United States Patent 7,868,149 (PLANT GENOME SEQUENCE AND USES THEREOF) - sequence listing, part 110

SEQ ID NO: 60001 - DNA, 23882 bp, Oryza sativa
cacttggagggttaccaacgtcaaggccatttgatcatcgggaagatctcatcttcttgatctttgacatttcatcttctatttctcaaatgattgatgcggataatccatggcttcaaatggcctcgcacggttcatcacgacacagtcttcactcgcccttcaccaccggtttcggttcatcggccccaagccccttgcttgcccttcaccaccgcatggtccatcgcagctgagcgtcacttgcgcttcaccgtcttgccataggtagtcacttcatacccgcatcttcaatatcttctctttaattctcatccatctataagtacatttcctagcttcttcatcggactaatcatttgcttatacactcaataagcgcattagtcccttaatcgcttgtcatcaatttaccaaaacccactaagggcatagatgctctttcaatgcctatcgaccggccgaacctacgaaacaccaaactcctgaatcctgatccaatctggacacacaatgactgacgaaaaactacggcaaaaacatcttaaacttttataatagtagagataagtccattttacaccctctaagtctttagtttgtctaaaacacacctcacaactttaaaaccggacatctgacccctacaacttttaataccgtgcaaaaaaccacctggtgtggttttctacactgtttttgtgcactaggatgccacctgtatagattagctagccccacatgtcagtccggttctccttctttctcctccccactctctccccccttcggcatgcgcgcatggattatccctctgcctagcgaggaccgccgcacacccatcgacaagctcgctgcgacggtcctatctcatcccttgcggagctgcaaattcgccgcctgcaaacaccgtcctccaatgcccattccaccaccgtggaggataacagccgcaaccaaatcgagctccaacacacaatgacttaatcctgatccaatctgaacacacaatgactgatgaaaaactacggcaaaaacatcttaaacttttataatagtagagataagtctattttacaccctctaagtctttagtttgtctaaaacacacctcacaattttaaaaccggacatctgaccccctacaacttttaataccgtgcaaaagaccacctggtgtggttttctacactgtttttgtgcactaggatgccacctgtatagattagctagccccacatgtcagtccggttctccttctccctcctccccatactctctctccccttcggcatgcgcgcatggcttatccctctgcctagcgaggaccgccacacacccatcgacaaactcgctgcgacggtacagagctgcagattcgccgcctgcaaacaccgtcctctaatgcccattccaccgccacagaggatgacagccgcaaccaaatcgagctccagcacctacggcggtggtggtggaggcggcaatgggggcggcgttctccagcgaaggcagaggcgcagggacgaagtagctccgagtggagaggtggagctcgccgaagatacatgcgcggggatgagctcgagcgccatgaccaccgcgagtttggcgcacccatccgctgagcttggcggaagcaagctcaagctttactcaatgagcagcgggctcgcctccatcagactgtggtcggtgcgaccggcgtctacgagctagctctgtcatcgttggccgcctagctcctcctctgcgagctccgttctgttgccgcagaccggtccgttctctggctcagtcgagtactacccctgctcctgctcgtgcttgtgctaatccgtcgtctcctgctcagaggcgtggaggccgaagagctttagccttgggattgacatgctaatgactgcaaagatgggcagctagcagcacaaagtactagcttgccgagattagtaaggcagcgtttgtttggagtacattgagggagaaagcaccccgttttcggcacgcacgcttcctaaactactaaacggtgcgtttttaaaaaaaatttctataggaaagttgctttaaaaaatcatattaatccatttttaaaatttaaaatatttaatactcaattaatcatgagctaatgactcacctcgttttgcgtatcttcccaatctcctcaatccccctctccttaaacacaccctaatagtagtatgagtagttgtgatagacaggagaggaaataatttaaaaatatacgtttttttccgtggaatttgcatgaaaatgctgaatataagacgatttacaaaagagtactgttacacgtactaaaattttcttacaaaacttttactaataaatttctcaaccgtttgatttaactagatgaaagttgtaagaaatctagatttactcatagcttgacaaatcagagtttgtaaacattttgtaagaaaaatttagtacgtatagacttttcctttataaaaatataccactgtcgcggtttggtttagcgagaacgcggcgtcgcacgggggatgtgcgagaacgagagcggtatcgctgtttagataagcgaggacgaagtgccggcggtctcgcggcttggagtaacgagagcgtcagcactctcgcagtatgcgttagcgagtgcgatggggccagcgttgctaccagtttcgcggcgccgaaacgtgagagcggcggcggtctcgcgcctgggaagtgcgagagcgagcgggtgccgcgggcctatgaaagcaacgacgggacgcgcgttctcgcacgaaggtaatgcgaaagcgccgcgcagtctcgcgcggtgggaatgcgatagcgccacgcggcggtctcgcggaatgggaatgcgatagtgcacagcacaggctcgcccctgcgccgaacacgagcgatgtgacagcgctgtcgcttgtctgatttgcgagaccgcgcttcgctttccaaattagccagacggaatcagtaatgtactgattattaagttaattacaattttatatttgcatgaattaacaacatgtgataataacatttgttttaaggctcgttagtaaatatatatgagaaaccttctgtatatgtactagaaatataactaccattatttaaacttttcatttgttagacacaacattggccatctatataaaataaaaaatcacatgagctacaaattaattgtaacttacaattagtacaaattaattgtaactttaatttaattttttttaccatataaattaattatgtctatctaatttttaaacccgaaccgactctaacccatataacagaaactacctctgttattattatcctacttaataataatatactatacattattaatattttatatttattaatttcatattttatatttgttgtttgccctaaggaccatgtagctttgcttcacggaagaggccgttgtcttgttcaaaatataaaatttaccggtctcgcaattctaacaagcgatcgagatcgctggctccacgcgcgttgttgcattgctaatgtgcgaaaccgtgccggactaagcaccaaccagaaaatcaccatgggacccactccacagtggctctcgtgctacgaaagcgcggtgccgaggccgctctcgcgcttcaggcatgcgagaccatgggtctcacgcacatctctcgcgcgccagtaatgccacaccacgggccccacaacgctactcctctcgcgcattgaaaaagcgataccgatcccggtctcgcgagggcaatcagcgagaccgttgggtccattcctgctctctctcccaaatcgcaagaccggattaggtcatctctacgtggtgctctcgctcaagggaaaagcgatactgcatcggtatcgcttacccaataagcgataccggagctgacgtcacgctttcgcttattgatattgtgataccgtgtcggtatctctcaatcctcttgcgaacctcggtatcgcgctttcctcccgcgatttcaatagtatatttgtgtaagtcgaccaacatctggtatatttatgaaaaaaatatttatgaacagtatattttcaaatttttttcagacaggagaagcatacacacaggtcacaagagacaggtcgaggtctatatcgtgcttgtgtcggagcagcttcttccctgctccctgcttagccatatatgcgggtcgtgcgcggcttccgccgatgaccgcgcgcagcggcttggatatgctactttcctgcgacaccttctccgccgacgaccgcagctgcttgtcggagatacgcggcactgaccgctcaaccctgccttcgcagtgcctctaccgccgccgctcctgaaaattaaggtcaaaacaaccaagcaatatgggcttgccccatataatcatatgcgctgacgtggcgaagggttgatgtggcatccaacgtatcatccacgtgtgcaaaaaccatcataaacagcccaagggggtcaaatatcaaatattgacagttcagagggtgtattatacccggtttcgtagttcaggggtatattttagacaagttaaaagttcgagggtgtaaaatggactttccccaattttatatactaaaactttatatctggttctaattcgaatcaagtgattttacatataatagtttcataaagtttctacttgtaggtttatatgtataaagtttcggcttgtaaagtttacagtatatacattgagtttgggttcataaacttaaaaatgaaaaagaaaccacgcaaatgcaaaaatggaaaacgagtgcttcgtaggggttaggcgcacgaacatccacgcgttaaacctacccgttattagctacacaaacgacattcatcaacggatccacggaaacgtatcttttgaagggcttgtgcgtgtacgcccgcgtggacaccctcctacttcaattttcatgtgcatgatgtctgatttatagataaagctttatacataaaaattagggcatttacaaatctgccactatttttttttaattttacaaggatgctacttaaatgaaagttatagtgatatttttgcaatttcgtagtggtcgtattatgataacgatttaaattagtggcaaatttacaattgccccccaaaaatacatgtataaagtttctacatataaagttgttgaaagcatgtcacgagggccttcgaccgaggctgccgaaaccagatgggcttgggtgaaacgccagctgagaagactaaggttttcgcctcgaacgtcttcgccactgaaccaaagaagttataaggcttaaaatggcctttcgccacttgagggcccatagtgaagcccattaaggggcccaaggcaaaatagatattagacactagttaccctcataaatgttcatgtacacattaactctaggactaggatgcatgagcttctactaagactataaataaccccctaggggcatgaaatggaggatcccaataattttcatcattaatacatattgttgtcgaaacgacaaccgcatacgtcgaaagacgtggttactcaacagtggttggaaaacagtaaagtgtattaaattaagaatttttctcgggatccccctattacatggccctagggggctatttatagccccattacagattcccactactagggtttaggttatacaggggaatttacatggttacccttatgatagggacattatgaagggcacattgtgtcctttacacacacacgggcccctactgggcctaaacagctcggcctatctatcttgcgaaatcccccgagggcatagcggcccgccaagtctcccgttaacgggttttggtgctatggcgaaacctgtgcccgtgtgccgaggctttcgccacatcatcttcgctcgttccgccttctgtcgagaactccacttgacgaaggtggtgttacccacaatcacggctttcgcccatatggcttcgctcttgtcctttggtgtgagcctgatacttgaacttttcggtttcggcaggttcggccgaaggccttccatggcaagcctccaacacatatgctttacttttccactgtgtgaaccacgtccttcgacatgagcagttgtaattcgacaacaaagttcatatgaataattgagatgtgtataaacttgataaaaaaaatcatgtggatgcaaataaggaaaacgagtgttcaacagaccaaacgcgtgaacattcacgtgttagacccagggtttacgattccgagatggctttccgttttaggctctagtggaatgacggttttcgcgaaatctggtggagagccgataaattccgaacaaatttcataaaccaaaatttaaatataaattccctgattttaccgataagctcacaaaaaccggtcggctttgacaaaattctgagcgaaatcatcaaaatttcaatcggtaactagaaaaagaggtaaactgaaattgttttccttttttaattcattattcttttctttcctattgtaaatttcagtaaatacacgaaatacattaatttttttcaaaaatttatatcccaataggttctatgaatatcatactatttattagtttttttatttttttttcttttttatcaattcaaatttgaatttggatgaaacttatcgaaatctcaaacggcttttattttcgagccttgtcgaaacctttaaatttcgcagaattcgactggttttcgtcagagttgtgaaccctacttagacatacctgttagtaggggtgaaaacggtacagaaacggacggaaaccatctttatcgttttcgttttcatattttattcggaatcggaatcggaaaccccggatacgaaaatggaatcgaatattatcgaaactgaaaacggagcgaaaacaaaccggcgcgaatacggtaacgaaaatttatcggaataaaaactccctcaaactgataaatccaattgaataaattatgtatgtttaaaagagtaatgttgttgataaatccccatgtaggacaaaaaaatattcttatgtaattttagtttgcataacaaatatttttttaaaaaaaatagccaaacaccatggtattcactattcagtgcttaaaaaaagaatccagggtatttctttcacaaaatttctggtaattccgagaaaatttccgaccgattccgagttccgacagaaactgcccttatcatttccgattccgtttccgagaaaatatttccgaatttatttccgtttccgaaaaaattccgaccgacatattccgttttcgaaaaataggttcgaatccggaaagtttccgtaccgttttcacccctacctgttagatgttgcataatcgaaagctacggatggatccataggctaagccagaatcatttcaagtatctcacactctcacgcgcgtgcatgatctagacgcgcgaacgcccgtccgttaaacccactcaccgccatgtgcggcatatgcctgagtgcgaagcatagtcgcatgacgacctacagggctacaactcccagtcccagcactttgccgagaaaaaaaagaaaagacccaaaccgcccatgaccccgcgtctccgccacatcgtgacaccggacaccggtgctatgcaccacgagagcacgagaagagacgcgcgggtacaactacattccacacgcgactactagctaatagcaaagcagcagtaagtaacacgttacaccggcatccccccaggccccaacccgtcaaagcataagcccacacagcgggagaaacactcggcggcgaccggccgtcgcggcctcgccgggaagagcaggttaattagcggccgctcgatcgacgatatggggggcagcctggtgtccatgctgcggtggccgccggacctcggcgtgccgagcctggcggcgctgctgccgtcgtcggcggccggccactacgcgggcgcgccggccctccgcgggtggcactggcagcactggtggccggagcggctcggctcggcggtgcggcggtggccggagctcgtgcaggacttttcccccgtcgtggacgccgtgctctggggcctcgtcaccgccatcgagtccgtcgcgctcttctccatggtgtgctgcttcttcctcttctgcggctgcacgctatgatcggtgccactcccccaccatatagggcgcgcgtacgtacgtacgtatgcataattgtatatgatcgcttcctagctctgctctgaatctcccaactgtttttgattgattttttttttcagatgattctccattttgttgtcggttattcactgtgttcatgcttcatggcaaattaatttagatgccgctaattgtattgtactggtgcttagtgcgtagatttgttactggattttgcttgtctgatgtatgtgcagagcagtgaggcagaagaacagcaagcaccattgatagttttgggtgatgaaatgtttggggagagggattgagtgagattcggttggactagttggtgcgggtgcgcggtcggaacgggggtgagtccaaccctcgaaatatcttatgattttcttaatcgtggcgagtccatgaaactactatttcctacctgattatactcgtcataaaaatataacaaaataacttcgaccactatattttttattataatatataaaaatattaataactgtattaaaatatcaataactgtattatgattttatggaagtaatttttaatcatcatattttataaatattttagatgttatttatagtcaaagtttttaaagtttaacaatagtctgatatgacaaatattattaactgaggaatatataaaattctttttttactcccttgtctcatataagtgcacttactcactccgtcacttaagaaaactaacctaccggaagtaacacatatttttagattaatagtatcataacatgtcacatccaattatatatttgttatttaagattgaaggaatattataggatatgattgaattgttcagatttatagtacacacgtagtactagggtattggaagtttggaactgaaggtgtagttaataccagtaggcagtagctgttgtagacagtgcactgatgagtcgctgattgcatgtcacgtttcggtgttgtcgttctgtcctaggacctcgtgaagcgccactgttgcagtcaggaccatttacaggttaaaaccatgatccgatgactgaccaaaatccggcttcattcctactaacacggcccttttgttcagagagctgtgatgctttcggacgtcgcataacacggcctggcttcaacaggcaatttggcggcatcaacgtgtgtataactgtatatgctcataaaagattatctacgctttgaaatttatttcgactgttaccgtagagtgttcgaatgaaatggtgtctttctgaagctaatgagcgaaccgccacaatttaagatgacaaattttactataggaaatcgtcggttttagctaaactcgtcggacgaagcgtcgccttcctctgctgcccacgcgctgcttcccatcgacggcgatgacccccatggcaccaacggacgggatagagagagaaaagagatgaaagaactgacatgtggatccagggggtaattttaagagtaattttaatatttcaagtgatttttcgctcctctccaaccagaaattattattttaataggtgcgatgtccactgtcaaattaccacgtttatagagtatttactcctaaaagtcactttgtgttgtgttttacaattaaaatcgtgaagtaacgatatactgtagaaaaatttaccatttgagatagcttcgacacttgatgtgtcgagtatccccgcaagattacataattctcttttattactagtattttataaacagactcctaatatcttctctggataacgaaatcctttttattaagtaggtattttaaacagcctcctaatatcttctgtggatatctgctgctcgcaatggcaacgtttattaatgagattgagggcatgtttactttgatgaaaaaaaccttattaaattttagtaattttggcataattgcctgccaaaattttggcaatttgacagcaaactaaatatatccacttttttaataaatttatcaaaatttgataatgttgaaaatgacattaaaatgaaaaggcctgagtaagcgagagctcaacaactgaacagcagacagacgttagcccccattgccccacgtgtagcagcaccaaagcgcgccagtagagagtcgccccggctctcgtccacacaatgatacaaacaaaactaaaaacgacccgtccgctcgacacctcgtgctgcgcggacgaaaaacaacggagcccgtcggtcccggtcagccatcttattttgagcggctgacgcgtgggtcctacagtttgtgatctttatatacgaataacccacgttagagggcagtagtacatgagaacagataaactcatatcccctttaattcaaagaaaatttataggaattcagaggattttattcttatagaaaattttccaacatagccctttgaatcgaagtaatgaaccctatgaaatcgtatggaattcctatggaatgccacttctatacgagttttgaaggaaatttaacgtgaggtaggacctcatgaaaataatcccttgagtttttatctcttctcaaattcttatggtttttcctacatccaaatcaaacggtcattcctatatttttgtgttacaataatttgttttacacttgcatttatgttagaatcctatttttttatttctctttttttattcctgtgatttaaagggttgagaatattatgttagaatcctatttttttttatttttttttcctgtgattcgaagggttcttattattctcaggtgggagagtgtgacgtggtcgctcttgtctctcacgtgccaggattgtaagctgcagcgccggagccggagcttaacgccatttggttggttggtccggtcgcgagaagaatttaccgcgcgcggtgttccgtccgtgccgtgcaccacgaatccgttctcagcgagggtcggataaggacgagcatcccgggcttccttctttctttgagcgtctacggttaaaactcctctactcgaagggtcactgtcgcctgttattgccttgcaaacgtaaccacgtttttcggacgaatcaaaactcagcagaatatgatatgcggtctcaatttcgtagcctgctcgatgcaaaggcgaatgctgcattaatgaagactgtagcaaggccacttgcgattgaaaaagacaggcgagcaagatttatcctgcttctgattttattccgaaacacgcatggcacaaattccacggatgcattttgcgtgcatccaaaagcctttcaatcagcacagctgaattagcgtaaccggaagttgttaaaggtcaggacacaattcggtgttcaccctcagctttgaagattttcgcccgttattcttcctgtcctggtaaaaaatttggggggattaccgagttccggaacgggtgctcactcgatcttaaatccagattttagatcaaccacctcttcgatatttctagccaaaaattctgcctctccgatataagaatgtggtgttagcttcagaagcgacgatcgtgccgcctctggcaagtctagatcttcaatgaattgccgtatgctgtccttggtgacagcctgccctctggtcatttccttcagcttctcataaggttcagggattccataccttcgcatcacctacaaagatgatataataatgtatgatatgcatctgagcttgaaagacgacagacaaatgatgatgaatacagttgatgtatctggtgaaaatgccaataggtgaaattacccccaatatcaaacttataagttctgagaaattttcaaaatattgtacgatgtaggagaatatgtcgttttcgaaccaaacaaaagcaattaaactaaccattctcagtatcaaaattcaccatgaatacacctggctaaaaacgtaaaaatcctacctaacaaagcattaagggcaatgcaaaatcacaaaacaagcatccaaaagacactttcgacaatttgaaagcatctgaagaggcgcacaaatttctaggacaaaccaatacaactcctccatggaagcataccattgtgaaaacaaccagaaaccatatagaggacaaaaagaatggtcttactgtctgtattggctctgcaaggacctcccatgtttgatccaagtcttcagataaccgggattcattcacctaacaacaggcaaaattcagcataaatacaacgaagtgtcatagttacattttggctagtaaacttaacaaagttaaggtcaattacaaaacagactaaatgtctaaaattccaatagtccgaaaatgaaattatgtgtagtgcacaaaggaatatcttgtttctagtacgacagataccctgactgaggtccttcctgtgcatattgagtagatacaaataatagttggggtaagacctagccacatccatcactttatagttcacttagtccaaaaacataaagtgtgggtgggtggatgtgcatgcttgggcatcaaccattcagcatcacagcatgcatagaaagacttcaaatacaaaatatgctagttcaatacttggacaatgataaaattatctatacaagaataattcaagaaacaaccaaatcaaacaagaggaggattgtggccacctacctgaaccttattgattcctcgcaatgtagctttgtaagccaagagtgaatgccctaatccaacacccaaatttctcaaaacagtcgagtctgtgagatcacgctgacagagagacatggttgctcattagttcaatcttaagtaaatagttaggcatgtctgactgcttgctgtattttacatcagtggcaagctacaatttttgcatgcacattggttgaccaaaattgcggttgcattgaaaaatgaggtaagaaagcattaaattgtgcagaggtaagaaagtgtagcgtgtgccacgagttcgacagaaatccatggactatagcctaataaagccaaacttaagaacaccatttgtggcaagttaggcgtctgttcttgcatgtgcatcaacaatggatgatgtactacccctttttcacaactggagatagtaaaagtggaaattgaagagtacagacagtattatacctgcatccgagaaattggtagcttcatgcttaaagaagacaatgtaccattggctatagtcaaattgccgtcactattttcgaaatcaatgggattgactttgtgaggcattgtggaagatccaacttcaccagcctttactatctggaacaacatttggaaggatgcagtaagttcaaacagaatctaaaactgtagaccactaagtttttcccactatgtactaaacgaattcaaccaaaccttaaagaacagtccttgcatgttagtattacctgcttgaagtagcctagtgatatataggtccacatgtctctatcgaaatcagtcaagacattgttaaactgaacaaatagattgaagagcttcgagatatagtcatgtggctcaatctgtaaaaaaaagttaaaactgcgtcagaccaaagagtatcatatgactttagaatttacagcgcagttagataaatggaaagtgtattaataggaaattctccacaccaccatagttcaagaataataactccaataaagcactgaactgggaatacaaatgaaacaactggatatcaaaataatgaatataaaccacctgggtaacataaggattgaactccaagcccaacgatttgacaaaatcttctgcaaccttaggccagtcaacttctggatatgcaacaacatcagcgttgtaatttccgacagctccagcgaatttccctagtatcttgacctcagaaaaactatttcctatgcttgacaatctggccgcaaaattcgccatctcttttcccagagttgttggcgatgctggctacaagcaggaaagtggaaatctaagctagcgttataacttctaagcatatagcatcgattacagtgactctgtgtacatatgtacgacagtacaagcatatattactgagtatacttcagaggtggttctcgtacctgtccatgagttcgcgacagcatagggatggttgaattttgtgttgccaaggagcacattgctttgcatatgtccatcataacagggaacataactgtatttaccccctcttttagagctaatgcatgtgacaagttgttgatatcttcagaagtacatccaaaatggaagaactccaacacctggggacaaagatacactcaacagctagcaacgaagtaatagtatgttcaggtattggttcacacagaaggctgacatacctttgcaatctctggatttgagctgcatttttgcttgagaaagtactcaacagccttcacatcatggttggttgttttctcaatctttttcacttcttttgcatcagcaacactgaaatcctggataatcgcatccaggaataactgggcctccttgctgaatggaggcacctcattgatctcagggatttgggagagtttcagtagccactttacctacagagccagaagtcacttcagataagcaacattgattataacactagcatcatgccccagtttctgtatttaacacatgaatcaagcatcctagtttatgtgaggaaatgatgaaatacactacaaatgatacgagtgcaaaggaatccaaataaatgatacctcaacgatgacccggtatctgatgaggccgaactcactgaagaagggtttcaggtccctggtaaagcgctcgtaccgcccatccagcggcgaaagccccatcaggcagaaagagtcgaagtcctctgcccgctgcatctcctccagcgacctcgtcgcccaatccatcggagcacgcacctaaccaaacagacccccccccccccccccgtaaggaacgacaactactcaagcgggagttcagagtttgcacgggaagagtctctgctcacctcgacggcggcggcgcctgatgcagagcagcgcaagcgtcgcggcgggacgcgggacgcaccggacggggcggcggcggcggccgtagcgcggtgggccgcggccgccgcgacgagggaggcggcggcggcggccggagccttcagcaacggcggcgccgacatgcttggggggttgtcgtgtgggaaaaccctagagcgagaaggacgcgcgcggcggctttgctgggtggctgcaggtgggccgtgcggcgcgcggccggagaagaaaggagggcggaggagatggataggaaatgattcgtagggtttaaggggagggggaaatttttccgggggagatggacggcgaagtggcgaaccgatagattccaacacccccaacaagtgggcgatgccaccgcgccaccatgaccgttcttttcttccaaggcacatttcccttctgtcccggactttctcagcccagcccaatcaccttgcctgagcccaatcaccagcccaatcattcttttagggaataagttcaccagggggtccctcaacttaacagcgagattttttgtgatcccttaaccacaaaaccagaaatgtgtacccctaaactccctcaaaccgttcaccggaggtccctcggcagtatttttgcccggttttgctgacgtggcatcctagtcagcaaaaaaaaattaaaaagtacatgggacccacatgtatgtcagctgcacattttcttttctcgttttcttcagtgaggcggccgggcagatgagggcgtggcgacaggcggcggtgcgggcacagcggcgcgcggggaagaagcgagagaggggagaggaagtgggcgcggcggcgggcggcgtggagcgagtgcgccagcggtggcgggagagggggagagaggcggctgggacggcgggagcggcgggcagggcagcgggtgagagtggcagcggagcggcggggctggtcatgctccagctgttgaccgccggggtcgtcgtcgtgttgggtgacctccgcgagcgcggtagacgaagcagcggtgggcggagggcagcgggcgattacgacggagcggggggcctggtcggcgagcggcggggagggggggcaagtgtggctgcggagcggcggcaggcggtcggcggcgacctcttcgccgatgcggagcgccaccccctctcccgctggcctcatctccgcccttgaagacgaggttgatgggctcctcatcgtcgtcgccgtccccgggtgggagcggcggcgcagggggctcgtaatcgtcgtcgtcgggcagggcggccttggcgctcttctcgccagagaggagagagagccggccgagcttcactcgcgagcttgtcggcggcaatggcgtccctccgcgcacgagagaagaaaggccaaaagcccgtgaacgcatgcatgatagctatgggttctcaagtgagggatacatgcatgcaatagagagaaaaagaccaaagcaaaagcagcttgtgattgatttgcaggctgcacgggttgaaagtgtatatgtatatattcatgaatgaatgcatatatgcatgtaactctaggcctcgcccacggcgacgacgacggtggagagacgacgacgagggcggccacggcgcgcggctgctccgctccgccgccgcgctccgctgcctctgcttcgccgccggacggccgcgccgcgtagcctcgctcacggcgacaacgacggtggagagccgacgacgacggcggccacggcgcgcggctgctcctcctccgcccacagcctgaaggagaagaggagagaagaagaaaagagaagaaaaaaatgtggagccccacgtgtttttttaatttttttttgctgactaggatgccacgtcagcaaaatcaggcgaaaatactgccgagggacctccggtgaatggtttgagtgagtttaggggtagacatttctggttttgtggttaagggacctcgaaaaatcttgctgttgagttgagggacctccggtgaacttattccttcttttagggcattcacgatttcaaaagtacaaatgacctcctatagtatttaatccggacacatggcgcccccttcctgttctcaagcggttttggcactgaagtagcaatccagtcaaacaacatttttaaaaaatggtgggactaaattgtaagtgcctttccctttctcagctccaacgcctagctcaccgggcactccatgaccagcgatccacgttagttgtttttgcccttgttgagccagccagccacaaccatgcatctcctcttggtatccatgtgctaggcagccagcgatatctaagctcgagatgaggtgagggagggagataagataaagggggaagaagtcgatgtcacttcatcctccacctcactagaccctgcctagagctccacattcgcccacactgccactagctctaattgatccgcaccctaccgctccagtcaaaaagggagaaagagaagaggtgatgagatgctgcggtgctaaagctcctagaaacacacatggtggagatggatctctgcagaggaggcggatgcggtgttggagctcgagctcgcctttgctactgctcgtgggcagtggagaggaggcaaattcgccggtggttggcagatgggagagaagtgacgaagagaggaagagtgcatcaagatgaggcgaccattgacacgtgggttcaaccatttttttaatttgtttttttgatggggttgcctcttgtatgtcaagtaggacaaaaatattgttcctcgctaggttaaggcggtattttgtctagtttgaaaaattgagaatataaaatgtatggtattggagttaagagggataatttgtgcttttataatagttgagggggtgggaggtaaattggatttaaccttacttgaaaaagttcatctctcacaatacaagtggcttcaagtgtccacctcagaagttttttttttaattttagcccttgtatatttcaatctacatgtaaattaaaaaatacactaaaatcaaataaaacaaaaaaataatataaaaaacgtagcgtaacctaatccaacatttattccccaccacccacaccggcaaaacaaatgaagacgggtggcaaggacactgccggagtctaagaaaaataagtagagaaggtggtgagggcgctagttgtaatggtcgaggaggaggtagattacagtgactgctgctgcatcatgcatgaacagctctagttgcacgaaggttgtcgttagccgaatctccttcctcccctaccaccatcaccatgcctcccttcctattgttcgttcccgtcctccttgccaccactgcaaatccaacgtcccgttcctgtcctcctccttgctaccgcttcaaatatgatggtttggatggtgcatgtggttaaagtgcaacctcggtggcactgcttagaacaaacggtctcaacgaaaattttgtatgtagtgatggtttgcgtggcccatggtggtgaagaccctaacaacgacaacagagcagcttgacgtgctaatgagggaccgttgcagtatgtagcgaggtgacaagatcaaccaatgcggctccccttgagtggctctacatagcaggagccttttctaggtgaggcactcattccttgcaaaggggcacaagcttcatgtggaagccactcgcctccactcctctctccttaggctgtgtttggtactctattttcctaactctcctctctcattttttgcgcgcacgtttttcaaactactaaatggtgagtttttttcaaaaagtttatatacgaaagttgcttagaaaaatcatattgatccgtttttgaaaaaaatagttaatactcaattaatcacgtgctaatgaaccgctccgttttccgtgcataggagatgggttcccaacccccacctccgaacacatcattaactacttaagtgcactgtgaatgttttcagtagttcatttctttgggatgagcccacaagcctagataatgttcaagttaggtagtttatcattgtcctacatttacttcttttttgctgttctttatcccaagattaaatctttattattctttataaggatctaaatcacttctttaaatgtcacggatcaatgtactggttttttatggacgacatagtggaaattattgtaacatttttgtgagctgtggttcaatatgtcatattaatttgtgtacctcattgtgtatatcaagattagaaatgtaccttttcatggtcagattaatttgtatcttcgtatacccaatggataaacactaaagcatctggaagtaaacaactacatttataaagtgagaaatggttctctatatatatcccatataactcttgtatctcatttcgtatatcaaagatttatgtgtatattttcataaatggtttagttattcatatcttcatctacattgagtaacatctatctctacgtaaacgactacatttatcaagtgcccttttgtataactttgactctagatagcagtcattgataaacataagcatatctgaacataaatgactacattaaatgactacacttattaagtgacaaatcgttctctctctccaaattaatccgcgtatcatttgtacataaaaacttatgcatatcttttttcataaatgaattaattatgcatatcttcgtcttcatcatgagtaactgcaatctatatggacataaatggctacatttatcaagcgcccttttttaaactatagccacagattacagatagcagtcattcaatatcataaaagaatgcaactcattattctcatgaaggaataattacacaatgacaatattttctttctcaccattttaccttggctttaatcctactttcagtcgatcaatccttctccaggttatagaatagcgtgtaccaaaagcacgaatctaatcacggattataatggtgcatttacaataaaacaatataatcgttgtttccattcaagtttcggcacgaaaaatacttataatgttttacatgaggagttatgatatttgtggcacgaaaagcaggactatactatgatactattaacttctctcgctacaatcaatttttttatagtagcactatctagcacatacataagaatatggtgagctaaaatcgacccatactactatcttagaagtttaaaaaactacaaccatcctagagtagcaattttgttgagataggacctattcggtgacaccaacagtgccgtatgcaggagtatactttcttcgtacttataaagagagtcgtttatgacagcgacacggtctccaaaacataactttgacttcttgtttatataaaaatatttattaaaaagtgatatatgtatacttttatgaaagcatttttcaagacaaatctattcatataatttttatattttcaaactcaacatcttgagagttattcatgatttatattttcaaggtttgacttaaacattgtcctaaacaattttctttatgagtacggagggagtagtctgcagccggcttgcagaatagttccataaacatcattttttttttgtcagcagctgttgccgtttgtacccatgccgggtcacgcgtaccctacgccccctaccggtgctccaccacgtcagcggctcgcgctcgccccccctccacccatcgcacacggcaaacacagcgcaaaacccccgtgtccgttggcaccaccaacccccgctatataaacccccccgtctcctgtcgttgccacaccgtcttctctcttctcctccgccctgcctcgactcttttctcccccattttccccttcccaactccccccaatacacaacctctcaactcagaaccccctcgaggcctcgagcctttttttttctgcctcgaaacaactgaaaacgcggggggttctctcgacagtcccccggccgctgtcaacaccaccgctcgcggcgacgcggaccctcgtggcctcaccggccccgggcaatgtcccgcagcagccgcggcggcaggcagtcggcctcttcggccacccggatggcgtccagggcccgaccgggtttccccgtggcgccaccaccacccatgggcccgccgccgcccccgccgatgcccccggtcccggtgatgtatctccggggggtcccgccgcccccgccgtggctcccgcagcacctgatcatctgcgggctcgatcccgcggccgccgagcggactgacgctttccggagcaaatccctcctcaacgtgagcaccgggggcgtttaagcttcgtacgcttcatcgtatggtcctatggtgtttgatctcgtggctaattttggggggatcttcttgtttttttttacgaggtttagttcatttctcgtacgggggttttgccctcgccggaggaggagttgaagaggcaagtggtggtgcgggagctcgataaggtaatgatcgttcgggtttcggagcttaaaggttaaagtttgcgatgctgactggtctgagagccttgatccgatggtggtttttgcagatagtgatgggttgggcgaagagggtggcgtacgaccagagggaacaatattggaacacaacagctacggtgttgacctttgggtcgtatgctttgggggtaaacaagaaatgttcgatttgtgcacaatttctgggattttttttttgtgttgatgcaatgtccgattgattttatagtgtatactgttggagtgatataattattttgcaatgcatttagttatctgtcatatgttgtgctcattttgaacctaaaagtgttaccattaattcgtcaattgcccagtcattttcagccactgctcttggttatgagcattttagagctgctacaggagaagccacgagctagacatagctcgttgttttaatatttggaattacatgtatgccatgttaattttagcagagcatgtttatttgtgagctcaaacaatctttcaatcatttttttgagtggaaacaatttactgctctagtttttgtgtgctaaagaagatgaccagaacctgagagagagagagagaaaaaaaaggagaaacttggttctttggcttgctcattgttctttttctaagcctcttggtgacttaatgatttattctggattgatgagccagaatatgccatagtgactagtgagtgtaagcgaataaagtttctgaatggatagatcatatgttcttagttgtgcttgtgcatagtcaacttaatgtggtgtttgttgatttgacataagattatatggttaaggaatacatagaaagattaaatcttgacatctgttcccatggacaatattctacatgtaaataacatgtaagatgtttaaatccatgcttgaaagactgatggtaggcaaatcagggaattagagaactcactaaatatccatttgtattgttgacattgtgcagagttttaaggatggaaatatacttatgcatacaatcttggctcggttaatcttttattacatgttgataaaatagactgggttaatagtagtattttaactttgttttgcttgtctataacattgcctcgtaactaggaattcccctttgagatttttaatatatcttattgtgacaagcgttgcctaaaatgttctgctttgaaggcatatggacctgaatctgatatagacgcagtctgtgttggcccttgtattgcatcgttacaggtgaatatctctttcagttttccctttgtccactagcttggagctttcgaaattaactcagtgtgtatgtgtgttattgtatagcaccattttttcattgtcttgcgacaaatgcttgaagagaggccagaagtatcagacctgcattctattgaaaatgctaaggttccattgatgcgctttaaatttaacgggatgttagttgatttcccatatgtccaattgccagttatcaatgctgcagaggcaagtaccttatgtcttatgattgttttgattacatgactatagttacatgctatcataattagtgttctgtactaccttatatatgtgttataattgtcccatgattaattgttgattcagtcaagttttcttaaaacaacacctttcactgaagatatagaacctgctggtgatgtcctggagctaatttgcaggctttattttttaacttccttcaatattttaccatgatatggtttcattttttgcagaattgcattcaatcatgcataatatttttcgaaagcattgcatgctaccttgttaagtacctattaatggattagatccccccagaaaaaaatgaaatgaattcgaggtcatgtgttattgtggggctccagtatcactggctttgattcaacggcgatactggagtcccaccactgctgttgcaggcttagtttgaatgtaatagtcaatgttcaccataacaccatgacttcatttcaataactgagttgtacatttacttgtgctctgtttgatgagtttaaatggcagagcatttataaggaatgacgccttcactgtctttatgtgtatatatagatgtatatatttaattggtttatggaatgtattttttgaaaataatgtattttatatgcctattaatggattaggtttcccccaccatttttt

SEQ ID NO: 60002 - DNA, 1522 bp, Oryza sativa
tagtcttagtgcaactagtatatggtcagtccttcctcttttgtttttgctgaactgttatatttgaataatttgttacttgaatcttcagttaactctattttaagcatttaatatccagtctccttttatgcagtagtcagagcacctaccgtttcttttttaaaaagcattgaatattcaaatgaaacaaattgacccacaaattttgttttctttgtttttattattgctatgccatttttatcttttttttaaaaaaacagaagtatttgaagacttaccaaaaaactttgaagctcgtaactgtagcactgctctacacctcactgaaaaataattaaggtccaatttatctgtatacttcatctgctttgggtagtgagatccctctattagtcaactgttgcaaattatgtaatttgctgaggaagacctatttttaacttatgtcaattatataggtggatctattcatgggtatgttttttaactaagcagacagctaggaagtggtgcttttgccttacatggtcttttgctaacgctagaatcctcgataatgttcttgtcagtcatctgcactttggtggactttagggtgacatttgctttcatcgttgaaatttctgctgctaacatctagcttggtgtttgcactgttgaacagggtgataggaatggtgatattaattggactgagctttttgcaccttttccgtatactgtgagatacaaacattttctccgtatagttctttctgctccagtggctgaagaattacgtgattgggttggatgggtgaaatcacgatttcgcaaccttcttctcaaggtttttttttcatcacctgcccattgtttcttcacatttatagctgcaagttctgattgtaacatatccaaactgatgttctgcagttagaaagcattggtgttgattgtgatccagatccctcagaacaagccgatcatagcatgattgagcctaatgtcgtatttttctggggtctcatgtatagaacgagtacaaacatctgcatcgactctgtgaaagaagacttcatgaagagtgtcaccaacgacatctatggaaaggagaagtgcacccattcagacataacgatgtccattgtctggccaacccatttgcccaaatgtgtgtatgctcactcagtttactcacagaatcgacagaatccgcggcaatttatgatgggcaaccaactgatgaatcaggactgcaatgcagtgcgttaggactccattattatctgaaatttgttcggcatctgcggatacctgtttgagaatagttagagatctgatactcaggctgttgagtacgctaacatcatcagatactccgaatctcttctgttttttggaccgaggcttgggatgcttctgtcacaaggactatggagggtttttttctttgttggagctggccggcgagagctgggtttttcgtgtcgagcttctagggcaaagtaagctcaatcgagctacttattgctgt

SEQ ID NO: 60003 - DNA, 3422 bp, Oryza sativa
attcctgcagcccctaatacttgtcgtatcaacaaaaaagcaaaccagacaaccaaccgatatccacaaccatctcaccgatcatcacccaatcccgccaatttagccaacagcagcgttaaagcaacacaagctcccgccagagattccacgcgcatgccatcatctccagcgcgcttcctcccagtcccagccacctaaacccaaaacccaagccgcacttccgcggccgcggccgcgcccggcgcccggcacacgggcgatgccttcccattccccccgacgaaatccttgagccacctcgccaaccgcggattcccccgacgaaatcgcctagggggcagcaaatgccgcgcggtccccgcacccgcaccaacaacagagcagcagcccccccctccccggatcgacggtgcgatttagggctcacctggcccggcgtgagggaggtcgaggcggccatggcgatcccacccgcggacgcgatcgcctccgccattctctctacagcatccgccccgcctccttcctgcgccgctcggatccagccgcgtacaggagccgagcagagaagagaagagaagaagagagggagaggacgaagaaaattaggtgcgaagaaaaaaaaaaagagaagcgcggtttaaagcggcgggtggatgtgcgcgtcgtacgagggagcgcgagcttgccgacgctgccatgtgggaccgagcaagagattccacggtcactgacagtgggggcagtgaggcatttcagagcttgtgggccccacacgccatcggatttgcgagtgacggtgtaactaaacggatgcttagtttggtcgatttaggtgagaagaagaagaaagaaatatttccgtttttattatttctctctttacacgaaaattgcagctttgtagattacaggattgcccctgtcggtcggcgagatcttgttgcacttgcacccctcactcactctgctagtcttcttaattccttcgcgtttagtacttgtgtttgcgtttttcgatgattatcactaacttaatctccccgcaaagaaaggcactaactttaatcggtagtactgctccgtttcttggatttcgatgcacatcaattcgtcagagcatcctgtctgtagtgaatagctcgccttaattaagaatcaaattcggaatttgagatggttagcagcgcagatgcccaactggaagtcaactacggcaacagatggtgattttctcgatcaaaagcccatagttgtaattgacgtgtgttgagcggtttatgcgatctgaatcaaagcgataagctgataacaatggcctctttttttctcatagttggcttgtaatatgcgtctacgtggagtatacaaaacgccattaatcggctttttttcacctgggaagtgggaacatgtttgcccaggggaacaggaaataggatttttatgttcagtgcgagagtcactagtctcgtcggtagttggtatgcgccctaacccaccaactaggatgcatgtcatacagatgcaatggagctagcttagtacaggacttcggctgcgttcgatcgtcgcttttagatgttagttttgctgtcacgtgaaattagatgtgtgattagcatataattaatcgagtattaattgttactccctccgtcccataatataagggaatttgagtttttacgtgcaacgtttgaccactcgtcttatttaattttttttaaaattattatttattttatttgtgacttactttattatgcataactttttgttttttatatttgcaaaaaaaagtttgaataagacgaatggtcaaacgttacaagtaaaaactcaaaatcccttatattgtgggacggagggagtcaaacttagaagtatttttttaaaaataacttctatataaaaaaactttcacaaaaatacgcaattggtaaacatgctaacagaaaaaacgagtaagttgtagtttagatttggagctttagaacgggaccttcgtctatttgtggtgatgcagtgccaaacaagtattttccctccatgtcaaaataagtagctgtataattcaaatttaaactacacaactagatttatttttggatagaggtagcatgatggtaacctgatggtgatagtaaaaaagagagaaaatgacttgtgtgaatattcctttgaacttgtattcgtggatacaatttatataattgatcaattgttgataatgaaacttaattagtgcttcttagcaataatatacttggcatgagcatgtgtatgccactcttctccaaaagaaaaaaaaaagaaaaacctcaaaagtcatacccacacaaaacaaaccttttaaagtacagaaatttaaaatgattttcatgaaaattagttagaaaagtgtgaatccacgtaaaagagaataaagggcctatagccaagtggttaaaagagtctcagtagtaccttaggtcctgggttcgactctccatgagagtgattttttcaggatttaacggcttttgtgctttcagtggtaggcgacgcccagtcttcgaagatgctcataggggtagggatcaccagtgacaagttcttcctatgagacggaggtgattagggagttgatgtgcggtaggcgcaacatgccgccaataaccaacccaaagctacctcgccacgagctcgtccccaaccatcccctccgcaatgccatccacaagttacatctccgtcacgccatgcgaaacaagtagcccgttggcggccacccttttccccacctctcattaccctctcgttattgctcggaggcctagtgacagataggaaagatggaagatgaggaataataccacttacgaccctttcagtttgcaatggtcgttgccctttctaatctaccgtggcctcatcccatcgatcgccacccctctccaagtcgttgccctttctaatctaccgtggcctcatcccatcgatcgccacccctctccaagtcggtgactgtccttcttcccaccacttgtcgcctcctcacagggccagctctaggtctagacaagttgtgcaaccgactaggacccagagtgaatggggcctatcctaatgtaatgtaggtcaagagtaaatagctgagcagtgtgccttcaatcaactgatgtatggacttcttgatgacctatcccattccagtcgtctcatcccgaggccaaaggcgtcgagcgggagcaactcgccgtcatcgccgacgactccttttcgacagacaacagtaaatgtgtctcttcctttgatcaacaattcatctcagttctctcttctactcttgcctggaccgtacgctcgtagcaggcagcagtgtggcacccagccggccaggccaaagagcgcaggaagcaaagtagcggcagcct

SEQ ID NO: 60004 - DNA, 2216 bp, Oryza sativa
atagtcctttgaaagagaaatctatatacgttattctagtttctttaaactaaatatttttaaacttatttatggttaaagttataaaagtttgacctcaatcttgtccaaaacgtcaattattatagaaccagagggagtatctggttaagatgatacatcctatcgggcttttaggtcaagatttttagtgttcttgccttctattttcctttctaattgcagttgtaagattttaatccgttagatgatgatgataattgtgatgtgttgtagtgaaaagaatattttggacaatattgagcacaatattgttcttaatgattttgaataaagaaatgagtaaatttcacaatggtctgccttttcttaccaatgttttacattgggctagggttaggtcaaaattttcactaacaccatatatatttgccaagagttgcactttgggctaggctccaggatttgagcccatctggatgagcagacatcttctccctcccacaagggcatgcgcaacctcgccgccgccacttctgtcgctggtcgggagttgagtgcaaggggacacgatgggggttagccaaggagaagggcgatgcagcaggcactgctctgttgttgttttcccttgctgtccagtagttcaaggggctgacgagattggctagaggatagagattaagcgcgccggcgaagtgagtggcggagtggttattggaaggaaaagcgttagagttggggacaacggccatggccatgaagctgacagtggcagaatcaaggtcaatgaaacaacattaggggacaagtgcttgttcttcttctccagctctagcatgggattgacatgaagctcgtttcgcgtgtgattgacatatccagttgaattaggggcagggcatagcaaacggtggagaagctgtgctccagagttggaaggagagaggaggctcccagcttgcccatttatctcctaatctcgctgacaagtgagccaccggtccaaactgaaattttttgctgtaagacctagcctaaagtgaaaacattgtctataggatggtccaaactagaactttggtaaatataactagaccaatgtgcaatttactctaaagaaattccagaagttcttttttaatcacatattggatatttgccgttttctctttttgaagcatcgtcaataaagttgttggagtttagtggttatttgccgttttctctttttttcaatttttttcaatgaagcatcaacgctatttatcgatattaagaccatattgcaatgtcacgttaggggattaatggattataatgtgtcttataactaaaaggaaatatctagtctaagggactattgtttcgagtttgcatagggtcctagaaaacgtagtagctttgccccctagtttgctacatctctatctatcagacggcttggtgttttccgtcggctgccggtcgaaggcttggtgagaatgtgagagatgggaagagagggaagagggaggatagaggaggaagaagaggtggttgttgacatgtggggcctattggacacgtcagtcaaaatcgggtattataaacctcggatacactgttttgcaagttaagagacgtgctacaattggtatcgcggtacaagaatgtaacttgaactcggcgtcaagataagggacctaatatgaacttattccaccataaaaaaaagaacttattccacgatggaaagctcttcttgcgttcagcagccagtagcccaacaaggcccattgttcgggttaaacgaacccaaaaccgtacgaaagcccgagaaaattgccttcgtctgcgccccgcgggctctcgtcccaaccgctcaccggcttcccgcggcggcggcggcggggctccatgctcacggtgaccctcctggacgcgcacctcgcgcggtgcagctcggcgcgccacctcctccagatccacgcccagttcgtcgcgtccggtctcctcgccgacgccttcgccgccagccgcctcatcctcttcaccacctccacccgcctcctcccgctcccgttccaccactcgctccgcctcctccacgtcgtccaccgccccaacgccttctcctgcaacatggtcctcaaggcggcccgcgagcatgggctgccgcacctgtgcctcccgctctacgcgtccatgtccgcggcccccgactgctacaccca

SEQ ID NO: 60005 - DNA, 5510 bp, Oryza sativa
  unsure (1)..(5510): unsure at all n locations
tgtttgcacggatgcctgaacggggtgctgcggcggtgagttcgatggtgtcgctgtttgggaggagaggaatggtggacgaggcgaggaaggtgtttgatgtggtggagcgcaaggatgttttcacgtggactgcgatgatttcttgctttcagcggaatggcaagtttgcagaggcgttggctttgttctcagatatgcgtggggaggggtggcctgtggatgaggcagtcatggtctgtgttgtcgctgcctgtgcacggttggaggtaactcggaatggggagatgtgtcatgggctggctttcagagctggccttggctcgaggttgaacgtccagaacgcattgatccacatgtactcaagttttctgaatgttgttgcggcacgaagattgtttgacagtggccagtgtttggaccagttctcttggaactcgatgatagctggctatcttaagaatggctctgtcaaggatgcaaaggaattgttcactgtaatgcctgacaaagataatgtttcttggactacaatgatatctggttgtgtgcaaaatgaccagtcctcagaggcactcactattttcaacaacatgcaagcccaaggaatcaagccagatgaggttacgcttgtaagcgtcatctctgcatgtactaatatgtcttctctcgagcaaggcaagtcaatgcatgagtacataagggaacaccaatataccatcacagtcatacttgggactagcctcattgacatgtacatgaagtgtgggtgcttagaatctgcattagaagtcttcgatacaatggaagaaagaggaacaccttgctggaatgctgtcattgtggggctggccatgaatggtctggtgatgaagtcccttgacatgttttcggagatggaatcatctagcactgccactccaaatgagataactttcactggagttttgagtgcttgcagacatgctggcctagttgaggagggccaacatttcttcaagttgatgcagcacaagtatcacattatcccaaacatcagacattatggatgcatggtggatcttcttggacgtgctggatatgtcaaagaggcagagaatctgattgagagcatgcccatgtcaccagatgttccagcatggggtgctttgcttggttcctgctggaaacatggtgataatgaggttggagaaagggtggggaggaagcttgtcaatctagatcctcaccatgacgggttccacactatgctatctaacatatatgcttcagaaggaatgtggcaacatgtaaaggacctaaggggctccatgaaacaatggcatgtcccaaaaattcctggttctagtgtggttgaatcatcactacctttgtgagaatatatcatatgatggtacttgaaatcagaatacagtgcttagagtggtttgactcaagtttcataaggtactgagccgatccttaattccttatcagcagaactagtgttctagctatcttatgagttgctttggtagcttgtcattcaaataatctttcttctgtctattttttcacatgtttttagataatgtatatttttcacataagctaaaagtttttgtctgccattaattttcacaacattcatcttttgatcattcacctgaagtcagatataacctcagtcgctccctcctcatttctgcaaaggtaacatccatccatctggcaccatgaataagtagccacccactacatggtcatgactccttttttgcatttagccatgcataatggtgcttatgtattatttatttattaatttgtaatctatggtgaattcaatctatgatggggactaatacttctgcattattgaaggcatggagcacatgagagtgagggtggtctacttcaccaaattaaggagagtaactgtctgtttatatgaatatatcagggagcttggtgaagggaggagggaagaataaggaagcaaggatggcctgttatttatagttagcagatgacagattaacgcaggcagactacccaagctcctaaatggtacgatttttgcaaaaaactttcttcatcaacatttcttagataacttgtttaaatcaacttccaatatttaattatgccctcgaataattgtcatgaactctgtgtcatccatcacccatcatctatttagggtgggatcttaaggggtgcaataagcttgcaacctttattggtatgtttagctttgtcgttggaagttttgaagttgggacaacatgttatcacacttattgcactggaaaacaataaagagaagatctgtagatgtttttttttccatagagaaaagaggaatgtaggtcaattccgttgttttgtttctaaggcatttgtttgttacaaaatatgtccatgttaattattatgaatttatgatgtacaagttgcagccgtacaggcagctagctnnnnnnnnnnnnnnnnnnnnnacatttctggttcagcgatcttattcagtattaaattcaagtctaaagaggcttatatttaaggtgaacaacactcaaaatttactgttgtgcatattgacgaaactaagtaattccaaacaaattttgcaagaagataatcattttgtattgactttctaacaaagaagaatttacggtgtgaaatgtgagatgagatccaccttgacaaagtgatagatgacctgctaaattaattattggactgaggggatttcattatatgacaaagtgaaagtgactggcctatcttaaaactgcacgggcaaatactactggaagagtttttctgtcagttccttgcatatgactagaaaaatatggaacactcctccctattttatattttaaaatgaagtagagatcaaatgcagaacaactttggcaccaccataccattatctcccttgaggggaaaaaagaattcaaagtcttattgacttttgactaacataacaaatgcatggagaaataatacaggtttaattgacagaacgataatcatagctaaagggaaaaaaagaatacaagtctaattgactaacatagctgacggagcgtggggctcctcaccgggagaccgcgcaggcccccctttgccggttcggccgggggccctgggtgagattctaagctcctggtctgagtgtggaaggttcgcgagagtggaaacacacaagacacgggcgatgtatacaggttcgggccgctgagaagcgtaataccctactcctgtgtttttgtggatctatgtatgaagaagctacaaaagagctggagaaccagagagctcttactctctccctctctagtccttctggatccgaaaaaatcccctttctaagtgggcaaggtcctccttttatacctcaaggggataccacatgcaccatctctctctttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacgtgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgaccggtctgtgactggtcacagaccggataaacgagcgcgctgcactgcgttacatgcggcgtgacgcgctcgtccaaaccgcaataaatgtggttaggtgagccccgctatgctcacctaccccatatacgtggcgcaaaacccacaaggggtcggggcgcctcggccctcggggccgagacgggagcggtccgacccctcggggagacaaagagaagggcggccgtatcaccctcgggcccgaccccccccccccccccccgagggggttaggccacgtgggtgatcgtgtctgcctcaagtctctaagtcatgatacttccggtcccatgtcaccgacaatagcaaatgcatggaaatgataatcatttgtgcaagagaaacaacatttcaaagatgaatccatcccccaaaagactaataatggttttgttgctgttgtgaatttgtgataatgcaatgaaagctcgattgcatcaaaatgttgcatgatcaaccggatcatctttgctgatccacaagttgtctgcaactcattgcacatcaaaataaatgaaaggtgaaactcttcatgcaaaactacaaagccatgtcatcaagcgaatatggagcagatgatttttgcttcgggtgttatacgctgtcggattctctgattggcaaaatatcttctcaatcctccaggatacttcttttgaatgtacgtcacatctatacacagttcgagtttgtttattttgtaaagagtaaatttcacaaaactacagatattatgaccaaattatcacaaaactacagatataactcggtgtatcacaaaactacacatttaacaccaaatttatcacaaaactaaacatttaagatgaagtgtcacgaaactacgtgtttagtaactaaattatcacaaaactacaggtttagaaacaatttagtcacaaagcaataatgtttatagcttcaccataacaatgttgctagggatttaaactccaaaagttgtagttttgtgataacttcaatattaaatacacatttttgtgatatttaaccttaaatctgcagttttatgataaatttggtgttaaatctgtggttttgtgatgcaacaccttaaatctgtagttttgtgataatttggtcaaaatacatgtagttttgtgaaatttactcttctgaaaacctcattgcatattagtctatttccgttggagcagttggggatttatcaactcaaatgccaaaataatttcaaaaaggaaaaaaaatcattgttgagaaggctttgatgaaagctgaaaggttagcctgccaaattatacagttctggaaatgggacaattaaattgaccaatctgttattgcttcctagaatgggttgccaattttctatagttccaactttctcaaatgagaaagtctagtgggtttaggtcagtaaatgactcatacccagaaacaaaaatgagcagacatcccctatgtaacgcattgtcctgcaaaaactgcagcatgtttacagatattctaagagcaatgctacgctgtatggagcattttcactatgtcaaatgcgggtaaatatgcgggtgcaaacccaatttaggtgaaaactagtgtaaaccctgagtttggaaaagatcttttacatggttgtgtaaaataatctcatcta

SEQ ID NO: 60006 - DNA, 1573 bp, Oryza sativa
cccccccctccccctatactcctccctcttctcccccttcctcctccccttcttctctttctactacagtacaccacacaattttttttaaaaaacaaaagttagaaaaatttatgtatagaaatactatatataaaaaaattgaatttaaattcaaatttaaatcgggtatgtaaacttttgacttataaactttgggtctataaattttagttgtataaactttagatgtatagaaatgctatatatagaaaatatttgaattcaaattcaaatttgaatcagatataatttaaatttaaatttgaatcgggtatgtaaacttttgacttataaactttggatctaaactttagatgtatagaaatactatatatagaaaatatttgaattcaaatttgaattagatataatttaaattcaaatttgaagcgggtatataaacttttgacttataaactttaggtgtataaactttagatgtatagaaatactatatataaaaaaaaatatttgaattcaaattcaaatttgaatcggatatataaacctttgacttataaacttttggtctctaaactttaaatgtgtaaacttgaggtgtataaactttaggtgtataaatttactaaaatagaaaagtaatgcggtgacaaaaaaagaaaaccaggtggagggtggggggaggggatcgatcgctgtcctaacccgaacagcatttccgcatataatatcgtcttgcacctgtggctctgaactcaattgctcttgggctgcaccgaaaactattcagcccaagatttgttttcttctcattttgttatgtttagcccaggggaaaaggtacacccaaggtccctcaaccttgtcatcgagttacaaaatcgtcccctaaccacaaaaccagatatctagcgtcccttgactagttaaaaccggtcacaatagatccttcggtgattttgaccccggttttgtcctacgtggcaactgagacagcgtgggacccacatggtgcctaaatgtcaggctgagtcatttctctccccctcctctctagtctctagtctcttcctcggttcctcctctctctctctatgtgggtctgtaggccggtcggaggtgcgaggcgggagaggagggcggtgccgcgacggcggccggcggcggccgcggtggggaagcacggcggcagcccggtggagaggaggaggaggctggtctgccggcgccggagctgtgcggtttggtttggttggttggtgaggggattcagggattggtttggtgtttagtactgtacgtgcacgatggcgacgtggaggagcttgccgcggaggccgacggcgatggagatggcggccatgacggccgggccggtcaggaacctcacgtcatggcgaacgtcgccaccttgttccggcacgcgatgatccgcggttgcagcgccatgaacagccctgagagtgaagaaacgtgtttgtgttggtaagttgcaagaactgtgttgtgaggtaaggtgaggaggagaatgaaccgaggctgaacatggccatgccatgggctgcaggaa

SEQ ID NO: 60007 - DNA, 15429 bp, Oryza sativa
agcccatctttgcccgtcgcggaactccgctgggctgccgccgccgccggccgcggtcgcggcgccgccctcctcttctcccgccttgcctcgccgagtcgccgactggcctagagagagagagagaggaggaaccgaggaagagaagagagggagagagatgattcagcctgacaatgtggggcctatatggtcccatgctgactcagccgccacgtaggacaaaaccagggtcaaaaccaccgaacgacatgttgtgaccggttttgactggttaagcgatgctatggttttgcggttagaggacgattttgtaactcgatgacaagttgagggacctttggtgtactttttcctagcccaggatgtgtgtcggacaggctacgtttaagcccacagtcctatatatggactggcccaagccttgaaatgttagacccacgtggtccctttttacagggccgagacatataaagcccaaaggagcttctagtcggacattggcccttcgagatagagttggagttaatgcacgtaatacgagagagacagtaacacataataataaattaagttttaattatgtacaaacttagaatataaattttatattttaaagaaattctcatatataattttttcgtacgatacacaatgtttagcagtttaaaaaagtgcgaacaaaaactatggcaaaatctacattttaatgaaaactaaggtactctctccatccacaaaagttacacatattacatattactttttgacataaagaccaagaaaaaattaaatcaccttggatgttacaaaatcaagaagtgaatataagcatgcaaccaataaacatttagatgactccttgggttctaataaaatatttaatttctctttttatttaagttttgaatgtataaagactacaaataggaacaacttatttggaaaaactcaaatgtgtaatatgtgtaatttttgtggatggaggaagtaaaatttactggttgcaagtttcaacatggtgtagtataatcaaggtaaccagtttaacatactggttgcaacttgaaagcccgaaacacaggagagtacttatctatttcactgttactgtttgccaagtgtatattattatgactttttttttactcaaagtgtgctgatcattttttggaggggaagggatgacactgcgttgaagacttctagtagtaccaagttgttccttgtttagtgccacaaaacgaaggttgttccttgtttaaactgtgccacggcgtgcaagtggcttggtgatactttttacagtgattttcggattgattagtacaaatggtagtcgagttgcagagctttgtgcacatgcatggtttgcagcagaagatcacaggaaggcaagtggcatccaagctttgatccgctgccggtggttgccgcaagactgcattgtacgccagcaacctcggcggatccggcgcgcatcctctgatgctctgatcaccagaacatgtatggcggttgcagtggcagttaaggaggcctcagctcagctgctccatcattcattagcaagttctcgaaccatcttctataaacaaatagtattgctaaatgaaatggtctggaagctttttgcttagtctggacaataggtactcgagcaagattgtttttttttttggaaaaaaaaacaatattcagaggaaaggatgtccttccgaatatttttgtaagaagaaaatgcaaatgtattgaggtttgaacactgaactttaaggttgaaattatatatcccttaatactgcactatcaagtgcatctcaagattgcaagtttgcaaccgttccagctaagggcacccgtaatggttatctatatgctctctacaagagatccatgtcagcatatttttctatttgaaagagattaaatggagagagagagagcaaagctatctactaacctggagatagtttatagagaaaaacgagacaatgtattagatagctatagatacccatgtaaacatactattgaggtggtttactattatctagtctattgctgagatgtacatgttttacagagaacaccttagagcacccacaatggtaaagtaaggtgctctctataaaacatgtacatctcaacaatagactagattaatagtaaaccacctcaatagtatgtctatatgggtatctatagctctctaatccattgcctcgtttttctctatagactatctctaggttagtagatagctttgctctctctctccatttaatctcttccatgtaagaaaacatgttgacatggatctcttgtagatagcctataaataaccattgcgggtgtccttactggtgctctaacaaagacacattatatgataacagcactaacaaatatgttcatgaatgcaacttagaactggctgattagatcggttccagaactacaaagcggcagccgcatccacagccaatctgcgaccggtcagccacgacaatcgccggatcgggctggagggttgcacgtacgcacgctctctcaagtctcacacaaccttccaccattgatcgagcgaagcatttgttgggaaacgcagccgtccaccgagcatcacgatccgaccggcccagaacgtttcggatcacgcaaatcgatcgtacatccggcgcccgatcgcgaacgaccaccacccatgcatgcatggccctccgcatgcacctcggtctcgaaccgatgtaaccaccaccacaggtccaagcgcgcggcggatggggcgccccaatccagtggcgctaccaacctcggtcaaaccggcggccaaccgaccggaggcgggccagccatcgccgggcacatgcgctgcgtgtaccgctgtgcgcgaggcgttgcacgcacctaacgcgcgcacccacatgcgccgatgcgccgttcgctcggtcgagaggcgagcgaacccggcctatctcgtccgagcgagcgatcgatctagcggaggggccccggacccggcggatcggagtagcagatcgacatgcgtatctcgctgcggattacggtgcctcggctgccgtcgcgcacgagctgcaagcacgccattggatgcttatataaaactttccgatcgaggcgcgcgcatcgtgatgccgcgcgccgctgcgtcggattggtagtgtcactcaccaccacgcaccggtggcgtgcgtgcggtgtgtcggccggcatgcagggccgttaaaaccgttgcaagttgcacgcagaatactgtgggatcagtgtttacccaggctctgattttgttttaggattccggagctccccgatcggtttcaccgtgttctaggattctgtccaagtcgctggcacgttggttggtttactgctggtgggttgacattgatctacaccgccaccccgctccaatatatacatggatgtggagtactagactggagtatttcagagactatttacctctattctctgccttagccaatcaaattactcctcttggcttgctcatgccttaacaaatgaatgaataagaagaattgggaatactcctactagtaggatgtgtttagttcacactaaaattaaaagtttggttaaaatttaaacgatgtgacggaaaaattgaaagtttatatgtgtagaaaagttttgatgtaatgaaaaagttagaagcttaaagaaaaattttagaactaaactcgaccgtagcatactgatctcttaacttacctactcctagaggggttttttttttaagaggtactcctagagtatatagagaggatttgattggtcagagcaattcatgcattttcatttagaggttcatgtcagtccaagggctgccagatagcacctgtccgcatccaaggaggactgttttatgtccagacaaaagacagagatcggattgggttccaatagcgatattcccatgtgccggccatctcgcactgtcacctcatcacattgctcatgactgtgcatgcggatatgttgctcgctagtacagagtagcacagtcaattactatccctccgtcttaacaaaactcacttttaagggcctgttttagtttaaaaattttttttcataaaaaacatcacatcgaatctttaacacatgtatgaagcattaaatataaataaaaatactaattacacagtttgcatgtaaatcgcgagacgaatctttagagcctaattagtctatgattagcaataagtgctacagtagcccacatgtgctaatgacggattaattaggctcaaaaaatcgtctcgtggtttccagacgaattataaaattagttttttcattcgtgtccaaaaaccccttccgacatccggtcaaacgttcgacgtgacactcaaaaattttcatttcaccaactaaacagaccctaaatttaaatcaaactcacttttaaatttaaatctagacataggctacgtacatgtctaaaaaaactcaacctagaaggaggtctgaaccatcccagtataacgaatctgaatagagagttattcagatttattgtattaagagagggtcacgttcttttctagatttttttttggacggaataagcatgagtgattttgttttggagggatggtatactagtatctcctagtgtggcgtatatgctaccgtatcaagggggcatacaattaatactaataagtaatctaaacgatatttctctatacatgccatgcatggatatattcccctagaaattgagcacatataatatatcgggatcgatttgagtgggtaaaataaacaatgtgttgtctccatttttcgtctcatactccattactacccccatgtttcgacatgaactaattgactcgtacgtactagtacaaaatgacgaagcttgggagactgtttaagcacgtacagtactacatgcacattatacggtgaggcccagttaagcataaattaacgccgaccggccaatataggtgaaacgttggcgtcatggcccgatcgatgcatgcatcttcgtacaacgtatggggggcagctgggacagcaaatggtgaaactatcggcgtactcgtcggtccgcgcgcccccttttgcccacacagccacacgccacgccacaccgatcggtagatcggcgggtccgcgcgcgcgaaaacacgaaatgcatgtggtgttcctatgcgtgccggataaagtccaagaatatattttagataatttctggtatcaatacaataataagagggaagaaaaaggctatatgctatcaatattaaacagtcttgctgaatatttccatctaatgaatgatataatgccaacatcagaaaataatgaagtaataccacaaaaacccatatatgttgtttttgacggaaagcttcctggagtgtacatatcttttgaagagatagtagcccaaaaaatagatgcaaaattaatgggtggattgtcatggaaaaaatatatagattttgatgaagctttaactcaggccagaaaaatattaggaataaactactacttggaaccagcagcaaaagaatatatacaaaaatgcaaaaaagccaaaaataagaaagctccagagaacccatattgttcaaatattaagaatgaaggatcatcccaaaaacctacgtataaggaatgcttgactaagggagtagatcctttggatggcgaatatatcgattggaaaataattgaaaaatttgaagaagcatcccccaaattaaaaaagaattgaaagaagaaatacttaaagaattaaagaaagaaatgaatgacaaatttgaagaaatgaaaaaagcatatgatgaaaaatttgaagtctccttttctgatgtagatactatggatttaggtggtcatgggcagcctgaccaataaagcaatataatataaattgataataaatatccattctttgggcgaatgaccaaagtatgaattgaatttgaatcaatccaaaatgcaaggacagtgaatgacatttgactgttaaaaatactgtggagaatattgctttcggcggaaaagaaaggcgcaggtacagaggtgtctccaccttggccaattcaaggacaaagtaaagccaaaaagaagataagcatctccatggtgcgagccagctcgtgaaaatacagtatctagaagataagcttgaagcatagtcgagcctcccgagctcctataaaaggaggggtttgctcagctgagaagaacaacgaagacaccattcagagcaaagctttcaagcgcgctctcaccctccattccaccattcttagtagtagtgactttagcctaccttgcatagtatattgaagcaaggagttgtgttataacgctgtgtaaggtaagaacagcttgcttgtacctaccttcgggtttcccgaaagggaaaaccgtatgtaagcttatctgtttaatatgaagtaattttccttaagtattcctgcacgtttattctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatctttttaagttgcttctaaaaagatagataggtgaggcatacggtgagtaccgagtaggactttacatcatctgaaacaagcttctgaggctgtctaaataggattcgccaccctgcaaagatcctaaagttaaaatatctctcgaagtgaacagtattgaacagtaatttaaacagtaaactaaatagtgtttttgaacagtgttttttgtccgaagcatatatatatatatatatatatatatatatatagagagagagagagagagagagagagagagacttacttttttttgttaattgaccatttagttgaccgtaaaaaatttagttttaccctcggatttcgatcgtccagcgcgcggtcgcggcggaggcatggagatcggagaggccacggcccagcgcaacacagcggcgaacgcgacgtggagcaacgcctcatgattattcgttatgtgcatacgcatgacactattctggtttctgtagcagccgtcgagcacgtaagcaaccaagctatcacacattcgtaccggtctactacaactctacaatagcgaaagcaattggtccaaaccttttttgtggttgacatgcatatgcatgattcaatatctatctattatattatcaacaccacgttcgctgtggcggctagaaattctcacattaatcggagaaaaagagaaaactttacaccattagatcttagttgtctaaattttaagggctgagatttaatagcatagaagttttaatatggtaatcagatacagatacgtgtattatagaaattggccagcagcagttagacttttcttaccaaactagcactaggaaacaaaaattgtaataggaatctagggaaaaaagctatgtccgtgtatgattttgtgtccgattgctatggtggctagctaccaaaaaaaaaaagatactacaaagcaatcacagcacgtacagtttcccatctgccgtctccaacaaaataacgaagaaataggagccagagaaagagaaggtacgaccagtacacgagagaaatagatgtatttgatggctggtccatttattcaattacctcggctaactctttgtactctactcctgttatgagggatagaaattcccacattaacccaaaaaataattttcaagtaaaaatacaatttaaaagtaactaaaattcggaattaaaaataaacaatattgaaaggagagtctatatatataagaatccaatatgagattaattaaaatttaaaatataaataaaataaaatccgaatttttttttaacaaaaagaagatttcaagtagtaaaataactaaaattcgaaattaaaaaaataagcaatgttgaaagaagagtccaaataaaaacccaacacaagagtaattgaaattcaaaataaaaaaatgagaatacaaaaataaaaatgagagtggaatacattatataaataactaaaatttgcaataaaaaagaactattgaaagaagagaccgtatatagagagattaattaaaattcggaataacaaataaaataaattctgaaaatagaaaaatatttataagagttcatataggaatataatttatctccaaataagaacccgacatgagagtaattgaaattcaaaataaaaaaacacaaaaatacaaaaataaaaatgagaatggaatacattatacaaataactaaaattcgtaataaaaaagaattattgaaagaagagaccatatagagagattaattaaaattcggtataacaaataaaataaattatgaaaatagaaaaataattataagagttgaattaggaatataatttataaataaaaaatatcggaatgaaaaatatggaattttcaaaacaaaaaggtccatttagaacactacgatgacaaatacaataaagaggggagaaacaatgagcccgtaaagaaatagagtggtggtggttgatgggacatctaaaaactataaacaaaacccgaaatagaatcaaatgacaattaagaggagggacgacaggcataccattaagcaacacggttatgacagttggcgagacttataaaaagtaaaaccccgatgataattatgttcgattttaaatatctctatgggcgggccatagaggagtacagtggcgaagccgttaatgttttggtgggacttctagaaagtaaaaaagaacacaaacaataattatgttcaattttttaaatcctaatgataaaaaagagaggatgcggtggatgggccgtagtggagtacattgacgacgtttgacgggacttctaaaaattataaaaacgaaacccaacgagacaatcaaatctgaaaactataagttctaatttttgaagttctaaagaggatgaatagaagtaatgatagatcaagcaatcaaataaaggtgtagcagaggagcaagggtagcgactaacgtgacttttaaaaactttaaattagaaacatgggaatgataaattttaaataaaatcatatgtaaaaacaataattttatacgggtactagccgcgcaattgcgcgggctacccaattataagagttaaagtaggaatatattttataaataaaaaaatatcggaatgaaaaatatacgggttctaaagaggatgaatagaaatagtgatagaatcgagcaatcaaataaaggggtgacagaggagtaagggtagctattgacgtgacttttaaaaactttaaaattagaaacgctagaatggtaaattttaaataaaatcatatgtaaaaggcaaataattttatacaggtgctagctgtgcaattgcgcgggccacccataagagttaaagtaggaatatattttctaaataaaaaaaatatcggaatgaaagttatggaattttcaaacaaaaaattcatctagaaaacagatgacaaatgataataaagatgggagaagcaacatgcctgtaaaggagtagagtggtaacggttgatgggacatctcaaaactattgataaagcctcaaatagaatcccattgatgattgaaagtaggaacaacggaaaggtcgttaagcaacacggtcacgacatttggcaggacatccaaaaaataaaaaataaagagggaaggcagcggcgagccgtagaggagcacagtggcaaagccaatgatgattggcgggacttctagaaagtaaaaaaaagaacacaaacgataattatgttcgatttaaatctcaatgacaataaagagatgagacagcggacgggtcgtaaaggagtatagtggcagtgtttgatgagacttccaaaaataatagaattgaaacccaatgaagataataaactctaaaaactataaggtccaatttttaaatgttccaaagagaatgaatagaagcagttgtaacgattgatgagacatctaaaaactattaacaaaaccccaaatataatccaatgacgattaaaagcaaggacgatggataggctattaagcaacacggtcatgaaaaaaaataaaaaataaaccccaatgataatcatgattgattttaaaatctcaaggacaataaagagggcaggtagcgggcgaaccgtagagaagtacagtggcaaagccagtgatggtttggtgggacttctagaaagtaaaaaatgaatctaaacgataatcatgtttgatttttaaaatcccaggcaacggatgggtcgtagaggagtacagtgacaacatttgatgggacttcaaaaaaaatataaaaatgaaactcaacgatgataataaactatatctaaataatgtctactacatccgtcctaaaatatagcaacttttagctatgaatctagacatatagttgtctagattcaaagctaaaaatgcttatattttgggacggagggagtaatttttaaagattcaaagagagagaatagaagtagtggttgatcgagcaagcaaataaggaaggaggtgacgaagaagtaaggagtaacaactggtatggctttaaactataaaattagaatcacggggataataaggtttggtcctttaaagttttaaaacaacgagatagctatttaataaattttaagtaaaatcattttagaaaatatataattttaaatgggtgctagccgcgcaatcgcgcgggccatccagctagttccttcgtatggtagcagtgctagtctgctagacaggctcttaattttgctcaggataagaaagtagaaacacgcctagatcattacgcgcccccacctcgcaggtgttatctcgatccagtactgccgcgattaatatggaaataaaagcgaaccgacgccagcccatgctcggtcgcaggccgcggtgtctttccaactcggtcgatcagcactccagtatctggtcggcacagcatttgcgtaggcaaccacatctccacacatacaagcagcacgtacagcggtacactatacgtagtcacgtagcaattttcgtaccgctagctgcagctagcgttgctcagtgctgttcccacgtatatctaatgacacccattctccgtttctcctgctgtcctgcatatacgagtccaagcttaataattctgccaccttcagaacaacattatgtggactcacaaaatctgcgaatcgatatattagcatgatttttttttacaactgtaacccgctgacacagatcatggagcattacaggggagaggaattgaagagcacaagagattaactagcaaagataaccagagtctaaaaaacaagaaggaaaaaaaggagagagtttgtgactaagcgccaagaaaaactcctaaggaactaggcaacaccgcaacccgaatcttctcttatgcggttaaccatcatctctaccgtgaaaagtgtcccctcaaagcacaagcatttctttccaaccataggtgtcatgtaataaggatgacgaggagagtcaaacctatttttgttgtgatcccacaaccactggcgagaagactcccactaaaccggaagcaaagattgttggcagggtgatagggaggccaatgtaacctaatcctggacaataacttgtgccaaacttgtcgcgtgaagacacactgcaccaagatatggtgatcattttcagctcttactcacacttgatcaacagctcaacaccacagtcgaagcgcaagccaaaggaaaagtttgcccttcacaggaccagtgttgcgtcaaagaaacacgacataggggaaggagattgatcccttatagaatgcgtttgttggtcgaggcggcgttatactcactgcccatccagtgctagatgaactcatcttggacgaagtcttgcagtgggcagttttgtattctatcccaaagcgcaaggaattgggagaggacgcgcatagtcagggcacccgtgatgttagagatccaagttttgccaaccaggccaggaaccatcgaagtggagttctggcgacgggtggggacgacaaggaacatatatggggcaatcaattgaactgattgcccgttgatccagctgtccaactagaatagcgagcatcatccgtctcctatgacgaccacgacagccgctcggaacatctctgacacacactgctcttgcggtagtttgaaaccaacccaatgctagagctagggtcaccacatctgcagggcctagcccatggtttggagggaagcggttcctctgacgtgaactgtcacatgacgtagtcactgacaggtgggcctgcgagcggtagggcccacatgttagccaccacgtctctctaacttcacgtcagatgatcccaatccggttcgaaggtccgtgatttctagaccctcacatttccttgggtcggtacaccttgggccaagcgacaaggcaattccggctgtagaccaagtttgaccacttccaaaggaaagctttcaaggtccaatccggcaagcccgatggcaagggagaggtgcaccgaggtggaggagaggacgagtgcaccaaggtcatcatgtccatcatagtcaagagcctctcctttcaagtagacatccagtcttggacaaaatccacaagcggttgtagatgctcttcagaagattcgtgacggagaggggactacctaggtatttacatgggaactccacaatcgcgcaaggcaggatacgagagactactaccatatcatcttccgagcacctgattggagtggtggagcactcatcgaagttggtaataaacagcctcgaagctggagtggtggagtggtgaagcgtggcctaggtacgccattgaactggacacacgaggaagataatcgaaggataacattgtggagaggggctgggatcgccattgacgtacgccattcagggcagtcccaacccataacactaaacatggtttccataaactccacatcatcaagaaactagtactagacattactcttccaatgcaaacaccactattccatactttaatttaatgctacttatctcacatgatgtcttggatattgtgtagaaaccatgtctcatgcaagacatggttttcttctctttcctcatttattcacttgccacatcattttttgtcctacgtggcaacttatttaatgatatgaacaccatcctaatcattgggttgggaatgccctcagaacaactaatcttgcaagatttcaatatacgaatcagttaaattcccgtataaaacggcactaaacaaaaccaaagctggtaattggattgtctatttgtcttcgtcctggcggccggtcgatcgattgatcgtcgcctctcgtcgacggggactgcccatgcgtctgcgtgccacactacatttattcgagctgttaacatccagcatactcgcatgtgaggcacagctgggcaccagctgctacctgggccccgctgcgcgacaggccacgccggctgcatatatcatacaacgccccatcttatggatgcaacagcaacctagcttgatcgaattaattcgtagcgaatgccatgcatcatcatattaaaccgattgttgttagggctcataaagtcataatctcgtccacctgtcgtgtcgatccatgtcgttactggttactggttaccaacccgtgatcgatgattctgattcattctcctcgtcttttagtttctttaattttgggtgattagttgtatggcctacccatcataggccatttgtacatcttatatccacagacagtgtcagtgtaatgttggcaaacattggacaggggactcacacagcggtccttttctctgagagtctgaattagcatctggttgtttcaggctcaagtcaaaatacagtaacatggctatcttcgtgctagagatcaagactccattataaaaacttcctagggcaagtacacaagattaaggggttgtttggttgatgtctaagcttgtcataactaagcttaggcaagttgtggcatgtggcaaaagtatggctaagaaatagttagccacaagtgtggcaatattagctctaattatctgagtatgatatgtagtacctaagggtaggaaagtgtggcatgacataactgtggcattgaaacaaacacacgactaaaaactgtggcatgactgaagtgtgacgtggtaaagtgaagcaatcaaccaaacacctcctaatttcaaaaagaagaagaagaagaagatgaattcagcctacttactttgagtgggtgttgatatgaactgagcttattaaatgatgaaaatgaaacgagcagagagttgatcaatccgtgtcgagtcaatatcggccatgctgtgatacagtggtagcatctgcagccagctacgagatgattgcaccgattgtttcctctggcctcgagccaaggatgtaattacagtacgtaattggtgctattcaggccagtttttttaagcttagattaagttgcgcggcgggccagggagcggccgtagagtatttgttttagtaatttagggtttagctaggcatgcacgagccaacgtggagaagatatcgttcatgtgcaaaacggcaaatctcttcccttcctacgtactactactactagcgtcgtccaaaatttgccgaccgaatccaaactcccatctgcgcaggcgcagcgacccaaaccgggccgcacgcggctacaccaccactacatataacacgcgcgaggggagcagcagcagcaacggccgcgataacacctgcgacaaaccgggccggggtgatcgagcgcagctagcgcgcggcgccatggacccctgcgcgttcgtccgcctcaccgtggaccagctcctcctcaagctgccctccgtgccgcgcccgagctccggcgccgccggcgtccacccttccacctccccatgcttctgcacgctccacctccaggaccacccctccgccggctcccactcccgcaccgcgcagctgccgctcgcgtcatccgagtccccgggccccgtcgccgccggggagcccgtggtgataagcctcgacgccgccgcggtgcagaggctctcggcgcgccccgccgccgagctcgtcgtgtccgtgcacgccgggcagaaggggaacgccggctgcggcatgagcgccggccgcgcgctgggcagggtgcgggtgcccgtcgacgtggcgcgcgccgcggccggggagaccgtcgtcgcgcgcgacgggtgggtggacgtgggcaa

SEQ ID NO: 60008 - DNA, 25979 bp, Oryza sativa
ctgagcacgctgcacggcgaccgcgacgcgcaggcgcggcgcgagcagcgcaaggggtggacggtgacgatccacgacctgtcgggctccccggtggccatggcgtccatggtgaccccgttcgtgccgtcgccggcgggctcggggcgcgtctcgcgcgccaaccctggcgcctggctcatcctgcagcccaccggcgccgggccggcgagctggaagccgtgggcgcggctggaggcgtggcgggagcgcggccccgtcgacgcgctcggctaccggctcgagctggtgttcgactcgggccccaccgagtgcgccgtccccatcgccgagtcgtccatcagcaccaagcgcggcggccagttcgtcatcgacccggccacgttccccgtgggcgccgccggcgccgcgtggccgttcgccggcggcttcgtgatgggctccacggcggagggcgaggggagggccagccggcccaccgtgcaggtcggcgtgcagcacgccacgtgcatgggcgacgtggcgctgttcgtcgcgctcgccgccgccgtcgacctctgcatggacgcctgcaagctcttctcgcagaggctcaggaaggagctgtgccatgatcaagaggactagcagggagacgaaacggaatcaagtgcatgtacttgggggtttggcttgtgaagttgtgatgcatgcgatcactttcatgattgtgattaaattagttaactatagatattcaattgtttcttgtgaaagtgatggcctgtggctgtttttagtttaggctgggtcggatcacaagaagagaaacgtatgctctatattctttcctcgcgatattcttttgattctttttaatttatatacgtttctgttcctcttttttccttctgaaagtctggaaataaactcggctgcccgatgcaaatctgccctttggtgtctctgtagactgtagcctgtaggtgcctctgatgagttgatgtacactacacaaattgtcttttcagtcaacaggttaattatactatcttatttttcaccatcccgcacataccaatacccaaaaaaaaaagaataccctcgttttatcaaatcccaatacaattatttatcactttatcatctcccaatatattaattcttcactttcacatatttcgatgcaatgatttactcaaaaactaaacttatttgggataaatgggatgtcctaaaaataaacttatttccgaacggaggggtagctatttttggtgtggaaacgttcggccaggacagtgcccattggctgatgggcttaaacctgacgtgtagcccattttcggttggccacggggctgctactgacatgcgggcccatgtattacgacggaacggggctgtggcagacctacggcctgttaaggtacacatgggccgttttgggcaggttgaggtgtatttacgacccaactcgtacaactgccttccgattctggtgggcttgtgggacgtagggttgggtcagacgctttccattgtactccctccacatcaatggctagatttgtggtggcgcagcggcgccggagccatcagccatgggctcatcatcgtcgtgaagtatacgtttcagtaagtttcttcagtgcagcgtttggtgattatttaagtaggaatagccttgttgttcctttgtgaaaaaagagatagtctgttcctgtttctagagaaaaagtgtgttagttttgccgttgcgatattttcattaattctatctcttttcttgtttgctgttagcctattagtgttgtacctgatatggatgactataaacgatatggtattaaatttgcattgttcataacttcagtgtgttcaccaaaaaagtacatcctctttgttttccgatgcgagaatttagaggatttaccatcaaattcgcctgctttagggcctattaggattgttaccctaccaaaattttttgtagtgccaaaatagggcaagttttggcactaccaaatatttggtaagataagattatgtttgatcatatttggtttgctaccaacatatagtcaaaatgtgaaattgtagtaaagtatgttctagatgatgccaaatctagattaggtattaccaatgaatgggcttcaatccaaatcaaacacaactactattcaaattaccaaaatattggtagggcatgtttttggtaacaatccaaataggcccttaatttttttaccacctaatccgcaatgccctcaataatatattattagaactgttaattagtatatttgataccactttctatgtttttcatgtatttcttatttcttaattccattgacgttcaagcgttttctcagagaacgcaatacaaaatcaaagcagtattgtatatctataagctatacacataatagaactacaaaagtagtacacaagcatgtgtacaaaaaaatctacacaagcatctgtacaagtaacattccaacttcgtgcttgaatcgatcgccatgaattgtgtatatcttcattcttttccttgtacttaaggaatcaaattgtaaagaggatcaatagccagcataacatgactatccatgcaggtcaaacgttctttggcctgttggattgtttgattgctgaaacaatgtccagcctattgagttcaatgatgttatgtcaggctgccggcaagtacaacagaagcctgtgttattgccctcgcgactctgtgaatctcgtgctgtacaaacttccacgattctgtagtgttttccttccttgcactagctatagcattttctacaccaggataagatgcactttcccagtcattctgttctgatggtccatagacctgcgagaagcaacagctgccaattagcacaaaatacaaactgcaatctgaaaaccgtgatatcatggtgtaattcaaaacaagaaacaatgtaaactgaatccacacaccagatgtttgaaccattctcgcttgaacaggccttccctgttagtgaatgcccgttctgcctgcatgagccggtcattgagcgaccgtattttcattgaatcctttttcagctggttgctcgacagttgcctttgaagctcctaagaacagtcattcctcttagtcatgatgaaaacctgacctagaaggctgtctgaaatagtagaaattcttcatgtacatttacctttctctcgccatttactttggtagctgccgttttcagagctctaattgcattgtgcagtggagagcaactgatagccgttccccttacttcattctctactaccttcgtatatgcctgtgataaaaaaaacattaaaatcacgtaataattccagtcacagaaaagggaaatcaacagagttcctctctacaaaatactactggaagcatagtgatgatacctcaagttcaacagggtaggacatgtaattgaagggcaggatctcttcgtcagcaagcctcaaagccatcattccccagatgctagcagctgtaatacgaaaatgccgctcatcatgttgcagagaaagtactaacagccttcaaaaaatacagagcaatacctgcagcgtgcctactgaaccctggatctccgaatttctccatccacacgaagtcatcgtataacgaatgatatatgggatagcctggtcctgcaaaggacaaggcgaaacaagcaaaatccattaaaaagatagaagtgaaaaatccatttaaaagatggctcgatagattctggaacatgaaaacccttgccttctccaaaacccatgctggttgaaggaataccaacatgctggacgaaagctgaaaaatctgatccaccatggcctagccgtccaatcttttatgtgggggcaggtgatcagcaatgacgttaaaattattttttttcgaaatgaaaattttacagctaaatatatcaagtaacttggaaataggaattgctactataactattctgtttctaatataaaccatcttacaactcaccaagggggaaatgttggatttgacccatgaatcatacacggcttgagatgaattgtcaggatcttgaaccttcatgattggagaaagtgcatttatagttattagaaatcacaaccaaggatacgttataaacataaaatgtctcactagtgtttgaaaaaaaaagttgaaacacccattattgactatttctacagtaaaaccaaaagaaaaggcaataaagctctgccattttttttcgtcttttcccccaaaaaatgtcaacgtgactcgttttcaggaatgatgtgctcaccaatttcattgtttcctgaaatagttcgtcaagttgcggagttgcagagggatgaaataccgggccaactactgaaacgtcaacgttaagataagcaacagctcttgaggaaagcatctccctattttcttcaacccattcagttgatcctgtctgcataaatgtaagttgtgaatgatcaccattctagttgctcttactctgcataactctgtacatatatagtgcagagagagagagagagagagagagtcagagatatttaccagcccatactcttctgcatcccagctgcagaagattatagttcttctaggtctccatccttgcttttgcagcaccgaaagcctttgagctagctaaacgacaagtaaacaacacgccaagatgcagacatggccatgttctgagtgatcagtcgcagtattataaaacggtgttttggctcagcaaagttacgataaagtacagcctactgaacttcggagaaagaactttgtgccccaaaaattacctcaatcatagctgccgttccgctattgggatctgatgctccaaacgtccaggcatcacgatggttaccaaggataacatatctgcatcacaaaagggtcaaatttcagttaagtcacatcctaagttcatctctgatttcattttgtgtggttgtgcctagactttctgcagactgatacgtctctaatcagtcagctacatgatttttttaaaacgaaaaatgtgtagctgtattactttctgatctctatattctgcaggatatggatatgatagcaacaggagacggtggacatctacatccgaaatataaagtgagccatgtatagcttgccaagataatatttttgttatctacaaatctgttgaaatattgaaactacagagggagaaaaaaaatgtcaagggctcccactatccaaatgtcaagggatagaaattatacaataaatattggactagaaaatcatctgttgataatggtgggtgattgggtgaatatgtcaggcctagattgataatgtagaataaaattgttgtaattatacattcccggcaatgataagatgaaattttgtggcaaatataggcatgtaaaagtaccacggtagtgcagagtattaggtcaatggtagagcacatgaaatttttttatcggtagttatgaatcttcataattttagtgaggctagagatatattacagatctctatcaacatatggttagcaattccgaaaaaaatattgtcaacgaatggtccaaaagcagtgcatggcaatgcccaagtgggatgcatgtgttaacaaccagcacaggttgtgattgaaaatctgaagcagcagttagttagagaaataccccatgaagaagtgtatactggaggagtagagtaatttaatctgatgcaatgtcaaaaagagttacctgtccggctcctctgcaccttcgatcaccgcgaagacattctcgatggtggccatcgtatcattcccctgcaaactccacaagaaaccattggctcgttggttgcaagttgcgacccatgaggccatgactactaaaaaaacaacatgcggatttcagtgatcgagacagaaaggctcgtcgaatgttgcttacggtatacgtcaggttcaggatcgccgggccagggccgaggcggtacactgggctgccctcccggccctgccagtccgccggcgcagcgtcgccgcccagagcggcgtggatctccgccgcgtcacgcgcggacaccggcagcgcggggatccccggcatgtcgtcggtgtccatcgcctcctccacactcacgcgctcgcacccttcggacgacgcccacatcggcgtcgtcgggtcgcccacgccccggaacaggctgcccacctgcacgccggtcggcggcagccaccgggagtcggggaaccacgcctcccccggggcgccgccgtactgcagaggatcggtgtacaccaccgcggccgcggcacccgccacgcgcgcgttgtgcacgatgtcctcgcagtggatcctcccgtaccgcgcgaccgccaccttgcccgcgacgtcgacgccgcgggaggcgaggtaggcgaagtcctcctcgcggccgtagttggcgtacacggcctcggcggacaccgaaccggaggcggcgtaggcgtagaacgtcggcatgacctccgccgtggccgacgcgtaggggtcgttcgggtacgtctcctgcgacagggcgaagctcgtggtggtggcgcggccggggacggcgagggagagcgagcgctcgaccgggtaggagaggaggacggagtagggcgtgatgtgcgccgggatggagagggacgagaaggcgtcgcagacgtaggcggcggtgagcgagttggccctggtgcccgcgacgtgggggtgaagcgtgagcgcccggaggtggagcgccgcggtatcgttggaggcgagggagaggaacaggctgccatagttcggcgctggtgcggagtggacgacgaggaggagcagcgagagggaggctccgagggcggcgagggtggaggagacgacgcagatgagccggcgcggggtggtaggtttgtgcggcggcgtcagcgagggagagaggaggagggaggtggcgtcgaggcgcgacatggcgcgcggcgcggggtggtgcgcgcggggatcgcgcggcggaaggaagaggagcagagtgcggggtgctctgttctggctcgtttgcttccgtgccgcgggcgcgctgtatctggctcgcgcgctgtttaatccgcggagacaactgacaagcggaccagtggcaagctggatactgctgctgctactgccacaccggcagtttgatcgtgcggcggcgatgcgaccacagcgcacgccacaacaatggcagtgtttatagtttccgcctattcctaactttccatcacatcatattatatcaaaattgtcctacgcatataagctttcaactttgagtaaattacacccacggtacaacaatttagtaggtgggtgtaatttagtataataacttgaaaaataagcgttctagtacaacaacttagcaggaaagtacaatttagtataaggactttataagtggtcgtataaatgcaataacttttaaggtaggtaagattttaatacaagagtaaagtttatcaccggtccctaaacttgtcgctgtgtcattccggtccctaaactcgcaaatcgatcattcagatcctcaaacttgttcgactgtgtcatcccggtccctaaacttgcttatcactcgtttaggtcctccaacttgttcagttgtgtcaccccggtccctaaacttggatttgaatatcatctgggtcaaataggaccgtctaaagactttatatttaaaaataattcatagtttttccatgtgaactctaatgaaaacaaactttatatcaaacttgtagccctcgacgcgatctacaattttatagttgaatttttttattttaagtcattttttgtcccaaaatgtaattttaaaattaaaatttcaaaatctataaacatgcaacaacattttgggaccctaaatagttttaattcaaaaccttttcaactacaaagttgtaggtcgcgtcgagggctacaattttgatataaagtttgtcttcattagagttcacatgaaaaaatatgaattattttttgatataaagtttttagaccgtcctgtttagggaccggggtgacacaactgaacaagttggaggacctaaacgagtgatctgcaagtttagggaccgggatgacacagtcgaacaagtttgaggacctgaaaggtcgatttgcgagtttagggaccgggatgacacaacggtacaagtttagggaccggtgatggactttactcaaaagagtaaaataaattataattttgacaacttaatttcaagcattttttatataaattcaaatttttaagtacttattttgacaatatactagcgtggatttgtataaacatatttatattttttcctaataactaataactgaaagtcaattaaactgaatatagaaattattatatttcggttgatatttgagaaggtgaagaaaacaaaaaattcttaaaggtaattggatataaattgtatgtgcaatataattcttaaagattaaattcaatattataaggtaatatttgtatcaactaaaaaaaggtaatatttgtaggattattgtgttttggcatattgacatagtgaaaaaactcacctagcatatgcttatccaaattgatttaccaaaatactaaattattaagttcttgtactagaatgcacccacttgtcaaattgttacacttggacgttcaattctaaagttcttgcactatatcgcacccatctgccaagttgttataccgtgggcgcaatttactcttcaaccttttttttttcaaacttccaactttcttcaaacttcacttttttaggaactgaacacacccaggccgtatttagttccccaaattccaactttccatcgcatcaaatcacatcgaaaactttcctacacacataaactaccaactttttctttaacctaccaactttctctcaacttctcaacttttccaccatctaaacacagccccaatttctcggatgaaaatcgtgtgaggctggacgctggagaggatcttgccggcttgccgctttggggaaggagcgattattatagatcaggttctcgctgatggttcgctgtttcagccactccgtcacaacgtgcgctacagttgagtaccccaacttcgccgctcgtgtgacgtcgccggtggccatctccagctcagacatgtttgtttcctaataagataagctcccgtgtgtagtgcatggtctcccgcaaggcgctaggcgctaggagcctaggatgatggtgatgtagtacttactcctacaagggatcaactacatcaccatcaagtttaatagttattgattggcggcaggcaatgccaacagcgttaggatgttgatgagcgagtgattgggtggtgtcccaatgctacgctacaattagcggaccaatctgttaatgttccattagggacacgcaggggtactccaactagagtccctttcttcctgtcaattcatcctattacaaatccaaaagttgaacaaagtatggaggcttaattatcttgggcacgcactatttgtggatgcctcgaactatttggcttccaggtttaaaatttgccatctttttttttctatgtcgacactatgtcctcatcttttatttgagtgtcagattaaacttgctgcttactacccctccgtgttagaaaaagtgcagttttacacggttcatgttcaaccattgatcatctgttttatttttaaaaaatatgattggtattttaattgttattagatgataaaacataaatagtactttacgtgtgactatttttttttatgttttccataaatttttcaaacaaaacggacggtcaaacgttagacacgaaaactcgtatctacgcttaaattgggatgaaggtagtattacttgttggatgaacaactgaaactctcggatgtgacgtcaaaagaaaattgggggtgggggattggaataaaggccctggttagttccttttcatcctgtcacatagaatgtgtcggagaatgaactcctccaccagggaactgtgaggcccccctttgtgagttcggccgggggcagcgggtgagattcgaggatttggtgagcgaagctgtgtgatcttgagggggttagcccccccctcaagacgatgagacaaaagaggtttatacaggttcgggccactgagaagcgtaatactctactcctgtgcatggttgattgaatgtaaaacaagtgcttggggttgcgagacccaagccccagttcaccccgaagtccccctctccaccactaggcctggacctccttttatacctcaaggggttaccacatgggcccaacaacctaacctagctccggtggagaagtattataatctttgtattaaatgcatgtcttgtctcttgacttgggaagccaagcacacgtcatcttgatgatggggcctgtcaaatcttgccgcctgacacgggggtgcccctgtcaatcaccatttaatgggtgaagacttctgggctcctattacaccgagaaacgggagccttactttgaccagagcgggaggaccgactccggctgggataagacaatgagaaactctcaccatcattatttgatgggacatgttaggctgcacgccgcctgcagcgcacaggcgcactagccagtcccatcggtcattcgaccagtcacagaccggttgagtgcactgcacgctgcgcgaccgctcgggacgccataaatgtgggtaggtggacacctggaggcggacacctaacccaccgtacgtggtgacctagagagggggtcgggggagcccgacccctagtcacgggagggggcggccgccgcccgacctcggggggggggagccacgtggcgcctggggcagccttctctctctagtctcggccagggagtggccgccgccctacctcgggcccgacccccctcgggggagggccatgtggaatcgggaggtagcctcctccatccagtctctgggaaggagtggccgccgtcctacctcgggcctaactcccctcgggggagggccacgtggcatcggggggggggggggcagcctcctccgactattctttggggaaggagtggccgccaccccacctcgggcctgactcccctcgggggagggccacgtggcatcgggggcagcctcctccctctaaacccgatactcccgggcccatatcaccgacagaatgtttagacacatgcatggagtattaaatatagataaaaaaactaattacatagattgcgtgtaaattgcgagatgaatcttttaagtctaattgcaccataatttgacaatatggtgctacaataaacatttgctaatgatgaattaattaggcttagtaaattcgtctcgcagtgtacaggcggaatctataatttgttttgttattagactatgtttaatactttaattttgtgtccatatatctgacgtgacacgccaaaacttttcataaaacacaagttttcagcgtcataaaacacacactaaagttttcagtgcttgaatttactattccgacccagatcgataggtgtgaccaacgaaccaactgctgcgaccgacgctacctacagcagatctatcggccaagcagattcacgaggaatcaatcaataaaaactgcttgatccgtgtccttgtgtggccatggaggtgacgcaggatatactcgtctggcaccattccaataagctgcaagattccaagccttatcgagataattaaaaaaaagagatactatcgtactggtcaatttgttgtggtacactacgacagcgaaatggagacggtcactcaactcttaaacaattatgcttccggttttattcaacagaatttgggttaacccatctgaaaaaaaaactctcaaacaaattattcgtagtaccctagagaatcacgcagggtaatccacaagagagtttcttgtgtgcttggaattaattagaacccttgatcacctataatccaacgcactaagataaaaggtacaggagcaaagtagtaaaaggatgggccaggtatgagaggtggaaggttaaaatggtaattaacttctatagttgatttgtgtggttaaagataaatgcgttatcttttcaatattcatctctttacgatccgctcaaaactcccgatccgttccaaatgccgtgcacgtcctgatgccaccgctggctgctcctcccgccggttcctcgccgggacgccggctacataagttgatgttcggacttctcggataggttggccttcagagtgtgccgtccatgacctcgaggtaaaagcggctgccgctgatgtcgagtgaacctgccggctttgcataaacgtgcttgatctgcttaattaaatgatcagcgattaaccacagaatatcttgttcgatcaggatagcaattagatgcatcaatttcgcaagaaatcaatgaccaaacttttcaattccattcaacagctttcgagccaatcaatgcttaacaaaaatgaaataatgcttcagcatttaggaaccatcagcagcagccagcatccagccgtcggtcgcaaccatcgtacatgcccgccggtcgtcgctgccgaacgcaaccgtacgtgcctgccgatcgcagccaccttgcgtgctgcccctgctcctggtccgttctttcacttgggatttaaagttagggttagacatagagagattgaggtcacgctaatatcgtgaaaaaaaacaatctcattgaaacgacaacgtcagccagcggatggggattggacaattactaagctacccttgttaatattatttcataatcctaaattaccctttaggaatcaatggtggatattaattagtttaggaggtccctgggatacctctcaagcaccgtaaaagatctccacaattcattaacatcaataattatgatactaactgaggatagttcttcagtatcttcacaggtacttgtgtaactatatcatatcatcgtaactacgtgtagagctggtatctggtactttaaactgcacaaaactacgtgtagagctggtatctggtactttaaactgcacaaaatggaatcgtgtagtgatcttaatttatgtactctcatgttagtctaccatcaaggacagctgaagccttggacacagcccttgcagccctgtaaatttcatgctgcaggagctgccaagattcggttgtgttgagcttatttgccttgtcgatggccgacacgataccagggaatgccttggtgccccagtcgtcttggtcagacgatgcgtatatctgtcaaaagaaaaaaaatgattggacataggttatcactttgtcagcatcaaatttggatcagaacggcataccaaactgcagaactgatgatactcaccatatgtttgtaccacggcctaccgtcgagcccttcccggttgatgaagcctcgctccgccatcattaaccggtcgttgatatctctgacttttactgtgtacgctctcgtttttaggctccagttttctgcttgtagcatctgcaaggcagaaatgagatgttttcattggaatgttggagcaattttgcgcgccatacacttctgtttcactgaaaacggaaggcgttaccatcttttctttgtgaattttgttggctgcttttctaagctggtcaattgacttgtgtaaaggagcgaaactgacaggacatcctgtacacccaccttccacaagttttgtgcatttctgcgataaaaaatgtggcaggtaattcatatgttaagcatttgctgcagattgttccaccaactctggtaatttcataacctaacatttacccatcagcgaaaagtgtatcacaattatgttctgtttttatttataaaatgaatcgaggctttgtcttgtgtcctaaattggtcatctcaattgaagaaaagaaggaaagttacctccagttctgatgcgtaagagacataattgaggggtaagatctcatcatctgcaagcctcaaagcaatcagaccccatacacttgccactgcatgattatgcaagcaaaacaaatgaatctgtcagtgtttgcaatgagatgaaaaacctttgaacaacaactagttcagtacatgcaacatgtctgtgaaacaacggatctccgaatctctccatccaaacataatcatcgtacagtgagtggtaaacagggtaatcttccactgcaagagcaataatattagtagatgctaaaggagtgacagcagcagagactgcaaacaatggtgaagtaataaaaaaaattaggagttatcaagatcaacatctccaatatataatcattacttgttccgtaagacatgtcaagtgaaggtactccaatatattgtagaaaagctgcaaaatctgttcctgctccagccactctatcaatctgaaaagaaaactttatcactttcagcacaaagataattttattccagatctaagattgcacataacaggattataaagccatttcaccactgtacaatgtacgcaccggaggatggtggcgaatcatagtgtcatacaatgtctgcgatggatcatcaggatcttgcaccttcaaaagagagggtggaaaatgaaatgatttttgtgcctttgtaagactgctatatactttgatattggccctgttcaaagaaaatttccctccctccctctcttttcaaaatgacggtcttagttatacttcttaatcaaaaacaaaatctggctgtccaatttgtaaaaaaggaaagacggagtaaagcttaaataccattttacttgcttctttgatcaactgatcaagttgaggggttgcccggggcctaaaacctccagggccaaacactgttatatccacattcaaataagcaatagctcttgaagccagcatatccatgttgtcctcgacccattcagtagaccctatctgagacattgagtgtgccgcatcaatacacaaccttctgataaagaagcaattcagaacaagtgatcaaggacataccagagcaaactcttctgcatcccaactacacacaatgattgttcgtctaggcctccatcccttcttctcaagcttggacagcctttctgcgatctatatatatacgtgtgatgctaacattatatcatcaactcttggcattcagaaattatagatgccttttatcatcaacaaaaagaatatgcacttaaatttgttgtttggaaaatgagacaaaggctaactagaaagggaaaggatgaaatattcatgtctccaaatgtctgatgaaagatgacatatctgtataatttgctcctctaaactgaattgattacctcgagcatagctgctgttccactgttgggatcaactgctccgaatgtccaggcatcacgatggttccctatgatcacatatctgttcacaaacgggcaaatttatccttattagctttgccttggctttacaaaatttctagaaatctaatcatctcctgtgggatgaaaaatgaggactttgatctaaactcagaacaatatgcagggcagggcactaagtcaaagcctgataaacagtgataccacgtgtccacgtgcaactgaattctatacgtatgcagaaaaagacaatcaggaatgccattcacttgttcgagcgagagattacctatcaggctcttcttttccctcgatcacggcaaagacattttcgatggttgctaaggtgtcatttccctgcagttcaccacagaaacaacgatgagtcgatgagttttcttggataatgactcaactagaacactaagatccactcacaatgtacgtgagattcagcacagcaggaccgggtccgaggcggtacatgggcgcgccctcgccgccctgccactccgtcggcgccgcgtcgccgcccatcgccttgaggatcgtctccccgtccctcgccgacaccggcagcgctgggatgctgggcatcgcggcgctcccgtcgagctccccctggctcagccgctcgcagtcctccccggctgcgcaggacggccacagcggcgtggtcgggtcgccgttcccgtagtacagggtccccacctgcacgccggtcggcggcagccagcgcgcgtcggggaaccacttccgcttccccttcgctcctgcgccgccaaagtccttggcgtcggtgtagacgatcgcggcggcggcgcccgcggcacgggcgttccgcaccatgtcctcgcagtgcaggtttccgtagcgcacgagcgcgaccttcccggcgacgtccacgccgcgggaggcgaggtactcgtagtccttggtgttgccgtagttggcgtacacgacctcggcggcgacggagccggaggcggagtaggcgaagtacgtggggatgacctccgccgccgcctcggagtaggggtccccggggtaggtctcctggaccagagcgaaattgaaggcggccgcgcggccaggcacggagagggagagggagcggtggatggggtaggagagcagcacggagtagggcgtgacgcgggtggggaatgagaaggaggagagcgcggcgcggacgtactcggcggcgacggcgttggcctccgtcccggcgacgtggggccggagggtgagcgcgcggaggtgcgcggcggcggtgtcgttgttgccgagtgagaggaagagcgcgtggtagcgcgacgcgggggccggcgcgaggtggtggtaggaggcgaccagggccacggagatggccaggaaggcgacgaacctgcgcctcctcgtggccgcatcaccgcgcccgccgtcgccgcctcccatgggcgcagcatcggggaggatcagcggctgccgctgctgtggcttgccgtggcgagacatgggtgatgggcgcagtggcttgggtggagtttggagaggcgtcgtagtttgcggttgcaagcaacgtcactttgtcagcgccaagagcccaagaggttgtatcgtctcgatttaattgggtcgttcgcatcgcaccgcagcgcgcggtgctcgcacacgttgcaacttgcaagttgccgcgcaatgcttcgttcggcttcaataattaaacgcttataataagtgtggaaaaatatcaaggctgattatgagcgtcagccatcagctcacttttgttgatgcccacgagtttttcctctaaaaaatattagctcgtgagcaacgttccaactccgcgagcgaaaagtagtacttgtctctctaataaacgaagttacggattgtctctctaataaacgaagttacggattatgacacgttgaaatgcaaaccatgtttttaatatactccctctgttttttaatagatggcgccgttgacttttgaatatatgtttgaccatttgttttattaaaaaaatttatgtaaacgtatagatataaattatgcttaaagtactttgagtgataaaacaactcataataaaataaattataattaagtaaattttttgaataagacgaatggtcaaacgtgtgataaaaagtcaacggcgccatctataaaaaaaatagagaaaaatagaggtagtagtatcttaaagcataatctgtagtgctgtagtgcgggttagtttctagaacgtttggtggttggtcttgcgctcttgttaggaagaggcttctggacgtggcttctctgatatagagcactactcgtactttggataatacaaaattttgatacagtaattaaattgaaaatgtgtattttgttcagacttcagaggatttgaaattgtgtttggttcgtcgcatgaaccaaacataagatgcgctttgctgagttttttctgcacccaaaggcatcatggagcacatcgttgtcgaaagggtgaaccaattcggatactgggaatcgacaacaagattcattcaggtccttgtcaaagattggtcgtaggtggaaccggacaacggcacggaaccaccacgaattagcagatgccccacatcaataatgcgccacggcccagttcagagcgtagcaattcatgaggatttttttggcaggaaattcgtaccctttgcttttcggagttgaaacgagaaaacgcaacatcatcaccaattacaccgcatcacctgctcctttggaaaatactcaccggccggaatggcaccgcgacgacaacggcgtcgacttcaatcgacgtgatttgggcaatcagtgcacccagaaatcaacgagacagccaaagctttggactttcgggtccggttgatatcttccaacggtccaaggcctatccaaaattccaaatatcccaactcgaataaaacgaggagaacatgcatgcatcaaaatgttgctgggctcaaaggccttaaaatgttttcgttgcatggcctaccttgggctaaatcagatttacggcttgtttggtttctagcccaaatcaaaggaataagttcactttgggtccctctatttgtcgtccagtccgattttcgtcccttggttgcaaaaccgggtacgacaggtcccccaacttacaaaaccgtttagattaggtccctcggcagtattgtgtctgatttttgctgaggtggcgcctacgtggctccttttaattagtttttgtctaacgtgtcattgatgtggcgtttacgtggctactagattaagggtgtgtttggttcatagtaagactggataggatatggccatccatattttgagggatatggtggtccagttttttgtttggttgggtggatgagaatggattgaatgaaaacaacaacatattaattaataatgaaatatgttaattatcattaatatagccataatttatactaattaacaataaaatagagtaattatatctaattttgacaagctaattactgattaacaataatataatttaattattgctaatcaagaactaatgatcaaaattagcaaaggtgaatatcctcatccggccaatttggtcgcatacactcatccagcatcttcgtggaatattccctctccaggccgtcctatccaccttcgcccaccaatcaaacacactcaaaaactggatcgccatctcccatctagggatatccctccaaccaaacacaccctaaaaaaaacccgtgggacccacatgtcagtcacagacacaaataataaaaaatggtgggcccatgaagacccacacatcattctctcttttctctatccctctctatcctctccctccttcttatctcgctctccaagccggtggagcggcatgggcggcggccgaagcgggcgacggcgaggtggagcggcagccggagcgggcaacggcggggcggatccgaggggcgaagtgggtcgggcggcggctgatcctcgctgacacctcggtcagcatggcaggagagtggaggcggccgttccgcgatccgccggaaccagcctggcggcggtgacggcgccaccacgaagccgagagcggagggcgatgccaagggggaggacgatgccggagggaacgacgatgaggaggacatcgccggcgccgcgcggtccccctgacccgcgctggcccccgccgcacggaggatgggggcgtcggcggcggcggtgatggaggacggaggcaactggatcgagtgggcggaggaggacaaggagaaggtgtgggcgcgggagtcggcgcccgtcacagagatgcgccccaccggcgacgagcgaagccggcaggcgagaggagaaggaggtgggacggtgacggttgcaaggtcgacggtttggtcgccgttgacgaagacgacgggcagcatggccttgggccgcggtggcagtgggggggaggcacgtggacgcgcccgtgcaaaccttcgcctccgaggacgcaaggacgcaagcggccgtgactagcagcgccgacgcgggagcaggcggcggcggcgctcgggtctacacggcgctagctctagcggcggcggcatcgaggagggtgtcggcggcgcgcggggccccagggcgcaagcggaggatgccgtcgcccccgtctctgtcttctccgctggcacccccaactcgccaccggggcagcctcgccccctcgaactcgtcggcagtgtccgcatctgaccctaccccgtcctggtgggagacggcgaggtcccacatcctcgcgctctccaacatcctcccgccgccggccgattccgacgtcgcggcgctcgccgactccgactgcccggcgcacgcgcttcttcggtcacccgcgcgcctacgccgcgctgtccacggcgctccggtcggggggtagcaccgaccacgctcgccgcagccgccggagctcgcctgctccgccgcccacacacaccgtccgctgcccagaaggagagagagaggggaaagggaagagaagagagaatggagagggaaggaaagagaagtgaggctgacatgtggggcccacatgggccccaccattttaaaattattttttgtgtgcagctgacatgtggggccacgttttttattattttgctgggatataattgccacgtaagcgccacgtcaatgccacgtggggtgaagacctagtcaaaaaagccacataggcgccacatcagccaaaaccgccgaaggacctcgtttgcccggttttcgtaagttgagggatgtgtcgtacccggttttgcagtcaagggacgaaaatcggactggacgactgtggggacacccaatttaggcttgatgccccaaaaatccactcgtgatcgtccaggatttcaatcacgcacagattgatgtacagaacagctttcgattatttacacaggtttattcatacaagctaattatactactgttaaaaggtgaaaagatccaaactaaagaaaggatatttaaagatatttaaagaaaggatatttaaaggaaataaagaaaaggtaattaaataaagaaagaaaggatatataaagatatttaaagataatttaatttaaaaatggttttaaataaaataagaaattttaaaattaaagggatttaagataaatcaaataggtttaaattaaaagggtatttaaacaaaattttaaataggaaatttggtatcaaaagggagggtttgaaattagatgaacttagatcaaaggttcactggaattggatttgtggttggagagatatgggtgcctaaagtttggaatttgaaataactcaaataaaagaaaagggattactgtacagtggggcccgcttgtcatatgtctcttctacctcttcttcttctctgcttctttgatccgagaggagggagagaagagggcgagcggggcgccggctctccggtggccgggaggtgggaacgccggtaggagatggtgttcccgagcaacgcgcacccggagagggtggtggaaggcggaggaagagagagggatggccggaacggcggcaacaagagctcagttccggcgataagagaaggtggtggtggcggcttatcccaaggtggagggagaggggaaagggggaaaatggaatcatctgggcaaggcggagttggtggcgcaagggtttggcttgcgaagcttcggtgagggagatcggccgacggtagtgatggccggacatgggagtagagagagaaaaagggaaagctccgttgtggagagggagaggggcgacctcgttttctatttataggtcgcggaggtcggtttggagagaaggagagcgactaaggcatggcgacggcagcgaagagaagaggagcacggcgccgatttcttagcaactacggaaaagagtttgcggcggcgtgcgccgtgcgcaacacgtgcactgggaggaggagagaggcggctgggctgtgggccggctcggctgggcttcggctcagttgggtcggcagcccaagaaggagggaggaaaagaaaaggggaatgggccaaaagaaagggaaattggcccaaaataaataggaagttttgataattttgtatagaggattttgaatggaatttaaaggagatggaaactaaaggatagatggatgtggatttttttaatcttagtcaaagaattgaatctaaggaattttgaatggagggttaaataaattttaaaggagataaaatttaaaagagaaacgcttgagggtcttttgaactttataagaggaatataaagtttttttaaaagcaaaaatgagtttaaaatatttttaaaataaaatcaaatatatttattttgagatataaattttgaaaaggataaaaataaagatgctccaatttaaatagaattcaaataagaaccaaatgtaaaacttgtcacgaaagatttaaaaatcaaacggaaagaaaaggcaataatttaacttctaactttggataaatttgggatggtggcaaaaatagatggaggtaaaaactaagattttagcctccaaaatatgtggtatggattctcagtgaattatttgtggctaaaggaagttggactttgaatagaagggattgcaaataagtttcttagcacaagagcaatcattcaaatatttgtgataatattattcttgtgccaagaatgtgatcaagtcataggaatcaaattggtggatggatcaaaataggaacttgaccacagaatattttggatggattaaaaggagacaaaggttttcggagataggtttagataggggttgatccaaaataaattccaatggaaagggaattatactggtttaaccctaaagataaaaatggttaatggtatataatagagagttgggtcaatcggggaaatattggcccaagctaaatggtagactttgtaatcttgaatggataatttaaatgaacgagatttcaaagtggtaatatttgtgagagtatagaactggatttggaagtatatgtggatgggaatttttctaggaacggaattggtggtatattgataaactctaaatgatgggtatgttgactcaaaggggggattgaagaggatatttttagggactctaggaatatttaggtggagatccaaaggaaatgtatcaacatttcatgtattctggagatagttgagtggagatcaaaaagaaagtattgcttcaggggaaaataataattggtatttgtggatgttggagatgttcaggaatggaatcaaaggaactataatctagagccaaagttagagattaaagaaaataaatagagaggttttgtaaaatttaaaagagagcgattaactttgcaaataaagttttaaatccaagttaaaagaaattaacagaaggtaagatcacttcaatagaagaatcgagaagagtgcaactaaaatatttcgcaaaaaaaatttctctgaaaatttgagtccgttacaacgacaaatagagggacccatagtgaacttattcccaaatcaaacgcacctaccttgggctcaaaggccttaaaatgtgagacgatgattcatttggtttgttgccaaaagagttggtagcaaaacgtaacccaagtctatatgctcccaaaaatttggaaagaaagctaacaggcaaacgacgtcaaatagacaaagaaataagttcactttaggcccctctatttgtcgcccagtctaattttcgtccctgaaccacaaaactaggaacgacccatcccccaacttacgaaaactgggcaaacgaggtccctcggcggttttgataacgattttggctgacgtggcgcctacgtggctaatttggctcggtcttcatccgatgtggcactgatgtggcgcttacgtggcaattcgatccggaaaaataataaaacccgtgggacccacatgtcagtttcacacacaaaataataaaaaatggtgggccccacatgtcatcctcactcctccctcttctctctatcctctgctcgccgccgggggagcctacctcctcttcctgctcctcttcaagctcccctccatctccatctccgtctccactgcctcgccggcggtggccaccacgcaccgcccgcgccaccgcgagctcgaggccgcctcctccatgctcggctactactcctcctcctcgcctctccgcccgctcaagaccgccttcccttcctgccgtccccactcttcgtctcgtccatccgcttgcgccgctgcaactcgtcttccatcgatgcttccgccgcctccgccttcactgctgtgcacccgctcatgcaccacctcctctcctcctcctcctccccttccccgtcatcctcaccgtccccatctccatccacgtccgattcatgcccgtccacgatctcagtgcctacaccgcctacatgtactgccgatcctcgtgcgacttaatctccccgcgagcaagcgcggggtaggaggccccgacgaattgagctcgtgcaagaagatgacaaaaatcaagaacacgatgcaagtatacatgtttgggccacacgggtgcgtaaggccctacttctgtgttttgggagatgtgaaacgtattaagcgaccaactctagattagatgccctttttccctttctaatcttccaaccccttgctaagggggtgtttggatacattagtcctaggactaaagattagtctcaggactaaaacattagtcctttttagtcctagcctgtttggttgaagggactaaataggactaaaaccacattaattgagctgtctagtaggtattcataggtactttttaatgaacatgcattgcacaaaacatcccctcatgcagccacagatcaaccaagaccatcttgcggcatggcaaacagattcacagtagagattacaaagtacaagaagatttgttcacaatacagagttaaaattcaacacagttttaggccatcaagcacagtttgacagcaccaccatatgcagacatatagcatacacaatgaaaagtacagtacatgaaaatgcaaattcccgcatacatatcagttattacaagttatatgttccaaagtccataagatgaataaaacaggagactacatattttttaaactccacagtccattggcaaccgtgtcccgaaattgattcatcacttgactatccaaagagctggttggatcatttgattaaggactttgctcagacaatggaacatagctttcatcttggtcacacatgtcgaattcacagtcggctagtttactatctctaatgaaattatgcaatgctaggcaagcgcatattatcttactctgtttttgctgtggatagcttggtaagtggaacaaaatcctccatttatttttgggtgaatacccaacatgatccttgaactttcgcttaaggatcaatttagtccctgatatttcgtattgtccaaacaagtaccttaagttcattgtgtgattcaatatagtccttagaccctctaaacatgccatgtgtacatgccacatcatctctgcatgcaaatttaatatttaaatgtcctttacacccttatgttttcataggaaataaagaaaaactattgagaaaacacacaaaaaaaaagcttttgaccattggcaaaaatatgtagcattgatagataaaaaaattgacatttttctttgttttatgattgctttttcttgtttttcttttctttatttgatagaaaattgaaggttaaaatggacatttaaatgttatcttgcatgcacgaatgacgtggcatatccacgtggcgttttaagtgggtctaaggactatattaagccgtatgataatctttagggtcttgtttggacattataaaacatcaaggactaattcgagccctgagtaaaagttgaaggactaaactgcctattcaccctttatttttcaacactccaaaggacctctctatcacatttcgacacgaagaatggcagtagttaaagtattccttcctatgttggggcat

SEQ ID NO: 60009 - DNA, 4670 bp, Oryza sativa
ttcttgcaagatctgctggtaggagccgaaatcggggaagtcttctgcttgggagtttagatccaggcccgccgatctcctccctagaaaatggtagcccgcaccagatccgccatagcctaaggaagcttggctgaatctgtactcggtggcgtcaacggaggcggcttcgtgatgtgcttgtgattgggagaaaaaaatcaaacatgtcgtcgtcatggccggccatggctgaagggctacgagcggcggcggcagagacggcagccgcgctcacggcggaggtggcggccgcgtgaggtcgcgcgcggcggcggcctcgggagctcgcggaggcggtggccgcgggagcttgcgcgtggcggaggtggcggccgcgctcacggcagaggcggcggccgcgtgagctcgcgcgcggcggccgtgggagctcgctcggcggcggccgagggagccttcgctcggcggcgtcggtggcggcacttgcgccggatggggggagtgagtagtacaggagagagatagcgaagtgtgtgagagagagaccgagtgaagtgggagtgacatgatagggttaatgcgctctgttataggtttttagaccgtataagctcctcccccagcgacttattggcctatgctgttttagtctcttttaagtccctcccgtttggtagtttagagactaaaaaatgacttatttgaagggacctatggattagtccctcaaaccaaacaccacctaagttgcataactcctcttatacttcgaaggggagcctgcgccattacattttgcatagggttatgtctatgtctagtcttgtcattgtccctcctgtcacattagtctgaatgtactcattgctactgaccgagcctacgcttgtgccccaggaagctgagcatggggcccaggacagctggaacgagcttctagcgtcacttatcgtgaagtcgggcctagtggacctagatgagggcgtaggggattgtccgcccttcataacaccatgcagccataccaagtgttgctcgctggtgcatggcgcgttgttctagccctattccttcgggtgacacaactagcttgatcacttcataccttgccacctccttcttgcatgtatctgagttgtaatctcgaattgtaattatttgggtaccgctttgctgtggtttaatgtcattgctcgctgggcccgctaccctgcatagccggctgggagatctccaccaagctcagggcagcgagcaccaccgatgtggtctccaagtcaaacccaagtgacatgtgcaattaggctcgccttttgacatggtaatattatcatggccggactcatgccctgagaatgcaagcagtctgcaatctcaaggcgcggttcgtgcttggcgttggatccgtgttcgggccctgcaggtaccctcgggtctgcacatgctcccatgctgcttgacgagatgtcgtgttatttctgataagcttctcgaaaacgtcgttgatgaaggatttcatgatagacatggcctcagagggagtgtcgatgttaagatgtggatcttgtaggtttccgcactcttcttgatatcttgaagatataaaccttgtgtggcgttaggcgccgggatcccagggcccaggatgaaccaagccttgggttcccaccttacgccacacatcacctaccaccttagtggttttctgataggtaatgaattatgtttgtgtgaagacgatcctgcaagcccaaggtgcaacaggcccttggaggaacaagaccctggttcccatttctctagctaccaacatttggtaattataaaaatttctactcgcagaactaccaatttaaggtgtcaaaattttggcattagcaacaaatgtgttttttttttcagtgaactcaacaagcctttcgatctaagcttcaaacttcaaagagaactacactgatgcatcacaggagatcgaagcaaagagacgatgaaatggtgcaagatcattgcattagaacttgcaaggcacatttggtatacatacatggttacatatcacccaccaagaaatatattgcactgtggtagatactttgaaaagaagatgcagaaaactgctcaactgggcaagaaaccagcaaaatgcaggagaaggttacaggggaaaacgcctctagtggagcagggaaggagatcaccgaagagcgcatgggatagcaccgtagcaaccaggccaatcttacaggatcacctcccagccacaagaccactgaacacttggctgttcccagctagcgtcgcttcccactcgatcgacgacagcagtatttgcgatagcgtgattactgcatgcttcatgtctggccgaagaacaggatcttcctccacgcactgtttcgctagcatggccatctttataagaagaatttagagtgagatttagctttgaagcaaaggtatgtgaaatgtgcaggagatgttgatcatcaagcaccaacagattttattgtgcataccttgtatacacagtcatgtggatacaggtccattagattagggtcaatgcagtctttcaggctccccatatacattgagttacgacaattctttagtgcactcaacatctgcattgttaaaactaaattagttcaaaacttttggagtcaaaatagcaagtaaaatatactaaaacttcaataaagccagtgaaaaacactgcaacttgggatggcaaaataattctaagcccgtaagttataatgggcatatatgttcaattgcttatgctgaacctagaaaacttacaactgatgccaaggaacgcctttctgagtttgatccttcgttcaatccatcagtccttgtaattgcctcctttccagatattaactcaaaaagtactactccaaaagcataaacatcatttttcgtagttgccaggccatcgcgcaagtatctacaggaataaatgaaatgtcaggattgagctagatatttttcttttccaaatccatactgagctaccagaaaatgtactcactcaggggccaagtaaccaaatgtacccacaacttttgtgacagaagcctctgcatcagttgacttcactaccagttttgcaagaccaaaatctgaaatctacggagacagaaaatgcaggtaaacaagctgttctaaatggtgccaggagaaaacaaatcagtaaacaaatttcaaatcaattaacctttgctctgaaggattcatcgagcaagatgttactcgatttgatgtccctgtgaacataatgatcctttgtatgctcatgaatgtattcaagtcctctagccgcatcaagagcaatttggaccctgtagatccaagacaatgatgtgtaacctgaaaaagaaacaacacaaaatcaatcaataacgatagaaaatgtatgtgtgttcagaaaagaaaagttaacaaaacttgagttagcagcaatcaagaaatgttctcaagcagcaatattttagaacttgtacataagggttgcttttgattggtacctactcaacaaatacaatatcaaaactgctggaagtggaaacattacatggcgagattacccaagttaaacagaaagcaattagtaaatcactcgtacaagtcctaaatgatggtatacctttgctttgaggatcatgaaggtgattcttgagtgaacctttttgagagtactcgtaaataaggtatagttcatccttgcttgctgcatagccaatcaactctacctttgacaaatcatgggtaacacaaatgaaattcaataaacaggatataagacataatctattagaaggatttacacaactgtaaaatggcataccagactggcatgatggaccttacaaagaactttcatctccactataaactctttagttttagttgctgtcattctctttatagcgacctcctatgaaaaaacatatttgttattggcaagggaaaatcacaacagttttgcatggatatggtcagctcagatcacatacctggtctcgaagaacaccataataaacagagccatatgtaccatgacccagaagatttgcatcagaaaatgaatcggttgatgcaagtatttcttgataggtaaacacaatgggcttctccctatcaaacacgtccactacaacacctgcatgagaggaaaattgagaacagcttgtatgtgagaggaacgaaagaaaattagaacaaatcaaagcagagcgttctaggctgctagaaatggcttgtcacactaagaaatcatgaagttgtttagttgtgaatttgtatcttgacgttttgttttctttgatattatttggacaatgtacttcagtatagaagttcagatcatcagatgtgtttggtgctacttgaactcatacaaaaatttgaacagatcgtattcctgcttaaatcattgcaggaaaagcaactaagcgatgctgacatgagtgtcatatgcaatgacaatataacattttgaaaaaacaaaacccctaagggatatgcatatgacaacatttcgatctttaatatgcctatataaggcactagattcatcaggccactcctatattaatatccacgcaaaatgaactcagcaaaacccattcaccactgcattgccgtgctgtgcagatgca

SEQ ID NO: 60010 - DNA, 7057 bp, Oryza sativa
acaatgtggtagcatgttatacaactattagcattaagtgttctcagaatatcatatagctgccaaaaaaaaaacctagaaaacaaagtgcatcaactctaacaggtacctccatacctgagaatgtattttgtgcgggtgctggcgcaggagtaggagaggaaggagatatcacgggatatggttgtccaggaactgcacatgacatagttttacaggaatgaagccaaaaaaaaaaaaaaggtaaaagcaagaactatgcccaaaagaaaccttacaagctagaagagaggtatccaaaataacaaaataaaacatcataaaagaacaaagtggaataatatcattgtatttgtaccaaaaagggagtgctatacagatatgaatgataacattgaacaaggttaacccgcaaaaatgcaaaataagaaaataagatgaagcacctagctaaccaaaaaggccaatattgccaaatattaaacgtattgtggtccttgcctgtaacttagggtctcattctattaaatacatcaaacagatagtaccttatgtttggtgacaacacaatttggttaaattcttagtaaaacttagaagcatggcatgtgtttcgagtacaatcattcgatatcacaatgtgcctccttgtttgtgccaaatttgtctgtagcagcacatcatcagatgccaccaaccagtctaggaatgaagggattattttactccattcagtatagtctctacaggcaatcatatggacctcacaactccatggtggtaacaattttcagagatttgtttaggctgaactaaatggtaatgagcactttacgtgtttcagattgttattttactccattcagtatagtctctacaggcaatcatatggacctcacaactccatggtggtaacaattttcagagatttgtttaggctgaactaaatggtaatgagcactttacgtgtttcagattgtgttcatgctattaagttgcatgcaccagccagttgcacctaaaagcctaagctgatagggaaaggcgggcaattcactttatacactccaacacatgctccttcctatctgaggtgatctcaagcaagaaatgaactgttaaatccagttcaatatagctgattactatgtaatgggcaagcatctctgttcctccctcattaaataacgctgcatctataaattattagaccaattaatttcaccatgttcatgaaataaatggtaaattctcggttcagccaaaaagaaaaatgcagtataccgtgtgtaaatagggaagtttgattgatcaaattgccggagtgaatgatcgctaaacatttgttcacctgagttgagtgggatgtagtacacctttcccgtggttataggatcagggccggccatgccattggcggcctcgatggcgtccatgctggccccgaaccgacttgatagcgattgcaccgtgtctccgtcgacgccgacgtagctgaggagatagttccaggggccggatgagcagccacagagcaggtggagagccaccacggcgccggggcgcggcggccgcagagccggtccgcccggcggcggcacggctagccccgcgtacgccgcggcagccacgtcggccgccgtggcgttcgccgtcgccccggcggcggcggaggggacagtgtaggtcgtattggcgaggtatgtgcgggaggcgaggcaggagcagttcttgcggacgaacgcgtacccggggctggcggccgcgtcggccgtgatgtcccccggcgcggcgtcgaacatggactccagcacggaggcgttcgcggcctcgccggccgccgggaacgcgacgaacgccgtgcagacgcgcgagagctcggagcaggggagcggcgccgaggcggtgacattgccgggggcggcgtcatcaccggcgacttcgccgggggaggcgagcgccaggaagatgaggaggatgagaagcccgggcgcgggcgggcggcggcggggaggcggcattgaggggggctagggttctgggctcgaggtggcgaggtggtggtggtggggcatggaggtggcagtggcgagcagcgagctggatgcttcgcgtggtcgggtcactggagcacactctgggggacggcgcttttagtaagacgacggggttaattagcaagcaaagcccgcaccgcacgcacggccatgggtactggactactagtagatcactgtctccttcattccttgtgtgttatgcccatattgcccttgcacgcatcaataatccgcccgtttttgcttccgtcggtctgggaggtggtaacggataatggtttacgacgcctcaacttgttgagtgctatctctgtttcaaaataaatttactttcaagtaaaatacatcagcggtccttaaaattatcgtgaggtttcacttaggtccacaaacttgtaaaacgcacattgagatctctaaacttggtttattgtatcatttcggtccaaagtctcgtttgaccgtagtcttgcctacgtgacacgccacgtggacgatgacgttgaattttttattttttttctcccttcttttcttttttttctcccttcttcattttttttctccggcggccgctgcaccgcgagctccacagcagcgcctccatctccttctccatcagcctccgctccgctcgccgcagctttgccacccgcttcctgtgacctcgtgtggcctcctctctagctccatgccagacaccccgctgtcgtcttcctcgtcacggcgacgatgcctaaccctccttccagctcgatgaactcaccgtcgtccgaccactcctcttcctgcagcggcttctcgacctcgatgatgacaacgacaacgacgacgtggtgcgaagctcgcgacgttcattgtgccggcggagatctacccagcgaggctgcgtgcgacgagccacgggatatcggcggcgtcggggaaggtgggcgcgatcatcgggtcgttcgggttcctgtacctggcgcagagccctgacccggccaaggcggcggcgcacggctacctgccaggcatcggcgtccgcaactcgctgttcacgctcgccggctgcagcttgctcggcttcctcctcaccttcctggtgcccgagcccaagggcaagtcgctcgaggagatgtcacgcgagaacgaggtcggccagccatgatccacccgttaattccaccagcatctgtatgcaagatccatgcatatgcacggttagtccactatgagatttttgttctcttttttctagaatccattggaagcatatgttttcttctctttttttttctttttggggtttagagcggtgacaattagaggcagtatgatgaaataatggccgccaattaattgttgacgacaatgtagtttagcatcaggtgggtcatataatggacgatcattagggttcatgctgattctgtttcggcacgagggatcctcgggttcgctccttttttctgttgatgatctcctccaaaaaaacaaaacagaacgcatctctctctataatcaaaaggattccagctcgatgaactcaccgtcatctgatcactcgtcttcctgcagcggcttctcgacatcgcctttgtctggcgaggaagccgcacggccgacgccatcggtgtccgcgaaataacccgaagcaagacgagtcgagatcgacaatgacaacgatgacgacgacctggcagccacctccatcatcgccgtcgccgccgctgcaatggtcggcgtcgcgtcaatagatggcaaaactccgagaacacaaccacgagacgacgtcgacgttattgcgtgcacaccacttgcgagacagagagcgcgcacgtgcggtggagaggtggaagaaggccctgacaggtgggcgccggccctcagcggcagatgggagaggagggaggcaaagtggaaaaaaatagagaagggagaaaaataaataaaaattacatgtcatcgttcacagggcgtgccacgtaggcaacatcacggtcaaacgaggctttggaccgggatgatacaataaaccaagtttagagatctcgatgtgtgttttacaagttcgtggacctaagtgaaacctcatgacaagtttaaagaccgctggtgtattttactctttactttttatattttacacgtatgaatacaaaactaaaagtactttatcaaatctcaatagaactatttctcatcttatcttcttctaatacaactgtttcctattttcacaaagcatgatacaatgattactttaaaaatttattttttaaaaaatggaagtaactataaataaatttaatatcagaccgaagaagtaaaaagcttaacataatgatgatcattgatcagggggagcgaaatgaatgagcttccaatgtaaattttctttccgcaaaattttattttgtaatggttcgttgtcgtcttattaaccttacgatatgcaccacaatgtgtttttaacagtgaaaagaaatatgtattcccttcgtttcaggttaattataagatattttaagtttggtcaaagtcaaactgctttaagtttgaccaaatttatagaaaaaagtaatattttcgacccatgataaatttttattataaaaatatatttaattattaatttaataaaactaatttaataatataaatattattatatttgtatataaatttagacaaacttaaagcagccttataatctaaaacggagggagtagttgtgatacagcaacattggcgtgtgttggtgttcaaaatcaaaaactaaggcttagggtagcatctctggataaattactactggaagtgtggttatattacaaaaactggatcattggatgatggatccaactatcacaacatcgaaaatccccccggttacatctatcaacaaatgttggtttctgacagttcccttcatatcgatcaatcgtccgattgcaccaaattaacaacagtgataaaatttggtaagaactaaagataggctagtaagctacgataatataataaacttaaaacttactaacaaattatggcatgtataatatcgtctttcatgataatcttctaatgcgaattaaacaggtatttgattaattagttaatcaatatatatcataacaaatataaaaaagtaaactcgggcactgtaaatatatccattcctaagatcaaagaaacttcggggagcgacgtgggaattgtaaatctaccctgcgcgtggatcaatccacgtacaaaacaatgggagcagggccaaacccaggaccgcacaattaacgagcctccgtttgtctttgatacactattttcactctttgaaaaaggttagcaatccaaaagctcccgatgatcaaagattccattagccggctagttagtgttccaaattaaagaagagggggtaacagggtagcaactgtaatgctgcctcttcctcattcggacacttttgcggtgagtattctatcccccacggcccacgtattatatgctgcatactgttcagtgatgttcaccgagagagagagagagagagagctactgctccatccactgtttggtttctcttgccatctctctgcgtactgctacgattacaggaggatgtactgcaacttatggtaccctgagcaatgaatccaccatgtacagaatgaaatcgtttcgcagttacaccggcactattgcactaaccattaattagcagcatagacgggctgagtaaagcagggtagtagtactactgcccgcaataaggcctggtttagttttcaaaaaaaaaaatttcaaaaagatcacatcgaatttttaacacatatatgaagcattaaatatagataaaaacaaaaactaattacacagtttatatggaaatcacgaaacgaatcttttgagtttaattagttcataattagtcataagtgttacagtaacctacgtgtgctaataacggtttacttatgcttaaaagattcgtctcgcggtttgtaagcaagttataaaattagttttttcgttcgtgttaaaaactctttctaacattatcaaacatcccatgtaataccaaaaattttcttttcaaataagacctcggtggtagctgggcgtcgttatggcctgggccgagcggcaacgaaggccgatgtagccaaaaggccccgcacgtgggggtggccgacagctggttgcccggtactactaccatggaactatggcagctaacgccacgcgaggagggagccccgagtgggcgaggaggtgggtgccgtggtggcgcaccgccacgccacgcgacgccactgccagcgtcggtacagacaggcgagaaaagaacgatttcctcgctgagttgtctgagcgttttcgtacgagcacatccactcagatctcccgggggtttattttaagcgcctcgcccgcagctcacaaagcctgccgccgtgcgtgcatgcgggctgcgcaccagcaccagctttgcgagaaatataagatggttttcttgattatacggcggggtttgcgtgtgctacgtgctgtccgaatatttccgtggatacggtggatgtatagtggttacagtattatcccgtactactactactgtgtcctactgtccttgtttagtactccgtaggaatttagggcaaagctcaacacagaaacagaaaagtaggtgaccgaattgacgcacgcggtgctgttgctgttgctgaacgttagtaaggccgagtttagttcaaaactttttttaaaaaacttttaacttttttatcacatcaaaacttttctacataaacttttaattttttcttcacatcgtttcaatttaaaccaaacttttaattttgacgtgaactaaacacaccctaataagcagtcccggattgaagtggaactaaattggcagtgacacctaggggggacaagaaaaatctcgcctcccatgtcgtgacagctgtgccaatgcttaattcatgcgtcggtaatgcaaa

SEQ ID NO: 60011 - DNA, 10988 bp, Oryza sativa
ctggagggtgggagacacagaactacaaaagcaggggcattcatgagtggtgggggtacagccaggtagtgctgcactgcccgcgtaccactgtccagctcgctaagcgactcatgtcatgtgttaggtcaccaacacgaagcgctttctcctctccttgtctcctctcctgtgttgctaccagccctatgccaatatcggaacaccaacgaatgcgtgcttgaaaattgctaatggaaattgccaaatttcatgtgctctcagtcgcctttaacctctagaatggggtagacaagaagataggagagccaggggtggtggcagccagggcttgtcggcgacgaccgacgaccgcgagctccttgacaaccccttccatcttccgcaccgtgaaggacacccgaattccagcaacggatgtacggattatggggtttttagggtgggggttagaggaaggggaagatgatgttttttccgagcttgaaaggatggctagggagatctgcaggggaaaaggatgggcgacaggatggtggtggccgtggcatcgctatagctgaggctcgaggacacgggcatgcattagatcaggagtggttagaggacggagtttaaatagtttaccttctatacctccttaattgatgagatggaagaaaaactttctcgccacactgcgtactataattcttctcttgtgtgatgtatactccctccggactgataacacttatcattttagacaagggtgaggtcaaactttagaatctttaattatgaatcatttttaaaatatttgtctttcaaatatggtgactacatgtatagcttagtcaaagtactttaataaaatcatatatttgttagagaatttttatagtccagtaataggtaccgcccagtactgatatctgtaggtacctaaaaagatcggaccgttcaattcggaagcgtacgatcgggagaaaatgtaggtgcgctcgcttgccatctagtcgcagcccacacgcgtgtgtgccgtaatcctttccccttccatgccctccagcggcaactcctcagccgccacgtcctcctccttcactgccaccgccgcgtccccttcctcctccgccggcgcctactcccccgttgttgcctcctcctcctctggcactgccgccggcggcttgaaaaggatgagagaaaaatagggaaaaaaaatcaaggccacgagtctccgtcgccatggaggaggagagcacaagctccctgtctactcgcaacggtgaggaaaaaaaggagcaaaaacgaggagtcgaacaaatcactctcatgaatgaatcaatagtttactcttttaccagtttatcagtgagtgaccttggtccttaccagaagcatattagtcggagtcacccaccggaccggcaacacaaccactccggccttggtaccaccactgtgtgttgccgtcgagggtttcctccagccactgaacagctcgcttggtagctagcttcctcgttcagctccacgcccttccatgtgtgctctacttcacgctagttgccgcatctagggatccacacgcactgccgctggccgtctcacatgccgccgccgtcaccggccgcctaatccgaacaaagaggttcaccggctccgatcgtttcaacctcatatccaacgcaaaaatacagttttacccttccacctctatctcctttggccggtaccacctacaaactgaatggtacctggaggtactgattgctgttagccgttcgatccatgcccctcaatggttcagatttggtaccgacccaggctgaagaactgtaaaaataatctagttgttaacatttttatacatattataataaaaaataatggtcaaagttattttttagaaaccgtacccttgtccaaaacgataagtattatcaatccgggggagtaccatatataccactaatgagtaaatatttttttctttgattccaagatttacatgtagatctcataatatataactagtgggcttgcattttttttaagtaatgaatgggaatacaatggacatgcgttgaacttggtcttctaaaaaggacagatatatggaacttggtgatataaggtatatttgacaaggctgtaactttagcttcattcctcttgaagctagagcccaaccaaaaagttttaattccatctaaagaaatagtagagaaggttacagtgatctgaaaaaataaactagagaggtgcatcgggattcaaactccattcttgaaattattgtttggaaattggagccatgtcaaacatggccagactagtttgtagatattagtggatacttagagcctcttttggggagcttctaacatatgcagcttctcctagaatctctaattgccagaacctcctttaaacagtctagattttcagatagattataagaatgtgtagttgtagaatctaaaaaataaacaagaaaatacaagttgggaaacccaacttttccaaattctcactagctagcttctcaccaaccgcttctcagaatcttggagcaccttcaaacaaggccttaggctagcggctaggcgttggctgctctatggggcctagagcctaggttagtcgcccactggccaaacagatgaagtagagttatctcccatggtccagattggcacggacatcccaagagcaacaaatgttactcgcttgccaagttatcggacagaaaatgaataagtccactttgactccctcatatatagctccaatctaatttacgtccctgaaccacaatatcggatattttgactccccaactattaaaccagtgtaatttgatttcctcagcggttttggagggcggtttcgctgatgtggcgctttgatctgatctatcccgctgagtcaccaagtggagccacatgtcattctctcactcctttccttcttcatcccgtagacactttggtctatggagaagccgaatagggaagaggaagaggaagaaggtaaggaatgagataatgacatgtgggccccatatgatgactcagtgttatagacctagtcaaaagcgcaatgtcagcgaaacaaccctccaaaaccgctgagagagaatcagattacattgattttaatagttgggggttaatatatccggtattgcggtttaggagtaatatgaattaaattggaactatattgagggagtctaagtgcacttattccgacagaaagacataacactggaaatggcccaagcttcggcttgacaccattttgggcctaaactacttactgcttatcaggccttacgccagcagagagctcggcccattttatgccctagtgaagtctacgcgtgcctaccgactaccgagtaccactgacttgtccggttgtcccgtaatgcaggagcggcggcggcgtgccagcgccatcgtatcaagaaacaaagaagggagttactccctccgaatttgaattttaatgtataacgttgttaacttttcgaccaacgtttgaccattcgttttatttaaaatttttgtgcaaatataaagatatttatgtcatgcttaaaaaatttgatgacgaaccaagtcataataaaaaataatatttacatatttttttaataagacgaatggtcaaatattagataaaaagttaacggcgtcatatattaaaatatggaggtagtacaagacaaaatgagataaaatatggtttcagcggttacatgcactaagaagttgataaaggatatctatcgcgcgcctagcggtttcatccggctgataatgtcgcttatgcctgatcagctctaagttcgtcacttcgtgggctcgtggcgctcctgcctaccgcgagaccacgccgagcagcaagggcaatgacccagcaacggcgcaccgcgtatgactatcaacgcgcggggagaaattaagcagcagcaccctgaaacacggagtgttcggctcgtcgcgtcggcgtcgaaagaggcaagtgatgcacgcatggtgcagatcgatcacggcggaaggggctggcgacaacggctcgcgtcccgtccaaggtgaggaggacagtattcacggaggcgagctctaaccgcacgaacggagccccgatcgaccaggcgcaggcgcggccggaggataaacccgtgctcgacgtcgccgaagcccgaagttacaagcgacacccccggctagccatgctcggcgccacggcgccgtggttcatcgcccgcaaggtcctctcacgatcaaccagaggccagagccggctgcagctctccatcgtcgtcaagggcaaggacatggccccgcgcctgctcatcaccaagaccggccttgacggaagccgagaaggccctcgtcaacgtacaagcgcggccgggagcccgggagtactcgctgaggttcaggtactcagcggcaacgccaccagctaccagctcatccgaagctgggtgaagttcctgagagagaatgaattactcatcggcgccacgcggctataagtttgaagcgccgtgtgtggaccgtggggatgacctggagcagtgggcattacgctcgcgcgaactgccagcctgccacatgccacgggccccgaggatgccggccacccggatggcgcgctagggtttctcgtgttgcacggcgacgacgacatggaggagacggctgccgtgatcaaagaaagaagaggtgcctgcggctgaccatacgtccatacacgtgcagagaagggtgaggagaagtcgagtttgatcgcaaaacttgctgcatttgtgatggtgtacgtactcttgaggacaagcactcgatcaagggaaacgaaacacaaaactgatgacgatagacgaaggccatagaatcttgcatgtatgcagcagatgcacgaggaaattaattgttgtcagtgctcttaagagtagtatgttacctccgtgtcccgtttcttatacacgcaagtttaatatatagattattgtgtaatctatcactttaattattaacacataccccctccgtgtcttaatatgagggattttgacatgttacttgcactggttgaccatttatcttattaaaaaataaaattattatttattttatttgtgatttactttattatccaaagtactttaagcataactgttcgttttttatatttgtataaattttttgaataagacaagtggtcaaacagtgcaagcaaaatgtcaaaacggaggaagtacaaggtgaaaacctacccatgaaaaaaaaatcattatggtgcggtgttgttgttagtcggatattctttttagttgctccatgttagagctcgtgaatgatagtggcactacaattcatctagttaaatatttttagtgttttttttatagatatatatgcaagaaaaaaaaggtgtgcccttaaatggcttaaaatatagtcccacgctatatgttacaggcattccccctgtgtaaagggtgtgttctttacaacatcttcctaacttttactttctcttctttcgtgcgcacgttctctgaactaattaaatggagacgttttttttagcaaaagtttgctatgagaattactttataatccatttctccgctttacgtgcccaggagaaaacgtttctataccctcccctaaagaatacacccatccgagctgggaaaataccttgactttggaagggtgccaatacattctcttcaaaccttgcttttgagaaagcaaattggatgtttttgtagctatatcttttactacatactcctaccccagtctacaaatatgattttttttaaatttttaatgttaaaaataaacctttctgaaacttatttcaagatctgaaccttttgaccacgggctgacatggtaggataaaactgtcacgtacgcccgtagcgggtggcgtgacagtgttattttgccacaccaaaatatttagattttgagaataagttttagaaggttttatatttaaataaaaattacaaaataataaaaattccacaaatataaggcgtgtaggtgcatatcttcgagttcgatagactgaggtagtatgcgctagttatagatggccatatggcctgtggcccgcggctcggcccaaagaacgcgtgtttggcccggcccaagcacggcgcggcccgactggagtcgtgctcgtgccggcccggcccgacagcgggcctctgtcgggccgtgcttgggccgcgccatcggcacgctgggccaacacggcacggtggaccggcatggcctggcacgctataacggcaggcacggcccgaccgaggcacgcacaccgcagcccagcccgctggcccatcgcctccctcgcatatataagccgcccccgccgctccgctcctccgcctcctccgctcctcaaaccctaaccctagccgcctctctctcgaccgctcgtctctctcgactgcttcgtcgctccaccgcctccacgcctccactccacggctccacttcctccacgcggaccagcggaccacgcctccatcgcttcgctcttcgccggatctagcaccgacggtcgccggcctaccgctggggacatgaggggctgagggccgttcttctctctctttttctttcatctccacctctccgatggccacgctatcgatttcctctttttttttgccaccctcgtcgttgctccgtgagcacttcgtcagatccacccccatttccagtctctgttctcgtcttcttgtagatctgtcgatctctgtcatcaacggcaactccggtgcttcggatgcgtaggtaggtagagtaaaaaaagtccatgtttttctttagttttttttccatgcgacccctaaaccctaattattctctgtgtattgtaggtcgctgagcggtgagcgccagtggtagccaccgttgaggaacagtagtgtcgtcgatggatgatccatccttctgcaacttcgagttgaggctattgggaatgcggggtgatgacgaagatgacttggaggaggaacgcgtggaggtgttcggcaacactgcctcgcctcggatcgatgggtcgcagccggagacgaagacggagccggacgatgacggtaccggtgctggtggcaacggcgcgccgtccggctcaagtgctagcaacaaacggtccagatctcaggtatggaacgactttgaagagctctatgaatcctgaaatggcagtcaggtttgtgtccatgctaaatgcaattactgccataaaatcttgtctgctttttcatctggtggtactggacatttgattaggcatattaagtcatgcaaacctataaatgctggtgctctgtctcagtctatgctccggtttaatgctgatggttctgttagtcaatgggaatataagacagatgttgctagaactgagttggttaagttgattgctagagaggatcttccactttgttttggtgaatctgctgcttttgaggagtatattcaaaaagctcataaccctagattttgttctgtctctagacaaactactagtagggatgtctttaaggtttttgacagtcagcgtgctatgcttattgagactttaaaatctattagctctgttgctttgacttctaatatttggtctggtaatgctaaggaggattatttaagtgttgttgctcactttgttaattctaattggcaattagggaagaggattttgggtcttgtgctgattgatgtgtcacacactgctgaaaatatttcggaacatattctttctgttgttcaagagtatggtttgactgataagattttctctgttactctggacaatgccgctgctaatactaaagcaatggatcatctaaaacatgctatctctggttatgttggtgatttatatttgcatcagcgttgtgcatgtcatatcatcaatttaattgttaaggctggtcttgagatcttcaaaaacatgctggctgattttagatctgctatttcttttgtgaatgcatctaatcagcgcattgctttatacaaaagcttctgcattgctaagggtgttcgccctcgtaaatttggtttggacatggatgttagatggaatgcaacttatttgatgcttaaaaatctcttgccacataagggtatcttttcagtgtttattgcaactaaccatccacctgttaatggtcatgcattgttgactgatttacactggacaattgctgagactgttctgttattccttgaacaattttatgattcaactattattatgtctggtgtttattatccaacatctccattaattatgcatcacattcttgagattgctggacatctaaatacatatgagaatgataggaaccttagaaatgttgttattcctatgaaatcaaagttcttattatactggtctgagattccatttctgtattcatttgcttttatcttggatcctagggctaagatcaggggttttagcaatgttctccaaattatgactggtaattattctgagtatttaactgaggttagggctgcattgtctgatatttataagaagtatgaagctaagtttggtgatgtaagattgcaaagggcaaccccaagcagttcttgtggtaagaaaaagacagcttgggggaaaatttttggatcatccgctagtggttccagtgttggtgctggacctggtgtaggtgatggatttgctagtgccagtccaggtgctggacttagtgctagtgctagtccaattcctggatttggtgctagtgccagtccaggtgctgggcttggtgctggtctatttagcaggagaacttctgctactgctttgattcaagctgtttattctactgctaacatgaatgcatctgagttgtttgcctattttgacagtgacacagtcaaccaattcgatgacgacttcaatatccttaactggtggcatgagcacaaacacacctatcctattctttccctcttagatagagatgttttgaatgttcctgtttctactatatcgttggaatatgcttttagcttaactggcaggatcatcgaggatcgacggcggtgtctaggtcctgccatggtgcaagctctggcattgatcaaagattgggagcaagcagaatcaaagaagcagcattcagcggagaataaagagcttattaagtcttttgaatacttgtatcttgatgatgaaaccactggggatggggatgggactgggactggagatggggctagggctgggactgggacttgatgctatttgtattggacttggactttattatgaacatttgatgaaagatgtggattgcactcttttttcctttctagggttttctcacgaggtgtgagtttttacctagaaaggattttaatgaggcaaccattgcactacacagctactttatatttgcaaataattgccttgtgtctgtgatttgtctgaatcagtgaatgaatgagtgactgtatgactaaatgctttcaaatattgtgaatagtgcatctgtgatatgtgcatgtaattttttggacatgtgacttgtaattttttgaaacttggtgaatgaattgttgttaaagtttgttgattcaatctgtgaaatgagtacttctgagttctgattcaaaatgttggtgcaaagatctgctgaatgagatgtcacaggcttatcgtgcctgggctggcacgagcccaatgggctggtcgtgcctttgggccaacatggcacgacccgagtgtttgtgggccgtacctgggcctgaggtgcagcccgtgggagggcacagcacggcacgaagtgccagtcttgccgtgccggcccgattgacctcggcctaggcacggccgtgcttgggccgggccgggccgggcggtccatttggccatctatagcgctagtggtatggaattttgttatatgatcatgtcagccaaacttgtacagtccacaacctagatgtgtcctatagaacaaaatttgcagttggacataattagagctagtgtgtctttgtgcttctctagattataacttttgactttatatcagtaagactaaccaaacaaagaaaaataatcgtgggagatgttgaatattggtataagaaattgcctaacacgtacgtaagacaaaatcaatcacttgatggatgatggataaatgccaaatggttgtttaattatgagtatattagttggtgctcctattgttacacacatttgatcctgaatcgcccaccgtttgaaaggtggagttaaaaaataagtgtatctgagattggcaggttgcccaaattaaaatcgcagaggaccacatttggaccagcagtagttacaacacatgaggtgatgagtcgcaatcaggtaagctctcaatcaagtttttgctgagtttctgaccaactcgctgcatcaggatttgttcagcgacgtcaatcttccgctcccttcactgtccacagttccacatatgcccactgcagggatcttaagtgcactactcttgtagatctacagcgttcgtgtcgcgttgtttccagctaggagacgagccatccgatcggaatggccgtgcttaattcgggcgttcaatcatcaggaagcctgtcggagacgcagctaactttcccacagctagctcggtagctctgcttcctgcacgaacgcagcggtcgcaggcaaagcaccggaagacacagagagagacagggacgactccctccacaaaaccaaccgcgagtgcgtccaaaacacgcacgacgacgacgacgacggcgaacagtgtggaagaggcaatcaaacgtgcgcgcgccgtcccagtaaaggctgtgcctgcccgcgccccctggaccctgcgccgcgcgcggcagctgaggcgaccagggcgtcaccggcggcatcagggcgcgtgcatgcatggcgcggcatggcat

SEQ ID NO: 60012 - DNA, 6815 bp, Oryza sativa
atacgtgccagttgtgtccgtgcgtggtcaccgatcgccgcgctgcaatgataaaccaggccatgaatccctacgacatgccaggacggcaggtccattttgaggaagcagcgaagcacagtgtatatggcactactgggcactgtgtgcgtatactgactgctactgttagatgctttttacacagatataaatcagatttctctcggcattcgggtagagcagctagctgtgtccatggagggcactaccgtttcagttcacatgattgaaactctcagttcctagctaggacagtccgaataaatttcactaaactttacaatacatattcatatagtgtagtgcccctgttttctttgagctttgctcctctacatgcaccgcgccggccatacctctttctctagtgaatggcaatacatatatattcatatggtgaaggcaagggtgatatggtgatctcgtcgagaagctcttacaataggtcgccggccatacctctttctctagcgattggcggagccgcggaggtaggaagctagtatgactagagtcataaggggtcaatataacaagagcgaatagagagaacaaacctccgtcaaatgcatgcttcatgtcaaagataaaagatagtgacagcggtgtgtaaggccgtaaggaataaaaacggtgcttaatggcatacaaagtatcgagcatttcgatcttcggggcatgaaaggaagtactacctccatttttagatggggcaattacaaatttaccactgctttgaatagttattgcaaaattgccactagaaaattacaaaaataccactataactatcattcgagtggcatccttgtaaaattgaaaaaccggtggcaaatttgcaaatgcccctttttaatatacaactccattgatcttttttatacattacgtttgataattcaacttatagaaaaaataagtatcatctattccctccatcctaaaatgtaacaacctaattaatacacacatcataatactagaaaatgtgtctaactagtactagggacttgtttagattcaaacttttttcttcaaacttccaacttttccgtcacatcaaatgtttggacacatgcatggagcattaaatgtggacgaaaaaaaccaattgcacagtttgcatgtaaatcgcgagatgaatcttttgagcctaattacaccatgatttgacaatatggtgatacagtaaatatttgctaataacggattaattaggcttaataaattcgtctcgcaatttacagacggaatatgtaatttgttttattattagtctacgtttaatacttcaaatgtgtgttcgtatacttcaaaaaacttttgccacacgaactaaacacagcctaggttactatattttggggcagatagagtattttgttgtgacttattttatcactaaaagaaagcatgacttgaattttttttacatctgcactaatttttttaataaacgccatgtccaaaagcctacatcgtcatataatttaaagcgagtagtagtaccgattagtgaatgtttagtggacatgtaagaaaattacccttttatccttttacatttttaacaatacatactataccaaataagaaatgtggctacaactctattgttacaataaaaaaaccagctaacacaagataaagaggtatttcccttttcttttggtttcggtcaatttggtgctagagttttctgttagtacattgttatgatttctaaagacgcagaatgcagaaacttgttgaggagaggcagctggagtatatagatcaagtactaagatttgagtaattggaggaggtatatcccggggttggtagccgctcttgtcgtaatgatccggacgcgtgtggctgatttcgacaaaatgggctttaaaaacttaggagacggaaagtgactaggctgtaatgattagagcacaagcagcacctattatactaatgatggatgagaggtagtagcactgattgagttttagatatcaattagaggaagctaatcatctgtggtaaaattggccagctttgagaaaaggatgtgctatttactctttatagttccaatctgaaaggagggaggggtacgcttttgtccatactgtttagattatgggcaataaaagtacatgctgcagcagcactgcacgcatgcagaccctaccagccgcatgacatgcaacggacggcagagggcgcccaggaacagcgaaagctaacaaatttgggatttttcagagggaagagccatactaaaagccactactactcatccttattagtcagaatccgtgctgtttgttcagtcatgttattttagaagttcagtaacatgttggatgcattattggtgcatcagtgagggactttatgcaattatttcaaaactcggcccggtcatatatacacacagacaatgtttggctaatgggaaatggcaatgattttccacccaccaaaatgcatctttaaatactaaccattcattctccctctttcatttaatcctaaccctttattcatttcccaattccaatctcaccctctatttcccattatccaaacacactcataagagtttgactgatctcaatatatagctgtatatccacgagtccaagaaaaaaaacaagtattctttttttcttttaacagatcgagtcagctagcccaaagttcttgaaaagtcagatgccggggtcaaaatgcctggagcagcatgcgcgcatccttactcaacttgcacgactgatgggccctcaactgtttaaagattcgatatgtcaacgagttgaaacagtaaatgttatcgccttcctttctttaagcctctctttctgcacttagctaaggggggccaatgtaccggccgaaagccagcacaatccggatatcaaacaagcacgagttttgtcaacaaagatgatctaatggtccaagcccaatcaattgtctctgacaagcatgaatagtaagcaggtggagctccactccaatccaatccaagggttcagcgaagatcaggagttcagacggggtaatgtcctcatcaacagtggtcccctgtggtcggggcgtggaaggaggtggaaccattccttacgccacaaccaacagcagcgccaatggccacacggatggagtatgtgcgtaagccagccaggaagacaacccatcaaatcactcatcgcgcccccacttgcccggataagcgtgccgctgttcctgtcctgggcgcacgccttgctcgcgcggcgcggccacaccctctcccatatcatatcgcccccaccccaatccgccaaacggcacacgcacacacgcgcaagaggacacacgggcgaaaaaacgcgcacgctttcgtgatcgagccgccctctcttctataaatggattctctactgtaattcacatgctaatcttccagccacacacctagtcagtcatcaaagtgtgcgtgcttctccagaacagtgagagagagaggggcaaagggaggcaggataaaaagccgagctgtaggggactaaagaagaaagaaaagcatagaaaagaacggcaagcaagcagctcgaggcacccgcgctagtacataaagccaccgaggtgcgatttcgcgagctctagccgcttccacttggccatttcccatctgcctcctggagctttagctctaactctagttctagctctagctccggctacgtttgcaactgttgtttatctcctggtgagtcctcctgtcatgttagccgtagattttggccggagcacaaggtgtttttgttgcttgctgattttacaggttgcaggttgttcttctctttcctgaaatggttttgacaaaagagctgttttgatctggggctgcctcaatcatttgcttctatggcaggctatacaccacacttttaagatgttttagcctcattggtattgtttatgtttcattatgagttattacgaaagactttaattaaaacaaacgtctagggtgctgcttgttgcacaaatgagttattcgttccgctttcaatttttcattgccagaacctgatcttaactccgtgtttttccgcgttctctttcgttctcgcttagacctcagcttacgcttcgggctggtttggtgcttttctccagcctaagttgagtgtagaactaaactttttaaggagttggttgaactcctctcattgccttcaaactcttcctactattctaggtggatagcatttagactcttgaagactttgagctagttaaccttatggaagaagggtccaacaaaagagaaggacttcctcctcaactcctagatctcatcccagatgagaaggaatggaagctgagagaagcattaggtctagggagatcaagaaacgcaggcttcgacggtgaagaagacaagaagctagacctaaagcttggtcttcctggttttatagaagatgatgaggcagaaaccttaagagattacaggctacagcaagagagcccatctctctcccttagtttctttccaaagcactccaagaccaccagcagcactactacgacaactggagcaaagaggggattcatagacacagttgaggacaaaacagaaggtaacaaacagcttttcagttctctcgtgagcttgttcttgaaacatgtttatacttgggattagaaacatggaaacaaactgatggaagcactgaactgaaaattactcttttgttgctttataaggttataacgaccagaagcagcaggcaagggcaggatgtgggaaggaacttgcagtggaggaaatgatagcagccgtgagtgagaggaagaaaggatgctgccccccaccaccaccaccacatggtgctcctgctacacctgcgcgcaacagaccacagacccagggaaggtactgatagcctatatggtgctttttccatcttttctgctctcagccaaggaacacatgctcgtttattcctgtcactcatttatagttcattcgaaggattgcatatagtccctccatgctcttttccaggttcccagaaatcgcaggtgtcctatgtccatttcaatcttttgattttaacgtgacgtgcaatggctaatttacttagctgttcttggtcgatatgaacctcaaagaatatactacttcttttatccctcaaaaagcacccctttttttatagaaagagagttgtcctttttctaaacactaaacttaattcctacgctcatagtcttgtctatttatcacttattcaactaagggcattcccgacccaatgactaggatggtgtccatagcattaaataagctgccacctaggataaaaaatgatgtggcaaatgaattaatgaggaaagagaaggaaaccatgtcttgcatgagacatgatttctacataacatccaagatattatgtgagataagtagcattaaatttaagtatggaatagtagtgtttgcattggaagagtagtgtctagtactagtttcttgatgatgtagagtttatggaaactatatctagtgtcttgggttgagaatgccctaagtctccttgggcacatatattcttggattataatcactctaacagtttaattggttggaacaatagcagtacaaatagaaaaatatatatactagtacaaccaattaaattattttaactattttattttattaatattatgcaatcatttatctcgatggcctttcagagacgaactcaccagttttctaacctgtttgtagaggagctgcagcaccagtggttggttggcctccaattcgatccttcaggagaaaccttgctagtagtagttcatccaaacattcccctgaaccacaaaatgataatgccaatgcaaaggtgacgctcacctgcaagaaaaaccctcttgtaaaaatcaacatggatgggatccctattggaaggaaaatagaccttgcagcctataacagctatgatgggctatcgtcagctgtcaaacaactcttccatgggtttcttcaaggtagaaattaacaatctatccaaataaaataagtacttcattttttataaaattcttagcttttatctgatcatattgcagctcaaaaggaccaaactaatgcgcaaattgcacagcaaggtgcagatgacaaaatattttatcaattgttggatgggtctggtgaatatactctagtttatgaagacagtgaaggagacaggatgctggttggggacgtgccatggaagtaagtttgctggtcccccttgtcatttacagtttttactggcatttacaaaataatcaaatcttaaaaacaacaaaaggacactgccaccataatttatattaggcaccaccaaaccatctaaattatttttcctgttctccaattcctgcagagtatttgtctcaactgctaaaaggctgagggttctaaggagttcagagctttcccataccctggtaagacaagctagaccacttaaagtcgtgtccaaatctttggtgtagccataaaaaaattagctttcgctaaatttgaatgaagatagctacacttttatgttagtctcatattctttactatttttttcctattctccagattggagctactgctagggtctagccgtctaggagagtcaccaattgctgaaatgctgggatcttattaaccattcggaatgaatgtgtgcactcaagccagtccattctccattttaggactacccctattttgcctatatagatgatct

SEQ ID NO: 60013 - DNA, 16405 bp, Oryza sativa
  unsure (1)..(16405): unsure at all n locations
aatgtcaccagcgtgtctcagaggacagcaactaggctaacctgatagcatcaagtcatcactccacgtggaatatgctactagtaggaatttttttttttgaaaaaaaaacagaattatccactgggtgagttgttatccttctaatcccatcactttccaaaatttgtcacaagcacagcgagaaaggtttgacccgactatgaaactgccgaaagcaaatatgtgctaatgccttcgcgcttattgggtgtcaaatagctatcatgtgatacaacagtggcatgattgtgaccacacacaagaggggtagatgttcatacttcgttttgctgtgaaagctaagaaataaactggttgtactatttttagtttttaacatgaatgcattatgtaggtccattaatgattaaaaccatctgatagcactagctgccaaacctggatgttatctccaagctgccctggtgaccatattcacattggcttttttgaataagccaatatcaacagctggtggcactgtttttattttctccccaagataaatacagtgcattagtttcaacttgacggttaacactgcaagcatgcctaatgcgtataactcttgcaaatatgtaacacaataggaatattagatgtataactcttgcaaatatgtaacccaataggaatataagatgttagaatagacactggtaatatttttggagggtaattgttatgaggcgtacctgaaataggactgcagaagaatcttataagttacatataatcttgtagcgccttcagtgcccaaagttttgacaggaaaatcaccacacagccatttccagcagttcatgccatctgtacagataaaaaccttatgtatttcaagatcaatgaagcaaacgggcacgaataaaaccagagagagagagacagagagagagagagagagagagagagagcttttctggtaaaggagaatattcaccttgatgcttccgagccttgaaactggggacaaaggaaaggtctttgtcattggaccatccctaaattccggacagcaggaaaagtagaagagacggggtggattacgaaagaatcttaggctcttttgtaatgtccttaccaaacatctttatccccacagtattgtgtgctcatgtgctggcacttgcagtgtgcgactgtataatttacctgtgtggcctaaaaactatactccttttgcaagaacagttctttggtgacagtgaaagccaaaaagaaatgcagacaatccaatgacagaactaaccttatttccagcacccaatcatgtggatttgctggcacaacaagttgaatactagatagattaagacgctaacaccattcaaagatgttctatggaaatacaatagagaaatgtaaaggagtgcatttatttgacacaaagcaatttggcatgatgtgatcaaaatctaatgaacaatgccatgtatctcgtacagtgtgctctaattcatgatgctacagttacactggaaaatgttaacctgacatcgacagtcgccttcagatttcagccccaaaagggagtatgcataaaaaaggataatatttttgctcacctatgaggctatagctagatgacctactatggataaaagtggtactcatcccatgttccacttcttagatgtttggttattaacctcgtaaacatagaccttgcattagtttttagagaacacccaggagagtggcacatgtttgttattaagcagatagctctgcaagacttttaggcttattaactcatgttatcatgtaggatgtgtaagtgcgttcatgggttggtccaacccaacccatttgctgatttgcatccctatgcccaaacataccaacacatctcttatgtccacatgaacagaatcaaatatcaataagagattagcagaagatcacacaagaattatgtacaatattatgatatcaagaggaagaaaataaccgcaccagcaaaacgcatacgtgtaggcttgatggataaaataaattcaccttagggttttatttctggaactgcatataccaactaataaaaaacaaataaatcactatatgccacatttaggaagagacgtgagccaattgcttacgttgcattagagaacaggcacaaagaatacctttacagcacaatcagcaatataatttcacaaagcaatgtaattaaatataaaatgttagctaaaatggcaaattggaaattgtgtaattcagaactccatgtggggcaccatcctgcatatgtgcaaccttataatcaaccatcacctagcctacaaaataagatcgggacgcagcaatagtgcttatatagtttttaaacattatttttctttcagcaaagatattgcatcttacctgtgttcaccgaacataaggcagaaatttgttcccactttatccaggtatgccaactataatttggggtattccccaaaactatttgtaatggattgttccatttcaggtaataagttgggtttctgtgtcttgtattggcatcatgttcctatttccaactctctagccaagtacttgttgaaaaacagtataaggatggtgtacttatgatctatcaggtcaaaccagtgttttacagttgacagctcagcaatgctctttgttttgagaagaaaagtagaaaacatgatggctactgtgcatcagtaaaccttcccgtgtcataagaatatacaaggccagtttccttcattttcaaaatacctgtcagcaactcagccttgactagtatcattattcaaattttaaccaccaagaacttctaaattgttaggtcatattcaacaaaagatatgtgattacatttgccatgcaacatacttcaataatacaataatatgatagctttgaagtattttcaagttcgataaaaaagtggtcaaagtttgaataagaatagtgtttagtgacaagtattgtgagtttgtgacatgggagtagtaatattattacaagagaacatcttgggctacaatagcaagagcaataatatgactatattttgcgacaaaacatgtctaggtatgaatgcatttgaaagagatgtgaaactatagtcttgtagcttgcttactgtgaggctggtactgttgaactattatgttgttctgctttcacttcctaacttttactaagatgatgctgaaagttcaaacatcacaaggggacaatcataaaaatcagatttccagaagatggaaaagaacgccagccaggagacggtaaatagcaggaccagattctgtccagatggttctatttgacttccaattcacatattttttcctctaaatcctaattttcagcaacttgtaaatcaccaacgtcctccatccttccaccaaaaaaaaaaagaacacaatattaatactactgtgaaacagtaactcgtggccctgcatgctgagcaaggatcagttaactctggtttttttaatctccaagcaccaccagttaaaatagactggcattatatttccagaaaataatcacaaaatggatggcaatccccccccccacccccgcgcctttgtcaaacacgcacgcacaccaaacacaaaaaaaaagggaaagaaaatgcccatgatatacagattaaaatacagtaatatactcgtattggtgatgttattgttgctgtaataaaagatgcagtgtccaagatgcctctagaaagatcaaaagtaatacgatctgtaattgtgcatacatgtatggatttcaaatgcaaaaacggtataataatactctataacaacaatgcagtcgttatcattgatcaaaaaggaaatccaaagagaatagttagttagttattaagatcattagttatatatatgtgagcaaagatgtactaaacacaagcagagaaggcagaacatcaataaattcctatgcatgctttatatgttgaagaactttgagaaaactatctgtctgtgttatattatgagggaataattagcaagcaaggataactttgtggatttttcatgaatgccactcagaccctcagaatagttcgaacttcgaacgcgcctcaccttacagccttcaatcatcagttccacacttgaccctcctaactatcagttgctttaaattctctaggtctacactagctgtgttacttttctcagtttattgctttgcgttggattacaacagcaatatatgacatctattgtaactgactggctgcattattttcactaataaattaacacaacatgcagtatttgagtttgtaaacaatgccatccatatacttcagtcggtccatgacaaacagaaaacaaaattattataggccatcttaatcttaaattatttaagtcatcaaaacaaatgtgtgctgaatgaagctgaggtgaaaacggaagcttaagcacaaattatatagtatgtgtaccaagaaccaagcaaatagaaggacatatttttttaatgagaacaactccatcttaaatattttaatgtgtaccaaggaaagccatgcatatggaagctaagttcgagaatatatgaatgaaacgccatacattgaaacgtattacaagactagtgatatcattcttcatatgaccaatgaatctagtttttttcgatgttagtagtcaaagtaaaagaactttgacagtacagcttctaaaaaatcataaattagtaggtacacccatgcttgcaaaattgccttagcaaaccaagagatgtattagctgttagtgcgatttatctagatataatgcagtaatttggtgactaaactaataagaatatatggaatatagactgtaaaaagaagggaacagagcgatatttataggaatgaatttgaggatgacaacttgtcaggaacagagcgatgttattttccaagttgggtcatctttctagtgttacggtattacagagatatttataactgaaaaaacgacactaaacatgcaatattgcaaggtagatgcaggtaatgctcaatttccttggcatgctcacaagagtcgtccaggtaaggaatagatttcctctgccttaatcttttttgaccttttggacttctgaaaaatatttctaactagcaattctttatgtgcttattccagaacataattatggcactatgacaaagaatcatttatgtagaagcatgcgactgaaactgaactcagtacatagagggagtaagtgttaaaagagaactaatataaataattatgatatggatggatgaattatgtgacatccttacataagagggatgctaggcttatcacttacaggggatgcatttgttccagccagatgataaagcaaaacccctgctgcgacacttacattcaagctctccactgcaaggaatgatttcatatcttggttacctgaataattatcaccttcttcccctccatctgtgtctgtatctgctcctacaaaagatccatcaacattacccggaattctgaccaaatgtgtgcaggatcgctcaaccaggggcctcaaaccagtgccttcactacccaacacaaggattgttggttctcctggcacaacttcagatagaggtatagctttaggagcaacagtaccaccaagaactcgccacccattttcagccgatgaagataaaaactgcatcatgttcctacaggagagcagttcgatcaactcaagtgagcctgcactagctttgctcactacaccacttaatggagcagagttcttagcacataacacaacaccttccgcgccaaagaagtaggcagatctaattatggctcctaggttctgaggatccatgacctcatccaaagctatccagacaggtgcctttccatcgtccaccctgactggctccaactctttagtattcaccatttccaagggtgatgcatcgagtacaaggccctggtgtggacggttatccacaaccatgttaaggtcatgctttgatgcttcgatgactttcagcccaatcctctctgccagttgcaacactttctcaatccctttcttgtccttcttcttcttgttgctcacactaaaatccatcccttcctgaatatacagcgcatagaagtccctcctctcagccatgagagctgcaagcacagggccaaccccataaaccccctgtccaaccatttttggcactgtcgattcccctgcctccttccatgtcttcctcccccagttctcctgcctgctccactgcctaacctccggcttgtcaaatctctcccctctaaatctctcaccacgggaccctctatccctcggcaccatccgccgatacttgtccttgatcctgccccacttcggattgtcaatcgagccattatcctcttcctctctaattatctccctgcccgaaccacgatccgtcaatacctcacctcgcgggctttggtcgcctctggagaaaaacttctccgcggaggtctcccacgaggaggagcggccggcgctagccctcgccgcgggggcggcgccgccatcgcggctcgcggcggcgagccaagggagcgcgctcccgccgtcgggcgatgcggtaccatcaggtgcggtggagaacgaaaccctacctcccagccccagctgcgaggggccgcccgggctaaccgcggctctggcgctcgcacggttggtgacggtggttaccggatgaagcgcgggcgaggaggccgtgggcctggagaagcacgctgcgcggagaaggccggcgaggaggatgcgtcgcggcgaggacgccgccgcgaggagcgggaggggctgggatttggtgaggccggagtggagcatagcgcggggcggggggagtagggttttggatgaggctggagccgagggggttttgggcggcgcgcgccacccgttcgacaaaatgccgcaacgagccgacgacgacgatgcgtggaaagtcacggttttgcagttcgcttcatctctggcgaccaattcatccaacggcacacgtgcatctttcttcctttactcgcacaccgtgcggcccagttcacctacagcaggccatcggctagcccatcagaattcagaaagaggagagaagggacttctgtattttgtggacccctttaaaactacagtactgtaagggcaattactataatgcttcatatgctacctctagaaataacacatagaattaggtgatgaggtggaggagagaagtgaggtgagagatgataaaaccacccctaaatgaagaggtggcttccacacaaactccaagaaggatgtgagagtactaaagacattgatatttgtctattagggacagtggcggacccagaaaaatcatattgggtgtgcccacgctaggatgtataataccattctttaactaaaacatgtcaggttataggtagcaaaagttttatgaaatttgatcaaaatttagttcaattaattcatgaaaagttggtaaaatgtacacaatttatgaaagaacccatttcacccatgcttggtccgttgtcgcaacccatgcttgattttgcattttagttttgatgaatttgaatcaagtaacactggtccaagaatcagatattcagagaaagtaaattatagaagggtaaaagactactagttcggtgatggctttagggcctcaaggctccaggccattggcgtcggcgtaacatggactgcgttgtgcgatggtctcagcctcaccgtggccgaccaccacaacatactgtatggccattgcttccgctacttttcttgcaccaccaactgaccaacagaaatgcccacaacaactagagaacgagatcaggtaagccttttggtcttccgtttgtttaggaacaagggcatctaccaaatatttaggccacgaatgaatactacatcctatattttctctgaaatatttgggtatgtccgtgcatacccggcaccatacctaggtccgcccctgattagggatgacctattgtatatcttgcatcttaatttataggtaaatgatataaataaatttgaaggtagcaatcacatctactataacacttgctttaaagcactgtaaaacttgtgtctagtgctggtcagctggcatgtgaggctcggtattatagtgagacgtactgtaaatatccttatggctttgctgttgctccccgctgtcgtctgctactccatacaggaatgcaaaggacaaggctgcaacagaacaataaaaactgaaccgctgaaatataaaattgatttaacattgtgaaggcgaaggatgaaataggccgagtttagttttaaacttttttttcaaacttccaatttttccatcacatcaaaactttcctacacacacaaacttctaacttttccgtcacatcgttccaattataactaaacttccaattttgatgtgaactaaacacatagtagagaaggaagcggaggaggttctggtcccaaagagtgggggcggtggtggcgatgagatagtggtagtgttgtcatcggcaacaatagtggctgcagcggtggtggcacgtgagtcatcataatacgagaggagtttattggcatccctgtcgctgggcaccattatctcttgtttgtctggcaccttgttttcaaggtttagatctagttccaccatcgaaacaggtgtgcactatatagatattttctagcatcggctgataacgcatcatatcaatgatctggtacagatgggtatcagtcgatactagtgagatatctgatactgtctttaggtattactccgtacctgatatcgcgtagggtaccagatggtgtgatacctatctgctatcaaagcatagcaacccctaacaaatgggcctgttcggcaggccgactgtgagggatgcggctgcacacagtgagtacggtgctgttcgtgcgcagctgcagcctggcaaccgaacagatccaataataactcattatgcataatttattatactattttcatcttaaaatatagaatagtttgttaatgtaacctatataatttttaggagtattctgtaaggaaaaaggtgtgtggtaaacttgtgctggaaagagccgtaaagattccgcaacgtagcaccggcatgattcatgagtgccaggtgccaggtgtcaaataagccatgaacccaaagccagtcaaaagtgacgaaaacggtgagggtggttcttggccgctggctgcctgcctccctgcaaaagccggctcgcgaacttcgcctggcccaacaagcgctcctgcatgccgcttttcgttgcgcgcctcctctactcccgtagtcccgttgcccagcaagcgaagacagtttttccgcggtgtctctcccttcccgacctccgtttcttggagatctcaggtgactttccggttcaaaagctttcaaggtgttcattcttcctcgcgcgaggggcgcacgactgcacgaggcatgacgcagctacgatgcttctgccgcacagctcatacggcgcgctacttgtgtttccaccgtgtgtgcaggcgatcgctcacggttgttcgatggccggggtttgggtttggtttggtttggtggtgcttctcgttgttgcgtatacttgcatgaaaagttgaaactgcagcgcgtcgtgtatgcatagcgattgatcgatcaggccatcatatggtcctcactcctcacacgtactagctaggagttgaacacaacaatatgcaacgacgatggttaattatacacggatttactctagatgtacgtgcgtaggtgtgcatactcgagatgcgccgaactgattctattgatcgcttacgcgttagcttaggaggtaataaaggaaaaaaaaaagagagaaagaggttaaggaccgagatgaattgatctgcatgagtcccattttttttcggcacatataatgtccaaataactcttcaggactgtttggataataggttaagaggaatcgaattaagataggaatataagtggacgattgagatgaaacgagggatataaagaatcgatggttaggattaagagtttaaggtggtgtttgaatctcttgaagatgaaaatgaagattaagtgttttatgcaaaacaatgtgataataacgtgtgattagttgagttttattttttacaaacttgaaaaatggattaatctgatattttagaacaacttttatatagaaagttttcgcacgaaacacaccgtttagcagtttgaaaagcgtgccacgaaaattcaaaagtttatccactctttgtcgtggattcgaacaggatggtgggaaaatattttcccatcccaggctcaataataaccattcttaaatagggaaaattggaaccatgccatnntnatnntncnnanatngaaatatgccatccaaacccacatgtcattgacacatgtgggtcctatattcattgagataccgatggcatatctcaaactttgcaaaattataatggcatggttccaatttacccttgtaaataagttactccaattatctaaatctattctaatactttctccgtcctaaaataaatttatttttcacctatctcacacataccaatagaaaacctgaaagactagaatacccttactttatcaaatctcaatgcattcctctactttattgctcctgtcggagtgtgaaattcctctgacagataaacaacgcgacgctcgcacgataaaaatgagggaggcaagttttttagactgtgttacagccctgcctagcgacgcgtggtgcaggactcaccacgctcccccccattctcaacaagacgggatggtatgcatgcgccacatcactattaattagggggggggggtgttgagcaaccccctcgcctatcaaaacatcatcgatgcgactgcgcttttcatggggtgcctaaggcaggtggcgcgctcgggccactgcttgggcatgaagagtgttcttacgtggtttgtgtaatctttgattctatcttagctgtatatgagcttgcaagagctacaacggatgtgccccaagcataacccaggaggggggcacgctatgggcggatgtgccccaagcacaatccgcggggtgccgcgcccgaggaaaggagtgccccgagcacagcccacggggggttcgtatccggaggtaagatgcgcccgagtagttggtgatggtaactctagttttcatttctctaacaacccccaatacaattattccctacttatgcaacaattactctaaaaataaacttattttggaacaaatgtaatgagctaaaaataaacttattatgagacgaaggaagtaagcaatattgaaattttgtttcaactggttggactcccatttgtttagtgtcgccagtttacgtgtgtcagggttatggataccacatacctaatagtagttgacttaatctcagcaggacccaccatataccatgtcttatacgagaactaactttagatatggagggagttccggataaggaaagacaatcagagttctacatggaaacgacaaggactactcggattgtatccatattggtttccctagttctaccttgacaaagggacacctatgggtataaatacaaggccctctaagaggagagtagacacgagataatcgacacccaccacaatctacagaataatatatcaagacagaagatcaacatacaagccaacatacgccaagacaagacgccagatatcgacttcagagataggcacggctagtcccctacggtgtctccggatactgtcaggagagacgaaagcgctatctttgatctcgccggacacgaactcgaggaggaagactaccctgttgtcgactacgagtcagaccttcagaccaccatgtcgacaacagttatatatgctaccctaaatattgtactggtgtgattatggtgaataagagcaataccggcttcggccaacaggatgtagggttattacctgacaactcaggggcccgaacctgtataaaaatccctgtctccatctcttttacctcagtctcacatatatcctagtaccaacgatccccatactatgcaaataccggaatcgcgacatcaaacgtcgacaacgtgttttagagattttctcatgtgttatgcgaattctcttttagactactatgaaacacaatattttaaaaatacagggataaggaaaatatagaaatatgtcatcacgacttattgaatcccagagaaaacaaaaccacatgaatcgctcaaaatagatatttggatgattcacaggaacaatatactccatccgtcccaaaatataagtatttttagactttgatacggtcttcgagatgctattttgaccaacgatattgtgatagtttgtttaatgataaatctagtaatattaattttacatgattgatcttatttttttgctattaatagttaaaattacaaatatttgatttggcagtatgctaaaaatgcttatattttatgatagagtagaaaacttaagattatattgcgatttgttagagagaggtgagagagaaagatataagttgtattgaaattcttaaaggaatttgaaaacataaggttagatctcacgctaaaaatactttaaaatatggaggaatcttttcctatcctatgaaaatcttttgaatcaatcctaataaccaaataataacctccataggaattgttaatgtgagattgggggtcaagacagcctttcacacgttcattgcattgggcatcgattggttcgtcgcccagccggaaactctgatgaagtctgaactctaggttagaattcccggtcacgggagaactgaaaagtctgaaaagcgatcccgcgccgaggtgctgatcccacggccacgggccgttgcgccgttgagcaccgacggctgccgtcctggtttcccatggcagagcagccgcctctgtcggtcagttgttcagtaggcgacgatggccagcctcttctgtcggtcagttgtccaggaggcgacggatggcgtccgtgcgtggccggccagccccaagcgagcgagattcaggctggcacccggtctacaatctacatccatgcctcccgaggccgcgggaggtatacaccatccgttacctccaatggatcccccgccttcccctgtatgctctcgtattgcgtattcccgtggccgtgcgcccgtgcctcactgcctctgctgtatgcccgtacttattccgtttgtatgatggttgaacgggtcggtactcggtagtaatgcttgctaggtgttcgttgttttgcctgacaagaagagtcgtggccttggcccgagaagcattagttacatttcgttttacagttctcagttactgaatttgttttgctgccgtacctctctgaattcccaagtacaactagtgagaaattgaccatggtttgcttggtggtaggtgccatgtctactattgtattcatattagtctttttttttctattcttaattgatgtgtagttccttataggtgccacaccaaatatgtgtagcgttgatcaaacattttagtctgacacatgacagatcagtgctttatctaattatctgttgtcttaatgatatcgaaaattccaaattgttgctctgattactattctgtgtagtacttctactcctgtcagttttccacaaacagatagttcattaggttggataagtggttaaatttagttgcaaactctgggagagatgcaactgttatcttaacaaacattggatcaggggaagcacatggagtgtagaagataagtcaaacttatgtcagattcccaaggaacatgatatcatgatacacatgcttccagtatagttatacattagcacctggctgcttcgccatttgttgtggtgatgctcatttattatagttttttgagcaagatgcacagttctattaagtcatgtaatgcattttttcattatgcacttgacagctgctgaattttaaattgactttcagtagaagtactattgatcttagactcaatatttttcttaacgcgtgcttgccattctgaaacacaatttctagtttacctgcggctgttattaactcactgcaagttattttctgaacacgaacttgtaagcaattgttctagtacaaattcatatggccatgcattatgtcagcattaatattagtgaaagtgggcaaatggatgtcgaaagaattaaaattaacactttataccatgaatgaacttccttctccatagctttattattctgattttacattaactgtgaagtttcacctgtgccaaatgtaaaagcaagataggttacttttcaaatgtttataaatgctcttccaaatttatttagcatgctgctttatctttcattttcactgtgaggtttgctaatcgaattctttttactgggatattcctggattctgactagattgatcatttcaaaacaggaaataagtttggtgtaaattgaaaatcactcacaatggttaagtttacggttgaagagatgcgcaggattatggacaagaagcataacatccgtaacatgtctgttgtcgctcatgtggaccatggtatgtttgagtagagtgctctaagactgttatacaactattatctttttcctgatatgccacctgttatgttgtcattattatttatactcatgcaaaaaaaaaaaaactactattcctttttgtagtagtgactgtcagtgctcctgccttttttttttcagaaaaagggcccatgctaagaacttttgctctttatcatctgtagttaatgtgttattgtcatatttatttttgcttgatatgaaatgtctgtaagcaaattaactgtatctgccttttcatttgcatgatctcaaaattaaaagctagcattttatagtatcaccttcatgtgtgcatccttcatcctgctcactgtttgtgctttttcgttaattaataaagtaacttacttgtttggtctgtatcacttctttgtttaacagagggttcctgatttcctgaatatattatgctcttgttttcctatttgtttgctgattcaacatcttgagttatatttgatgcaacaatgatgtttgatctgttatgatttctttgcaggaaaatctacccttactgattcccttgtggcagctgctggaattatagcccaggatgttgctggtgatgttcgaatgactgatagtcgttcagatgaagcagaacgtggtattacaataaaatctactggtatctctctttactatgagatgagtgatgagtcactcaaaagttacaagggtgacagagatggaaatgaatacctaatcaacctcattgactcacctggacatgtcgatttttcttcggaagtcacagccgcacttcgtataactgatggcgctttggttgtggttgactgtattgagggtgtctgcgttcaaactgaaactgtgcttcgccaagcccttggtgagaggattaggcctgtcctcactgtgaacaagatggatagatgttttcttgaacttcaagttggtggtgaggaagcttatcaaactttctcccgtgtcatagagaatgcaaatgttattatggcaacatacgaagatgcactccttggtgatgttcaagtctatccagaaaaagggactgttgctttctctgctggcttgcatggatgggctttcaccttgtctaactttgcaaagatgtatgcatccaagtttggagttgatgaatctaaaatgatggagaggctttggggtgagaactactttgaccctaccacaaagaagtggaccatcaaacacaccggttctgatacttgcaagagaggttttattcagttctgctatgagcccatcaggcaaattatcaacacctgcatgaatgatcagaaagataagttgttgcctatgctgcaaaagcttggtgttaccatgaaggacctaactggcaaggctctcatgaagcgtgttatgcaaacttggcttcctgcaagtaatgcacttcttgagatgatgatctatcaccttccctctccagcaaaggctcagaggtaccgtgtggaaaacttgtatgagggcccccttgatgatatatatgcatctgccattagaaactgtgatccagaaggtcctcttatgctgtatgtttcaaagatgattccagcatctgacaaggggaggttctacgcttttggtcgtgttttctcagggagagttgcaactggcatgaaggtccgtatcatgggccccaattatgcccctggccagaagaaagatctgtggg

SEQ ID NO: 60014 - DNA, 907 bp, Oryza sativa
  unsure (1)..(907): unsure at all n locations
ggaatctggcgagcatattattgctggagctggcgagcttcaccttgaaatttgtttgaaggatctgcaggaagacttcatgggtggtgctgaaattactgtctcccctcctgtgtctcattccgtgagactgttcttgagaaatcttgccggactgtcatgagcaaatccccgaacaagcacaaccgtctgtacatggaagcccgcccaatggaagagggtctgcctgaagccattgacgagggtcgtattggcccgcgtgacgatcctaaagtacgctccaaaattctatccgaggagtttggttgggacaaggacctcgcaaagaagatatggtgttttgggccagagaccacaggccctaacattgttgtggatatgtgcaagggagtgcagtatcttaacgaaataaaggattccgttgtggctggctttcagtgggcatcaaaagaaggtgcactggctgaagagaacatgcgtggccgtggcatttgctttgaggtttgtgatgttatcctccattctgatgctattcatagaggtggtggccagatcattccaacagccaggagggtcatttatgctgctcagctcactgccaagccaagactgcttgagcctgtttacttggtggagattcaggcccctgagaatgctcttggtggaatttacagtgttctgaaccagaagagaggacatgtgttcgaggagatgcagaggcctggtaccccactctacaacatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60015 - DNA, 8006 bp, Oryza sativa
  unsure (1)..(8006): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctaccgtagttaaattttaaaatttaaatgttaatctgagaatagaatttggtgttattttcaccgtggtccatttcttagcatttattttaagccgctaataatatactctctttgtttcacattgtaataagttaatctaggtttgtcatacgtcaaaaaaaaaattaaactcaaccaatttaacagaaaattacaaaaacatttctgacataaaataaatatactataaaatatattgattgatggattcaataaaaatactttagtgttatggatgctaatatattttttctataaacacccaaagtaacttataatatgaaacgaacagaacagagtagatgtgtgaaagtttttgctataaattattttggttatctttttgcatggcttatcagtcgtacctcaaaagatcaaactatatgcctttcaagatgaaccttaaggcactgttgcacacccgttaacgatggatttactgtaaaaaaaacagagaaaaaccacaacatataacccgcacaattaaaaaaaatcaagatccgttacaaatagatcgaataacatgtggatactttttttatatcatgacaaaatattggcaatgttgaagtctagatggaattggcatcaccaatattttagcaaactatttgtttgatggcatatttttttaagcaaaccaaacatttgcaaagtactactacgtccctcatataagttgttttagttttgttcttagttaaaattctctaactttgattggttttagattattttttaaaataatatttttaaaagaaaacttcaaatgttatagatattggtatattttatttttataaatttggtcaaagtccaacttataacataacttaagcaccttacatcggagataataggtgctactcctattttaaacgtatcctcagctcggcgctggccgaccagcggtccagcagtactatactattgcaaattgtaatgccgaacttatcaggcgagctactagttcaaagcttcccgtctagaacatacgtttacgtagggcagcaacttgcgaagtccatcctcgcgcgttttggctctcctcaagggcgtttcagtggggagtacggctgacccgattgttgagacgagtggcggtttcaactctcaactgacggaaggggagacgcacgcatcgtcatctgaccggccgctcacccgatgaggcgagcgattcgatcggatgggcggatcgattgggttgggttgcattggattggattaggcgcgggaatcaggtggcgacggacgggtggaagttaggacggcagcgcagctgcaagttggccggtttctttttgtatttctctggcgtggtcggctggttcagctagccggtcagatgcatggagcggatagagtcgatttctcttgtacgagtagatcacggaaggaatgatgatatttttcgtacataggcctagagaatttttagggcgtttcgtagtggatgggtcaatgtatggagcactgtgttttaataagacgggaaagctggaatccaagtagaaactcctggagacaccgccgcgccggggggacaagcatcgtgatcggtaggaaggcgatgagcgggagaacaacgatacttgcttaggtcgagtacgttagatcttccgcgttcttttcggcaattcggcccactgaacacggctggtcttgcggcccacagtagcggttggcaatgtcagtttattgacttcctgagctcaagctacgcctctctgaccatggaatcgtttttttttttctttctcgaaacaaaaatacaaacataaagctcgtgtacatacttcccattcgaaacttgagacaggtgaaaattaagcaagggcacgtaaaataaaaaaaatattaacgcatgattaattaagttttaattattataaatttaaaaatagatttatttgatattttagagcaactttttatataaggttttcacacaaaacatatcgtttttcagattaggaaaacatactaacgaaaataaagtacaatctgcatcttaaaaaaaagacctcacttttataagggcccctttgatttggaggaagatcatataaattttggataatttcaatcctatagtaaaatttcatatgaaaacctttgaaacaaaagattgaattatatgttatcttttgaaattcctatggaatgaacaatcctataaagattttggaggaaatttagtaagagctacaacctcttggaaatatccctttgagtctatcttgctcgtccgattcctatgtatttcctggagtccaatcaaatgatcatttttgtatttttcctatattttgcaattctctgttttgcacttatatttctattagaatcctatatttttcctattgctctatttttgtgtacctatgatataattataaaggggtcccgaaggaacacacgcacgctacctctacgtgcatttatgagatattgtactagcacatcttttgattaacaaaatcattataaacatctagctatcgaaggatacatcacctgtgatagaaataaatgaacgtatcgtgtaggatatgtttggttcgatacgatttaaaaaatgtagttttgaattttataaaattttgatagttaccaatccaaacatacgttaaggctcgattctgtttatctgattagatgatagacgatatatcattaggttttgtgatatttacaaacgaatgaactaattattataactattataaagttgaagtgtttttaaatactatcaaacttgtacataaaaaagttctgcaaaaatcgtacgttttactagtaattttgtagcttaacaagcttattcatcatgataatttatcctgtgaaaggaaaataccctacgttacctatcccaacttcccaagtcgtgtaattctgtaaattctctcacctaacaccacacaaaagtgacgaggctttaaacttaaaacactttcgcatgcttgaacgtgccagcttcaaagcaaacagaccctgtgttttgaagggagaaattgcaacatatggtgaaatgaacgacggacgacggactgtgcaatggcccattatctcactgggcccggtcgtgtgctgtttaaccgcagatagaggatgatgaatcttgttaggaagaagattattttacctccctcaagtaagagctgagatataatcgaaaccctcatccacaaaaccgggtcaacttatcgtctactgtaagacacggtttggacattggtttcgtcatacataacggaaaacacaagaataataaaaaataatggacctcgcgtgttagtgttagtaggttagaaaaattaaaacaagttatgtgacacccacatgtcaggagtactttctcctagcttgactcatccactcagtctctatgcatcctatcttggtggagaggagaagtgtaggaagagctcgccggtggtgcatgtagagaaggcggcgatactcaatggagaaagaggagatagagctcgtggccgaggtagtgcttggcattggaaataactagaggctcaacacctttccgaggacttcctcctgttgttccaagactgcctttatcttgggtatgctgtagcccctatgccatcatcgggcctagccgcgcacttgttagatcgatagtacggaagctactcacatcgtgcccgtcagttgccgctgctcgatggactagcacgattgggggcggcgaagggtggcaaggcctagatcgtgagaccatcgttgctgtgcttcccgatagctaccgcctgcgtctaccatcccaaaagatctcccgacgacgacgagtttattttccacctcttctttcctctatctccatctgccaccatggtcgatcttgtgcccgtggcccactcatcgagtactcgattttgccactgttagcgccttgctctttggcggcggcggcctgctcgctttcctccgtcgtagattgacgagtaactatgaactaggacaatgtgccatgtaggagtggataacgagccagctcgcctcggctcattaaccttaacaggctaaaagcctagctcagcttggctcgagagttggctcgttaaactcattaatatatatttaccaacttcacaatttcaattttacaagtttaccatgtataaatataataataaacactactatctccatcacagtattagtgcatccagaatataatgtgatatatcttagaactacgagtcttggatgcacttaagttaggacggagagactatctaataatgaattcactaaatacaaatagtctggatataattaaatgactaaacactacttaagaagcactaagtatacatgaagatatgacgatctcttatattaaaaatgcgtttgaacaaaacaagatagctataagcgcatgattaattaagttttaattattacaaacttgaaaaaaagatatatttgatattttcaaacaactttcatatagaaagttttcgcataaaacacgttgtttattagtttgaaaccaaggtaaaatcttcatttttttttgagaaaagaacatgacctaagtctctccataaaaaattcttaagcatatgttattttctagctttttaaaagagaatgatatatttgtagtcttcatatatccaagacttaaatgaagatgttgttttttggttttgtaattctaggttaaattgataatcagaaccgaaacaaccattttaatattcatttttttacatgtatacgtataattgccttttttacgtagtacttacatatatctacctataatagatcttgttatgactatacaatggattttggctatatatttatatatttagtataataaaattaaatagacttatattcagatttattgtattaagatatattatactctattcgtccaaaaaaattaacctaggactgggacgtgacataattttagtatagttttttatttttttaatggaaggagtagtgttcataagaccatcagtgacgagcacccaccaccagtccgatctgatcatttgtgaaccgtctgatatgtggagaaacagtacaacctgaggtgggctttaaataacgcctccgcttcccaaaacgccaaaaagcgcgccaaaccaagggacgctgcctttgccgctgcgggacgggcccacgccgtgtgtgtttttgcgggcggactgagcttaccgatgcgacctgtccctgtcactcccgcctcggtaaccggcgcgctaccctcgctttcgcttgctgcaagagcgcatggccgtggactccatggaccccctcctcctactactactgggagaatgggcccaagctcctgaaccagaaagggttttctcaagcatttaagcgactgttttctcaagcaaagcatctacccaaatgaaaaccaggagcccaggatagaatatgtcgctaatgagcctgtctaaacatggtaaagtacactccacacgagtgaagaagcatcaaaacgcgtaaacgacccggttctaaagtcattttttaccgcggctcctcagctcgaccgacatgtggtggtccatgtaaaagaatctccccagccgcaaacattctcgcattctccacgactccactaggcacacttttttttctctctctcttggtccgattaccactgatacggacgtgggccgcttttgtttgaacactctcaacccaattttataacgcccacctcgcgtccgcctcggcacggtcacgcacgcactccactgcactgcactgcccgctttgttgctctgtgcctgtgggctgtggcgtctgtgaccgtcaggcgtcagctcgtgtcctcgcctgctcgtcctccttcctctccgctggtgctctctctctcttccctccacgactccacggacggtcagggcaagggcacggtctcgcaccgagccacgggcgcacgcatcgcgaaagcgcggccaccggcttgtgttgggtaggaggactggcaggggcaccaggcggcggagcggagctcgggggctcggacgccaatggcgcatgtggcttttgttgcgctcctcttcttgctgctcgtcggtgagtcgttcaaccacaccgcgttccttcttccgttgctctcgctgtttgcgtagtagtgatacttttgtggggagagtgttcagtgagtgagtgctactgctagatgccttgcttgccggtgagtgtagcaacctgcagatgtgggacaagaatacgattcttcttgtttcatggtccagttgttacgatgcacattgaacttgttcgtcttttggggtgaaatcactcattttatcgatgtgtatttcaagattgtttctttttttttgggagatgaagaaatggaagagaaatgatcactaaaactatgaaaaatgcatgattgcaaatgtggcttttgcagggcattgcctcggaggcaaggttggcatctgctacggccgcaacgccgatgacctgccggcgccggacaaggtggtgcagctcatccagcagcagtcgctcaagtacgtgcgcatctacgacaccaacatcgacgtcatcaaggccttcgccaacaccggcgtcgagctcatggtcggcgtccccaactccgacctcctccccttcgcgcagtaccagtccaacgtcgatacctggctcaagaacagcatcctcccctactacccggccaccatgatcacctacatcaccgtcggcgccgaggtcaccgagagccccgtcaacgtgtccgccctcgtcgtgcctgccatgcgcaatgtgcatactgccctcaagaaggccggcctgcacaagaagatcaccatctcgagcacgcactcgctcgggatactgtcccggtcgtttccgccgtccgcgggggcgttcaacagcagctacgcctacttcctgaagccgatgctggagttcctcgtggagaaccaggcaccgttcatggtggatttgtacccctactatgcgtaccagaactcaccaagcaatgtctcgctgaactacgcgctgttctcgccgcagtctcaggatgtgattgaccccaacaccggactggtttacacaaacatgttcgatgcgcagatcgattccattttctttgcactgatggctctgaactttaagactctgaagatcatggtcaccgagacagggtggccaaacaaaggggcagctaaggagaccggagcaacacctgacaatgctcagacctacaacactaatctcattcgtcatgttgttaatgacagcggcacacctgcaaaacctggggaagaaattgatgtgtacattttttcattgttcaatgagaacaggaaaccaggaattgagtctgagaggaactgggggctgttcttccctgaccaaagctctatatacagtctagattggactggcagaggcaatgtggacatcatgactggaggaaacattacaaatgcaaatggtacttggtgtgttgcttctgctaatgcgtctgagacagatctacagaatggtttaaattgggcatgtggaccaggcaatgttgattgctctgctattcaaccgagtcagccctgctaccagcctgatacattggcatcacatgcttcatatgccttcaacagctattatcagcaaaatggagctaacgatgtagcttgtgactttggcggtactggagtgcggacaactaaagatccaagtaagttgccaccattcgt

SEQ ID NO: 60016 - DNA, 913 bp, Oryza sativa
agtatgtaactgtaataacatgcttgttgtcaatttgagttgtccgttatatttttctggttcgctgttctcttgtgcattgctttgtcttgcattatctcttgggagtttgctaagtgttgataagtattgttgatttggcatgtatggtattcatgctctgctctatttcactagttaatagtattctcaatgttccaactctgttgatcttgtggtgagaacactaataatgttcgtaggaaattcctagcccttgtgcatggatcagcacatgcttttgtaaatcatggatatcaaaatttgatgatggatattgtgtattaatatgggttaccgatgggtaggttgctggtccttagaccttagtccttcaaaatgctatgtggaagtggaacaaccttcaagaccaaactaaaattataaagatattgatggttacatccatgccaattattgttacaatggagattttgcatacgctcgattgtttagtactactagaatataagatgaaggtatattgaaatgtgatgatgaattgttttgcttgcgtgcaggttatgacacttgtgtttatatggctgccgggtatggaaaagctttctcatatctttgttcaatttttttgaagcattttttcaccaactcctttgagaaatagttctgctgactattgttttttcctcccttgaaggagtaagatgagcacaacaaattcatccaaccttccagttcaaagtgggttcagcccatcgcgattcgacaaaaacttctacctgttgttctccatgctacccattatgattgctgcatgcattgtgtgatatgttcggagagagatcttgcagaagccttttgccatggaggatggaacggtaatcgcctgatactggaaaccagtactggtttg

SEQ ID NO: 60017 - DNA, 1412 bp, Oryza sativa
ctgcagccctgtgtacaccgcgcagattgcagagcattcaattgtagaatgattaaaaaaggtcttgaataacggacagattgaaggaagaaaaataagtatataaaattatgaaatgtctcggaaaaatgagaataagaaagacaacctcatagagaaggtacttcatccgatcacttatcagccggctttcatctctcaatgcagttcttatagccggatgcatccagtgagcactattcagccatgcgtcaactgagggatggcctgcagtgacatggcaccaccatgtaggtcctaccggacgctgccagtatggagctgcaacatcagctacagtgtaatcatcctcactgtcggtcatctccgccggctcactatcccagctggcatctgactgaaccctctggaccagttcagcaatcctagaccatccgataggcacccatttgtgatccaggattgccctgacatgcaccggcctatctttgaacagagaaggatcattagcaaactctgtctggcggggattctccaccacatcgcactcttctggtttcatggttgcgacatgatgcccgttcctacttatgtgccgcttcatatgcatagggacctctttctcctgcatgctatcaatcgtcggccatgatttgtgctgaaccagcttcttgtgaccctttatgagctcaaaagcacagatgagcccgtcggtccagagctcgcttcctggcacatgctctttccccaaactcaccttggcaaccccgtcttgtgccctggacacaccactgacctgatgaggctgttggccctccacatcagccatgtccgctccaattctgtatgttggagagagatgcacattcatcaggaaattatgtcatgtaaatactgatttctagtacaattaaagtgtatagagcaatcagttgagaaattgggccaaaagatcaaacaactcccattgggatggtttaacaaatatacttgctgcatgagaaaatgatgcagtataataacactacttccccatcccaaaatatagcaacccaatactgaattagacacacccagtactacaaatatgaacaggcgaaccgcggatgtgtgtaattcagtatactaggctcctatattttgggacggagggattactaattactggagcattacaccacagttgtaccataggggaacacgagaatcatagcgacgaggcggaggatgtgattttcatccctcaaggggacatcccctcgttgtttgcatgtcatctagatagttatcaaaaaaattgaaaaaaaatgacaacatagattaatataaaatgtatcactccacaaacatgcaagaccaaattcaacttctacaagttgcaacaaaagaacaaattaaactgagggctgcag

SEQ ID NO: 60018 - DNA, 12066 bp, Oryza sativa
  unsure (1)..(12066): unsure at all n locations
tacaagtacaaactagaaactactactgctacaagtccggatgcaagtatacaagtactacaacacaagcatttgggaattggaaaaggtagggcaaaagccacaccgtgtccggagcccagatcgcggcacgacacccgcaggcagcgccgccaccggccaccaagtcccgctcccgccaaaaacccgccgcgcgccactgagctttccccgcgggccccacgcgcagagccaacctagcactcccgcggggaagacgttttagcctggagccctggaggtggaggaggaagagagggagaaagagaagaagagtgggcgaggggagcgcgccggagactgtggaagtgtggaggaaggaggaatcgtgggggagcggagcgggcgcttcaagacgggaagggaaggggatgcaaaggcaaatgctcgctttgcttctcgcggtcggtcacctcgctttgcaaatgtctcagcctctctaccccatgcgccggcacacgtactcctcgctgagctttggatactagtactccagtagatacgctgtgcggtgtacatgaaacgtgtaccacgtcctcgtaaaccgccaggagtttgacatagggatatgtgtttttttttccatttttgaattagccctttttcacacaggccgtatttaattcgtgtaccaaatttttattctttttaaagtactccctccatactcataaaagaagtcgtttagaacagcgacacggtctccaaaacataatttgacttcttgtttctataaaaatatttattgaaaagtgatatatgtatatttttatgaaagtatttttcaagacaaatctattcatataatttttacattttcaaactcaacaactttagagttattcatgatttatattcccaaggtttgacttaaacattaccctaaacgacttcctttacgagtacggggggagtatacagacacacatttaaagtattaaacgtaaactaataacaaaataaattacagattccgcctgtaaactgcgagacgaatttattaaatataattaatccgtcgttaacaaatgtttactgtagcatcacattattaaatcatagcgtaattaggctcaaaagattcgtctcgcaatttacatgcaaactgtgcatttgattttttttccgtccacatttaatactccatgcatatgtccaaacatttgatgtgacgggatttttagaagtttgaaaggaactaaacactgcaacaatttccccaaaaagttttaaagctggataatatttttagcttcataaatttatgaatctagatatacgattgctttaataatattttaataaattattttgtttctattttagaaaaaaaatattaaatattaaattactataactttaacatacaaacttcaaatctactgatataaagttgtgccaaacagagttagcaagacgagaatcaaacaaaaccgaattgagtttatactttgaatggggaaaaatgcacctgcaaggtttttttgttgttacaaacattttacaacaagaagtttgtaagaaaagaaaatttaagcatgcatagcactgctgtattttatttttgctacgtgtaccattttccggtgggataatggcatgcgtatacgtgtatttcatgtctaatgaagaaaacaagtttggatgaataaacagtagctctgcgtctatggagaaaatactatttttgagaaaattgggattatactatcgcaaaagagtggtttcgctggaatactatccctcttgattcattaaaatgctattctaaactagaggtgttcaccaaaattctattttcgctcttttgggtaaatagaaatgcttttactccaagtttaacttttttccggaccaaaatacccctgatacgggcccacctatcatactctctccactctctcctcctcttcctctctctcgagggagcgccggccactgctctcctccggccaccggcgctccgcttccactgccatcggccaccggccgttgctctcccccttcccgctcgccgccctccgcccgccccgcccagccgcctccttcgctccgccgcggagcgccgccgccaccatagccgtgcgtgcggccgcgacgtccaactccccggcggccgcgtccccgaagaagagggcggcgagggtggggcaggcgtggcggcgcggggccagcgagggtggggcgggactaaccctgtcattggcgacgacgaatgcaccgtcgattgctcctcggtggcggcgatgcggcgcgaaaaggtagggatttggaccccccncccgtgcgcatggctacggtgccgccggcgccccgcggtggagcgggtggagggcggcgagcaaggaggaggagagggccgcgccggcagctgttgcagatgactggggcggcagcggcacgagcagaaagggggaggagcacgtgggggagcgtcgggggccggcgccggagccagagacgatgcggagggcagcggcacgagcagactaatgcggcgacgcaaacagaaaagggagagggaaggggaggagcaggtgagggaagggtattttggtcacaagaaaactaaaatagagcaaaatcatttctattaacaaaaagaccaaaaatagtattttggtgaacacccctcagtttaggatagcattttaatgaatcactttgaagggatagcattccagcgaaaccatccgtttgcgatagaaaaatcacattttctcgcgtcgtatgcccctcttgcaattctgtgcggaggcagatatacacctcctttaagtaaagttgcagtatgaccttgctgcatactactacagaacaaaagctatttacatattggtgttgatgtattcagagcattgtcaaggcaaatcatgattagagacgcctaaatcagcgaatataggggggcgacttcgataaatcctccactgaaggcagcactgcagcagaagccattctacatgcttacggctgctctccagagtggttcaaacttgtaccgacgctcgaggtagagcttatcatttcagcactcagctctcagctcaaccgagagatcattgtacaaaaccccaagcatccattatggtccaagtctgtaactagttgttcatctgttcatctcacactgcaaagataagagctggaaaagttaacgcggacagtaatgctcatcagtaggtccaaacccatcaacaagcaggcaaaaagaggcgccttatgggatggggacatacaatctagaatctacacctggtggagaatcatataccggggccaccatttcatcgtaagtggagggcctactcagttgtgtagacagtagcccccagtattgtgaagttaaagtgtgcgtgcccaatgcccatgtcttactcccactagagaagacctctatgatttattgattaacattgtcaattttgtgaaactaataactggtattaaccaatcaaagtggcaaaggaaggtatttctctttggaccatgttcatcaatccatcagtaagtcaagcagctagattcttatctattgctgcaagcaccaagaagctaagtacagtcagccaaccaagattgttcatcgttgcaacaagtacccaagcattattagttttccatccgtcttttctatttattatcacaaggaaaatgactcattgcagatcaagaattttcaacagtaagaacagaacatgcaagtgtaaaaatttcttacagctgactgaggagcttcagaataaaccacatcattcagcttaattctttgcttcggcaacgtgaaaggtactcggtggcttcattgaaatctgtcacaacaggaaattcagtgttaactgcattatatacatgagtggaacaaaagaaaatgggtgaatgtgagttgcaccaggaatgcggcggtagtctggttctatgccatttccatttatgtctttgtgatttggtgtcacatacttgcccactgtgacgacaatgccagaaccgtcatgaagttcaaatacggactggattaagccctgccgcatccaaggcatagtataagccagttggtcacagagagtgcttttccttggatatgctgtgtttttttttaacaaacctttccaaaagttttttcaccgaccagaacagctttgcagttgtcatgaagtgctgaagcaacctagaaaagcgttagtgcattggtgagctcatgctgatactattctaatactaccagtaaagttaaattggtacttactatttcactggcacttgctgtcctgttattcacaagtacctatgaagaagttgtgaatggatatgtgagatacaatgagcatgtggagatcttattatagcagacaaaagagagaagcatgattcagctaaaatttcagtaaagggtacgtatatgattaactggatctgtatcattccacttctaaatcagccgatcaaaaaagtgcaaataaaaaactatgggcatgaataaatcataaaacaccctacagcttgatgattctcactgtcaaagttagaataggaaagccagaattctgtatgtgcaacttaataggtgtctgtatatgtgtaatttgtcggtcttcgctttctgttgcatgtaacagtgtaaaattagttgaattggctagataggttcatgtacatcacaatagcatacataccataagaggagtagtaaccaaaggttccctttcagcaacaattgtattttgtacttgacgatcacgaccagcagtataaatcacctgaagaagttccataggggcataaatactacatctcagttcttctttaagaaaagtacacctccaaagttcagttcacgatataaaggataattaacaacagtttagtcaatcatatgcctggctgaaagccctcaaactttttaatatgcacaggacaagtatatgaatttcaacgaagattctatccaaatgcatatcaagaattgtaactacaagctcttaatttataattccaaacccatgtctaacataaaaaataactgttttcgagaaaacataaaaaaaactagcatggcttgatttttccaagttcaaacctaaactagaaccattttagccaggaagtaccttcattttgatgtagtatccatgaacagtaacttttagctgaggtgggcacaaaaaggttgatggattttaaaagaagttatgtagaaaaaaaaggttgggttaacttctatggacagatttttcaggtaacagatattgtgctagaagttgacaaaatatggaagcaagtaaaaaattaccgtgtctcctttattcaggaagagctttgcagtctctatcccagcctttaaagtaaacaaaagtaccatgagtaagaataaccccatccaaataaattatatcagtgtctttcattatccaaatgcataagcctcaactgtttcaagaagcttacaactcaagaacttcaaaggaaaagaatggcacccacaaacacaattttgtttagcagaccaaagactgacatggttatataattgaaatgaaaaaagcatacttggactagtccaccaagattgtccctcaaatccaaaacaaaataggaggcacctgagttctgtagacgctttagtgctgcacaagagaacatatgttagtggatataacatgccaccatccaatgtaattatattaagttatatctaccgataataattttaatggaatatcaacaaataatatcggaaaattttgtaacatcaaaatagtttcatacagaatcagcagaaataacatccttagatggccaatttgcagaagggaaaacgatattttaagttctgaaatagcatcgttagatggccaatttgcagaaggggaaacaatattttaagttgtgctcctgatgctcacagtttgagccaggaaaatagttatatgtacatgcatagcagttttggcttaagaattagatactacatggccatttgcaataagttctatgcacggaacggttcagctatgaaagcaatgcagctaagtgcagctaaaaaatgaaagttgataaggttaacaaaccagcaacacaccactaaccaaatcttttttggccactgcattgaattctttaatgtgaatatatcctatagctgaatcctcattttctcttttctccaatcgatagaaaactggtgtgcgagcaaccagttgtctctgtaccttcaatggctcaacaggaccacagttcccatgcttaacctatacaatatacaagcaatattgagatagttataataaggagcgcaaagaagttctgggcaaaagacaagtatgatgtttataagattattcataaccttaattgtaacaaaagtatcttttggaccttgcaacatggatgacacatcaaatgcagatttacccataacatcaatgccattgactgacaaaagttcgtcaccctaataagagataaaaagacaggacaggaaagataagtatgtgcatattatccaaaaaccagctaaataagactacagtatttcatacaaaaaaaatgacaaacaacagttctctgtgataagaatactatcaacaggaattacataaaacataaaaataattaaatagtcaatcaaaccaatgttatgattgaaaagcatgcctactaattgaaaagtatatatgttgagttgttgatacctgtctaacaccagcagagtgggcaggcccatctaatatgagccctaataccatcaacttggaagagccattgccgtcaggaatttctctcaagtttaatcctattcccgtcatgtcatattttgacatcttggagaacttcaccagattgatttaacacatgcaaaatatcatcagaactgaagtacagttagaagatatagcatatcttcatgcaaaatcagcaataagtaaaatcagtgaaacaaaggaaatgcgtcaaaaaatggttttgtaatatcatcatttcatcattgtggagcgttgagttttctggtgtctaaactcttgacacaaattcgctattccctaagtgtaaaagtcacgcaaaacaatagttggcagtaaaggtccaagtcacagggatcccaaaaactttttgatggtcaatatatagtcatttgcacacgattctgacttgccaattaaaaaaataatggtgtcatgagcattggcccgagaggccgaggccatggtcaacccagattctaaaaacaggttcatgccaactttagcactaaattcagaaacaacaatgtcagaatagctaattgctacaaaaaccatggatcactaggagaaacaaggaatggcatttagtggacccaccgactataagtaggctaaacatgttgggaaatgtaaattattcaggctcatactctctcctctctttctctctttaaaaaaaacaagttgtacagttctactcgtgtaataggatgatgttttctccaatatgctgagcttccatttgtcattctccaaaaaaagaacagtgccatttgtaaggtacttacttctgagggagtcaggaaccttgtgtatgggtcacccaggttagccagcattttctgaatgatatcatgggctctggaacgggatctgattgaggtttggacaatatcttgcttctttttctgcattgcattgaagcgaagcaattagccaattagcatattcaagatataacgtttccctgagataaatctatggaggataaaatatgttcagaagactggccattccgactagaaatccattaatgtacaaagagacttccatataggcaattgaaccacttcatagttcatattcaatcatttgttaagtgctcaccatccacatctccggcgaccagggacggcttccggcgtccgggaggaacccctcgttgaccacctcccacgcctcctccacgagctgctcgttcgtcaccacttcgctcctcctcacctcctccttggtctcggcggcggccccgtcgcggcagagctcggggccccgcggccgctccgcccccacggcgtcgccggtgaggagggagagggagatggacatggcggccgccgtggccgcggcagcggcgcggagggcgtcggggaaggggagcgcgcacggcggccctggcttggtcctgcgggtggcgagcgagcgctgcggcggccgcggcgacggcgcgtaggggagtagccgcatggcggcgtggcggcggggcggcgggcgtgggagccgcttcggattagtggtgggagttcggagtggatggggtagagggggatggcccggctgtgcaacacactgtcagagattttagctcgtggagatttcataggatttttcttacgggaaacaatcatttttctcacaaatttcatgaaatttctctatttcaaaggaggcctgttgatgaaaaaatcgaacacaccggcctgggagatctgcttagctccagtgcaggtccaaatatgatgagatgtgggtgtgccagtcagtttgatcctgcaattgacaagatatgcaaatagtagatcaaaacagccgatcggctgacaacctgatggagtagttccggccggtagccaataatagccgatgccgataccagccgatagcaatagggtttaagcaatcggctatatgtccaatgtagataatgatataaaggtaatcggttgatgatgatgtaacaaaataacaatataatccagtataaaccaatcggctagcaatgatatagtagaacaagtattgatccgaaggttaaagcacacatcggctggaggtccgatgtcataagatccacaagattagattaaacagtgaaacctttgttgccatcggctaaatccaacttatatgtatatgcaatccctacaagccgatgcaacgtccagataacttatcggctagcaccccgataaaatattagcatgaacctatcggcttaacaagacttatattatcaacaacaatctagtagatcgaacctaaccgatgcagcacgagattgtatatgataatctaatactcgatgagccgatagatctgtctaatgtgatggatataacaaatctatttagaacagcattatgattgtagagatatatcggctaagacaggagatcatacctaaccgagaccgtcccaactaaaccgatgcgtctctaaacacaatgcaattagagatagaattgagatatcaggtaggcaaatatatcaaccaaaccagagcgatccaagagatcgaatcaatgcagccttgaacaacaccaacgtagccgacagattcaccagggcccgacagaacgtaggacttaccccttcgccggagatcgaactgaacagatgcagccccgcgtcaggtgcccaaatcccgccggaagataagtaaaaacctcgggaaagagggtggcgatgcgccgagagtattattgatcgagagtgatagattacatagaccctgggtgtacatatttatacccatgggttgataaaagtccttgtcagacaagaaagaaactaacctaaagataaaagtaaaatataaagtccttatcggacactaaacacactttcctaaagataaaaggaaactaacaaactattcctaattaatagataaactgccatgccgcatcctctttaaactcggtcacttagggataagcttcctttagtatattgatttccttaaccgaatatagaaggaatccgactattggcgacttgataactcccatcggctgattccgagatgctacagccgataatgattctaagccgatgacgtctttgccgattaccaaatttcactgttaacaaggccttaaagactaaatgtattaacaaaaaataaatatgataataatgaaggtgtaaaacaatggattgtaaaaattaaaaaaatagattttcaatagatcaagggttaatttgatccatgccattgcaaatgtggatattaaaaaatgtcattacaattgtatattcataactgtgccactccaattttacgaaattagaaccatgtcgttgctgtcaccttttccatccatcatcttcctttccgtcttcttccttccttttccatcttcttcctagagtcgtgctaggccagcccgcccgccgtcgctctctggcggcagcgtcgtctcccggagccaagtcggtgagctcggaggagagggagccaagccggcgccaccatcccctccctcagcgctgccgccccctccttccatgcgttggagcccgcgccgtccctctctccgcacgtcggcgcggacgccgccgcagttgaagctatcgcgtcgtctcctccctcctcacatcggcaccaataccgtgcgcatgccggcggcgcctgtgccgtcccctttctctgcgctgccgccccatccttcctctgagcaccgctcgccaacgtcgccgccccatacccctgcgtggccgcgccacggctccttccgcgtgccgagtcggcaccgccgcccggcttcctcggcgcccttgctccttccacgcgttgtcccctccctccacgcggaggaagtcgttggtctggccctccccaatctccaccgtgtcgacgtcggcgagcgccgcggggtcctcgagcacggcgtggaggcggcggagtcacgtggtgtcgttcttgccgaagagcgtggctggttggcgcaacacgtgcaggcaccggatgacctccttggagaagagcggcgtgtccttctcctcctcgtcgccgtggtgttcggcccacgactcatcgccgtcggaagcccttggcgtggagcgcgacgtggcgcggtggtgggaggaccagagctgcttttgttggaggtggtggtgctcagtttcccggatccgcctcgtggcggcgtggtgctcgatctcggctcagcgacatgcgatggccgcgaagaagatggagaaggaaggaagaagacggaaagaaagaggatggatggaaaaggtgacggcaatggcatggttctaatttcgtaaaattagagtggcacggttacgaatagacgaattgtaatgatatttttctgaatagccacatttgcaatggtatggatcaaattaatccatagatcaaagaaaaaaacacactttgatgagaaacaaaaacacaaatagaattaaggtttgataggatttaaagatgatcgatctttttccataaggaaccactaaaaaaatctagtatgcattcgaattcttaaaaaaaacacaatccctttttccatgagagttataaactgttatacttcgacttcaaactataattcatttgtactaggatgtgccccatcttagtactaggttgttttttttgacggagggattaccattttaaaccacaccattatttggtgaagttaacagatgtatggtagtatttagtttgttaccaaatatttgttgtgtttagagaattgatatcatcgtagttaaacctatcatgccaaaacttagtaacgttgccaacttgctaaaattttaaataatgccaaattttcgaaaggttaaacatggccatgaagtgaacaagactagagtttcgtacgagccctaagacacgcttttcggcgacctggtgcaaacacaaagttacaaatgcatgactccattcaacatattttaaaccgtattgcacatatatattttacaagacactaaaatacgtttctacctaaatctatgcatattaattttgttatagaataagcatttgggatgttgttgatggttaaacgtcaaatgctacctaagacatgttgtcaaataattattgctgtggagttatttatataggtaactcgtttggcacaatatatagaccatcaccccaaatgttcattttataattccaactagacgtgtaattccaaaaagaaaatggaaaacaatcacggtgtttaccctcacgtttccctctctgtggtatcaattcgtgttattttacatgccatcaagcacatcttttgaaactttatcatttttt

SEQ ID NO: 60019 - DNA, 731 bp, Oryza sativa
aaaaaaaaaaaaaaaccaaaaacgcatcgtcactttcatcaccaccggccccgtggccccacgcgtcaggtccgctcaggataactccgaggccacgccagtcgcagggttcgctgacacgtggggcccaccgaataattgcccccacatgctagcctcggggcggaagtcttccgtctctgtccgcgcgagccctcgcctccccgagcagacaatcccgtgcgcgcctatagttacaccggaagatcctacccacgagcgaaccacatactgcaggtgggcccagatggtggtgtccccaccatgtcagcgagagaggtttctgtgcgcgtttgagatcccacaccgccgcgacaagtgtacacggggatggatagagaggagagaagaagaagcttaaggctgagttcggatgggggagacggggaacctaactctaactcctgtgcacggaaaacggagtggtccattaacacgtgattaattaagtattagctaatttttttttcaaaaatggattaatttgattttttaagcaactttcatatagaaactttttgtaaaaaacacaccgtttaatagtttgaaaagcgtgcgcgcggaaaacgaaggagaggggatgggaaaaggtgcatgcgaacacagcctaagcgcggacaaaaaaaattgggaaattgattttttaataataatataataatactaataataatcgcatcgcagccgcatcg

SEQ ID NO: 60020 - DNA, 10652 bp, Oryza sativa
acagcattggtaaaatttagaaagaacagagaaactcccggtacaaattcaagaaaagcttatcaagttaaagatacctcaactcacgcattctaaccgaagcaagtacataaatctcgtcagaaatcaatcgcttcatctgcgcgaactacttttggactgtagctttcttgcttaagaggccttctaagttgaggttattgatcttcgcagcaaggatgaaatcattgtcagttaagcctcctgcaaccatagcagtggaatcacatcattataaactagagtgatggactgatggtgatttctgttctgttactgtgcttatgttgcttcagtacggcttcctaaatcctaacccaattctcaacaaccaaatactgtgattatgtgccttcagctacagttgctatgtctggtccctatttcttgacttatctccttttaagcatacaaatattttacatggaaaaggcaaatcaccaacagactaaacatccaaggctccaagcatgtaaccttttttccataatccatagaaattcggttaggtttcaactaatagagggcaagaatttctcaaataaacatctgaattttgatattgtccaaataaagagcataaattatgccattatggccatcttgtttttcttgcaaagtgaaaacttagtcaagtcaatcagagttcctaaaatagtgtattgactaatagccatcattcattaaggtttaggaaagagccattttgacctttcagtcctagagattgaaaaggttaaacaaagttaaacaggaacaacagtgatccctttatttcattcagcagcattggcttcaacattcactgctaaatgtaatgagtcaagtgttttcaggtttggaaggaactttgactaaagaacaaaccaaaatactgagagatatgaggtttgattcttttaaatgatcacatcaaaacaaattggcaaaacgaatgatatgcaaatcacttactgacagagtgagtccaaacatcaattttcacattgttccaaccgacaagatgaagatcagggtggtggcctgcgaaaggacatcaaacatacttcactggcactgttatttaaaacaaaaatgagatccaaaaaatgtgaacagtttagaagtgtttttcatgcaacatgtaaataaactcccagcatactaaatataattgtagcatgctatgacaacaaatgtaatgcataggtagaaaaatgtgagaaaactaataatttgattctgatcaccatgactacactatatcaaatgtaatgcaatctttctattcttcatcaatagccataacaattataagatattttcccaagttcaacaggagctagcttactagctctcctctctatcttatctcatccagacaataagcgtagaattacatgcagccacgaagtactgcatatgaaatagtactagcttgcagtagctccacttggaacacttgctctgcatcatattgtttaacctttttatggtacgtttggtgtctcaaaagaggtatgtaaaactgtgaacctccaaatcaactagtactgtaagagaagttagctaatcattgctgacttaatttaactaaggaaacatgtggtggaaatagaccatatagattatgccagtatgtataaaaagaaacaaaagaacaggaaaccttcttcctcagcaacagcagcaacaagctgaaggaattcaagcccttttacaaaattcttcaccttccatgctctgtgcaatttcagaatgtcaccttcggttgctaattcccaaccacccacctgttttcaagagtcagttgatgaagtgccaataaccttaatcagactcttgactacaaaatcatacaagaataaaacctgttctagcatcttcttagcagaatcttctggcatggcatgtatatccttagaattgcatggaacacaaatcttctttgccagctctgaaataataggagaagcagatctgtgagattatacagtaaatgacagtatggattaacaaggcaagagaaagtcaagaacagaagaatggggatcgatattgctactggagaaccacaatatggtgatgggagtatcacagctcctgtactgcatgctatcaagacatcactattccctcaaataagatgataagaatagtattctgaatatcattcaaaaagctagaggagcaaaccaggggttcctgaatcctgactagtgactacatggttaagatatcctttatttggttattcctagttctttttatccttcttacttaggtggattgctttctttctacctgttgctgtccatttcttttacattataaaaaaaatcaaataagaacaacatgttcatatatttgaatacccagctaaaattttaaaagattggctcatgccattgcacccgtagcaaagttttgcaaaatatcaacagaaaggtcgaatgtaaagtattactgcaaacgcataaattctggagaatagaatcgacatcacgttttccattcaccaaatctgccggtgtccgtttaaatgagagaagttttttcctcctggccttctttcaccccaactacgggtatgggcagacgattcatacgattgcagcaagatggtgttgacagagcacccacggccacggcatcaagcaagacattagagcgccgccgatgacaactcaagcaggaggggaggagaaggacaccatggacacatggccgcggtctggtgcgcgacgacgacccgtacgcatggtgcgacgggaagagattagaggacgggggggaggggggggggaacaattaaaggcggtcgaaagatgacctggatcgccgatcgcagccgtagacgacgacatcccgacgacggcgcggctcagacgatctttctctgcctggtgcggtgccaccgctcgagggctcgggctcgactcctccgccgcggcgcaactcacagcgccgttgtccgccggttccgcctacctcgtcaagctcctcggctgcgtgatgccagagacaggaatgggcgaatggctagtgtagattgtagaagagtttgtgctttgtagatggaatgagtgaatgacaggtagtacagagtttaacaagaaaaggcaaagaagaagaacagagtgagaatgaaatgtaacggatacgcaatcttccaaaaatgccctacttttgtgataatagtatgtttccatttatgcacgttagctgcattactactccatgcctcaaacatgtaatagtttccatttaaaaaacaaccagttgagatgaaactctaggtgtgaattgtacgtgggtgcactaatacatggacagatgaaccggatgagttcaaatgaatatcctcaaacatttctaagaaactttcaggaggctggtgtcttacaagactaccttgattgtcaggagaaccatggcaccatcttctacttgacattttaatctcgtcttgacttgcatacatcggatgatgagaactgcatcatagacaatggtatttctccactcagttatccatgagaccatcagctaaagctcactatagcataaaggccataagcccatacaagacgtcatacgatctcatttatcaacggaacttgtatcgaacccagaatttgagtgttttttggtcattagccatgatttaaatggagttctacactgtgtcctctatgactgttcccaacaggaaacttgcccggacaaaaggtttgcaagttccaattataaaaatgaacaaaggaatcgtcttcctattaaatgcatatgcttgcatatacttgtaccaaaatgccacgaaaatttatcagaagcttcctttcagaaaaaaaaaaactgtttccaaaagcatatcaaccatgttgtaatgcttccaaaccaaaattaaaagtgcatgaccgctacagcaacaatagaattcgccgtacacctaacaggctagagaactcttatttttcatgttaaacaacagtacttgatccttacttccgtgcatctttcaagttttttatggtgttctcatatacatccttattggtagtatatattaggcaaagatgtgcagaaatactctgattctgaaactacaacactaagtgatctgaaacatatgctaaaatcgaaccacatagcatattaatctgtcatgcaccagataattagtgatcatgtgtgcccaaaggatctgcaattaacgatataattccagattaacatgcataaccacctctcccacccctttcaaaaacaacagcacgttcaacaatccagaccccgacaaacccacccacggtataaaatttcgagcacgattcaagaaagaggttactcgtaccgtccatggcccagcagcggaaggttcttggatacggtaggccaactgggggccgccatcgcctgcacaggcaacagaaaagaggcgggttagtggcgcacgggaggtgttcgacggtatgcttacacggcgttggtggggggctgggcggtgagttcttcgtccccgcgtttggcatacgtagtagcgcgccaggaggagcctcgcgtgcgccatagcgacgccgcgggtcatcggcgacggtgggacggcggcggcgctcgccgtgggcttgcgacgcggttgggggaagaagagcggaggcggcgggaaggcggcgtgtgggtttgcctggcgtgtggtagcgcgtgtacccgctgtttacaaatagtactactagtagccttcgaggcttcgacgggtcactgacaggtggtcccaaaattgtcctgaagttattttctctaacagattatttttgacaacttctacacgctcgtgtatttgcattttgatatttttgactcagcttattagctacttcatctgtcttatattgtaagatattttaatttttttctaagtcaaaattttttaagtttgatcaaatttatagaaaagtatagtaatattttttaacacaagacaaacattctatgaaaatatattcaatgttggatttaataaaattaattagttttttaagtattgctatatattttttataaatttgatcaaatataaagaagtttgacttataaaaaaataaaaaaagttaaagcgtcctataatataaaacgaaagaagtagcttatataaaaaaggaaaaaatccaaatgctcccctaaactgtagagtctgtctagcaccttaaactttaaaatcggacatccagccccctaaactttgtaaaaccgttcatattaccctctaaggtggttttgtatggtggtttttatctaatttgtatataaatttaatgagtttgatcacgtgacatacacattgaacatatatattaaaatctttagttaaatttttatttgtactactttttagctctcacttacggacaactatcgacataataatagtatggtatcattgtataaatataaattgatgatttacaactgtttatatgcaaatatgttatataagttatttaatgttgttcgtttaagcatccaaaatatgcaaaaccaccttaggaggtaatatgaacaattttccaaagttcagggggttaaatgtttggttttaaagttcaaggtgctagatggacttttatccaaagtttacggggggtatttagactttttcctataaaaaatcgatacgcttggtcatcgcccattattacccttggtgatacacaggctaaaatgggagtgacacttaatcgtttcatgttgatatgataatattttagaactatttacttcctccgtttcatattataagactttctagcattgcccatattcatatatatgctaataaatctagacatatatgtgtgcctagaatcattaacatctatatgaatgtgggcaatgctagaaagtcttataacctgaagtggaggtagtatttatttattcaatcaggttggcttttaatatgtatctatcaaaatatcgtgctagtaatgtgaatatagccaacgaactttcaactctggaataaaaaaatagcattattcactttggcttttatatgtaaggaagtttaccgcccatcaaatctactcttgactccttgtttgtttatatttaggtcccttattggctcaaactttgtgggggtttgacacttttaagttgaatacataaatcaattcaacccaaaaatttaaaccaataaaaaaagcagggcaattcgcttacacttacattaaggcacgtgttcttaccccatgtttcccaactcattcccatcgttttctgtgtgcacatttttcaaactgctaaacaatgtgttttttacaaaaaaaaaaagtttctatacgaaagttgcttaaaaaatcttattgatctattttttaaaaaataattatctaatacttaattaatcacgtgctaatggactgttccgttttccgtgcgcgctgttctggttgggaacaggctcgtgcgaacacatcctaagtttctaatgaacattacccgcatactcaattttcctgctcaatatccacatcaatttaatgctttgtctacgctctaagctaatactacctccgtcctaaaatgtagctacctagtatagaatgtgatattacctagtactacgaatcgagacagcctagtacattccaaattagtagtaataggtaatgtcacatcctgtactaggtagctatattttgggacggaggaagtagtgattataacacaaagctattgaaacatttgataggagaaatgcctaccagagttgaaagtaacacatgaacaagtactaaccaactagccttgcgagttgtagttcttagcttgcctagaactttgtgtgatcatagcaacacgccaacaaccattcctgactctgagctcacatggtaggcaacatatcctatgcacacaagccctcacgtgtacacacgtgcacaccaactaaaaaatgtcaccaaaaaatctagaaaaaatcatacatatactttcaattgtattacacctagggttaaaatcttaacgtcaaattcattatattttagccgtaacaaaaaaaaacaaaaaatctaacagttttaaggttacaattttgtcataattttatcttttttgttattctctatgtagaatgaatttgaagatgcgattttgcacgtagatgtaatactattgaaagtacatgtataaatttttctagaattttttgtgataatttttagttggtgtacacggtgtgtacacgtgagggcctgtgtgcataggatacgctccccacatggtaatgtcacactattttccttgtggaaacaccaagcgacgaagatgaccacaaggcgtgaccatttttttctaaaaagaagcctgaaaatgtggatgtagctcactgcattttttcttcgtttcgtcttgatattccgattagatcaggatttcacgtaatcacagttattttcttcgcaacaacaagaatgatgatggcatgacgaaaatgctagcggagttttgtaccttttctaccatgaattgagcatttctccaccccatttttatgtcatgccttgcgacctgtaggaaccgtatggcacacacgagcaaaagacttttaaaaaatccatctactccttttgtcattattgtcctctaatttcgttttgcactcgctttccaccgctacgctaccgcaaaagtaaaccaagccaaactgatcaagcccaggcatgcaatccggcgtgacatttttccaggtgcattctcgcgtgagcttagcaaagaaatatctcgtggcacctgtcacccctccgctgccgatccgacggctcgtacgacgccgttggtaggatcggacggcaaggggtggctccagagtccgctgcttccgctataaattggccccaagtgggggctccacgctacagagcagcagtctcgtctggagaagtggactagtggagtgtcgtgagttcttcgcttttgcttggctaaaatcgccgttagaaacttgtggaatcgagcaggtttaagaatttttctagtatccactctagatttgctttgttgtatgcttgaatcaaatttttttcgcttgatgatcaatttgagccaaaaacatgccgtttttctggtgattttttttctagcaactgctttgaaatttgtttcctgtttttttttctcaccaaagcaaatttgtaccaaatctcaccgaaattggcgatttagttgggcagttgatgccattgtttgtcgtcgaactatgcaatcccgatcgatttcgtgttcgtcgtctcgcctcctcgtgatccttctctccaccatgtgcagctcgccgcgcagccatgggtacgcgacgcgtagggctcctcctcctcctcctcctcgccgccgtactgctccagcccctcctcgcggcggcggcggcggagggcgtggtccgcatcgcgctgaagaagcggcaggtcgacgagaccggccgcgtcgggggccacctcgccggggaggatgcccagcggctcctcgcgcgcgccacggcttcctcaccaacgacgccgccagggccgcctcgaggaaggcgagggctgaggccgagggcgacatcgtggcgctgaagaactacctcaacgcgcagtactacggcgagatcgccatcggcacgccgccgcagatgttcaccgtcatcttcgacaccgggagctccaacctctgggtgccttcctccaagtgccacctctcggtgcgcgccgttctctttggttgccgcggttcaggggttttgttagtggtttggtagtgtttgtggtgctaattggagtgtccctttctgatgtttgctgcagattgcttgctacttccactcgaggtacaaggctggtcagtcgagcacgtataagaagaatggtttgtgctttctaccaatatcttctcagacttataatgttgtgttgcagtgtgatttagtagcaatcagtgttatctctccagttatattgataatctgatcgatcaatactctgttggtggcttggtgcctttcgcctgttcttatatagtagttctgttggctccaagtgagtaactgaattggcatgactaatttaaaatttcaggttgataaagtgcattaacatgaaaacttatttgaagcatatatcaaactagatgttttctgcaatttattaaattacgctgtttcttgtgcaattaatactctctccaaccacaaataggtagcaatttttgcatcaacatgtttgatcttactgctcatatacagtagaaaaaatatcaaatcactagtcagatttatgtgtttatgcccaaatggtacttagtgttggttggatgtttattaaatatgataaaagtatgatactgtgaaattatttttcaagataagtttatgcaacccatttttgtatgttggtatgtccaatataatgaatagagatatcgatagctgaagttatagtggttaattacacatgtcccaaaaacatcatatatttttatttaacttatttttttggagaacatgcaaaagggttgcatgtccttccattagatagagagagttccccaaagcgtgtttggttacagacctggctatataaaccctgggttacagatcataggtttatatcttgcgaaaaggttctaaacttcgatggcccttcatatcaccacggtttcggctcttgtatttttaacaagagggagtaatactgtaataagtttctgcagctatgtaattgtgattagttgataatttttggtttgatggatttatagtcatcttagattgtgacgttgacaccatcctgatatttattctgtggactctacagttacccgatctattctcagataggccattatttgtaccatgatgtcaattctgtgaatccaaaaaccaaaactggagaaattatgtagtgtgaaattgccactatgatacttccagctttttttccactatgttctagcaaaaacaagaacccataacctgtatttacatctttggcaagcaatcaactgagtagcaacatagacgtcatgattataagatgttattcattatgtgcgttaaatctgtatctgttctgatgtgtccttggatttaaactgcaacagggtgttaagttcatgaatataatttatcagttctccttggcaggaaaacctgcttcaattcattatggaacgggtgcaatttctggctattttagtcaggacagtgtgaaagttggtgatgtagctgtgaaaaatcaggtttatcatcagctgtaacttgctttcatcttatattcttatgtgcatccaattcgagaatatcctgattttattgggtaacactgctaggattttattgaagctacgcgggagccaagtattacattcatggttgcaaagttcgatggcattcttgggcttggatttaaggaaatctcggtaggaaatgcagtgcctatctggtgagcaagtcttgctagcatcttgaaaaaaataaatccattgcactcgtatggtaatagtagcatcaacaataaaaatgaacattttactctgtgtgtgacatgtataccttcattctgaacaattttttggaaggaaagagaaaactgagt

SEQ ID NO: 60021 - DNA, 719 bp, Oryza sativa
ggaattgtctacaagggtcgactgatgaatgggactgaagttgccgtgaagaagatccttaacaatgtgtaagtttatattgccttagtgagtttactgtatgttaacttggagctaagatttctttgctgggtttgcagggggcaagcagagaaggatttagagtcgaagttgaagccatcggtcacgttcggcataagaatctggtgcgacttctggggtactgtgtggaagggatacacaggtgatcatttcttcctctctgttccctttgttctgcataattaactttgctgctcagcccagtttatacgaatccaccatgtgcaagttcattgtgatactaagcattatgttcttaaggttcaaaagggaaaatgaattatccatttcataagatggaaattctgttccttcccttgtgcataatcaatatgtgttttccttgttcccttgtttctcactgtacattgaccttttctgaatattcacctgcaggatgcttgtctatgaatatgtcaacaatggaaacctagaacaatggcttcatggggccatgagtgggggcatccttacttgggaaaaccgtatgaagattctccttggcactgcaaaagcgtaagatcacagtctggaccttacttgcagttatttcccatgaaatttacccttctcacataaatacaggttttaaagatcaatactactacatgctaatg

SEQ ID NO: 60022 - DNA, 13437 bp, Oryza sativa
ctagtatgctctcatgacagtgcatggttaaggaataaggaggacataagttctttcggtgcagttaaatactcttttcatcaccaagaggcgatatcgatcaagcccccatctaatccggctacgctaaccttaattaatctcgtctgttgcctgcaactacgggtaattaggccattcgatctcagtcagtcacagtcaagtctttggagaggattgaacgcctatgaaaatatataaaaacgacaattttatgtactacttcgatctgtgaatgacctgataagttagtatcactattttatttgcactcaacaaatgttaggtgttggcaacatagcattgcataattgcgctaactttattccaggctagctacatgcgcacgcctagagttggttacttggttagttgctggcttgctgctcccatcatgatcgtctttaatcatacgaagcaggggacacacttcattaggcgcccctaaatgccattatggccaagggataatcacagttcaggcagaggccccagaatgcaatggccatatctgattatctgtcgccttgttagctaccactagatatatgtgataatactaacttctttgaaacaaaatatcagaataaatatcagtttaagtttgatcggatttataaaaaaaaatcatagtaacatttctaacacgaaacagacattttattataaattattcaatgttaggtttgataaaaattaatttgatattgtaaatgtttttaaatatgtctataaagtctatcaatcataaaaaaaatgtgactagaaaaaaatatttattaaaacgacttataatatgaaatgatgagagtactatttaaaaaagttaattgtatacatgctattacaaatatgccattttagaaaaaaaataccactaccactcatttattcatattcatgccatccaaatacgcacaaaattagaaccataccatcacctgatcgccatcacatttttttattatatagaccaaaatatctctagacatgagacccacatgttagttccatgcatcttctaactccatccttcactcttctttttccttatctctctccacctcgttgagccaaaagcataggtcgacgagagaggcgaatggaaaggcaacaaccagcgcaatgatgaagcgctggttcccatttacccactggcctgagaaggaaggagggaagccaaggccacccccgctcgagctcattgctatgccgccacccgcaccaagctcctccctatggccccacctactcctgacattatggttcttgccaaatctaggttgatgccctccctgtcgccacaagctccgcccgttctcgtcacatcatcgtctttgtggctgccagcgggaggatgaggagccccaagcccgatgttggagatttggcattgcaagacacgtgacccgccgccaccgtcgttgtcgggcactgttgtcatttgctccacaggggagaggggggctagagatgtggggcgacaatgacatcaacgttgttgttgtggctggccagcaggaagggaagggagagagagtataaaaagaaattggggaagaaaatgaaaagtgtgatggtgttcaattttgtacgcatttggatgacatggatacgaatagtagttgtatttttctgaaatggtacatttgtaatggcatggatctaattaatagcccttgaaaaactatctatgccgacctatacttattaggcactttgtataatctcacacgttaattagaaagaaaaatctgaccattgattacaaagaacatacctttttagataatagaaatgtgttatgtctccagcctctgtcatatgacataacatagataataagttatttagctgaaaaaatagtaggtgaatggacaaacccaaactaccctaacaaagaaaatcaactgataaatttaaagaaccacataatgtgattataataagtaagcttataaaaattgcgcctcccatagacagaacatattatcatgataataaattctaatttaacattgtggaccacgttaagaacccatctattaagatttatagtgagttatgttgactcactgttcatgatccgacaaaatccccaggtgaacttggagaaaggaaaatatgtggtgagagctgatttcccgaaatctacagcaatccaacgtgctcctggagcggaaaaccttcgttgggagaggccgaggaatgggtggatgaaactaaatgttgatggctcctttgacatcaactctgagaagggaggtatcggaatgattctcagaaattgcctgggtagtgtgatcttcagttcctgcagatctcttgacagttgcagtggccccttggaagccgaactgcgcgcgtgtgtggaaggtcttcacctagcgctccactggtctcttcttccaatccaagtggaaactgattgcagctttgtgatccagctcttacatcactcagacaaagatcgctcagttctcgctaatatagtttaggaggctaaactactaacggctggggatcagcaaatcgccataagcaaagttcagcgtagtcagaatgttattagtcactttttagcaaacaaagctagagctgagtccctatctagtctttggcttggagaaaattgtacctttatcttgcattttgtctgcgaggactgtgattaatatattctcctttccccgaaaaaaaaaagaacccatctattctacacgttgtgaaaaattgagacttcaaactgaatactccaatttatttattattattattttatatataatatcaatataacaaataaccgtgtaccgacaagtcttgttaattggagatcaataaataaacgtctaaaatatgaaaactatcatcatgcacgacaagctgatcgaccagtaaccaactggccgtttggtatgcgtgtgggcgcgcgcgcggccgcggattgcgggagtaggccacctgctgccgcctgccggccgcggcccgcgtttggcctgcaaattttcgtcgcggcgaccgcgagacaccgagtgaccgacagagcgcgacatggcgcgcacctatgaatcccaggaatccagcagcagctgtttcttttcttcacctgaccgacgtccagctatactgaaactataaaatcaacggccttgattcggcctcagcctcgatctgtattgggcaatgcgttcactgtacggtcgggattgatgtacggggggagcaggctaatcatgccccttgtaggttgttgctgtgtcggcctggttgtttggcgtcgattcttttatagtttgggaattttgggcgtttttttaatatatgttctcgcaagctggaacctgaaagtcgtctggtgtgacgatgcccagctgtatatctgttacttcctccatggtaagttataagattttctagcattgctcatatatatatatatatatatatatatatatatatatatatatatatatatatatatatatatatatatatatatattcatgaatctagacatatatgcatatacgtctaaattcattaacattcatatgaatatgtgtaatactaaaaagttttataacctgaaatagatctagtttttatttctttactagcacaaaaaagaaagactagtagctaggagggtgtatgtgccttcatgcttgctgatgatttgagatcgacggggcagcaataatgtactgtactacactatagtttactcgtctcaaggaaggaaaatgtgcgtcctaacagcttttgcaacttctaaaaaaaacagcttttgcagaggaggatggattcattggaaaaactgactagttatcctgtgggttgtccggtttgatttgcttgatgttgtttagttgtggtcttgaggactttcagggttaggtgggggggcttgcagaatatactaagcttaaacgctcgtcgaggtgagctgttgtcacaatgccaaccaatctcttcacttcacgtgcccttttgttttgcttggacattcctagctcccctcgggtttacttggcctgttggccacatgtttcttttctgtccattgggagaacaaaattgatcttacctgatttatataacccggaaaaagggagaggttcaagcagaaggaaaaaaaaaacaaaaggtccaagcaaaaggcaaaagttcacttaaccaggcctggtccctgatctaagagtcgagttataatcacgtcccttaaccacgaagcctgatataagtatataacatacatatccttccatcttttaaaaccggtgtaaaccaagtccctcggcactagtgagagtccaagcaaaaacgcgagaagaaatcccaaagtccgtatcatgttgcattgcaagtaactacaatatcggatatcttgaaaatccaagtattgaaaccggtgtaatttaccccccccctaacggttttggaaagcggttctattgatgtggtgctttgacccggtccaactggctgactcagcgtgcgggacccacatgtcagtgtcacatttctctcactttccctctctccttttctactaccacaacagcgacgatgtcgagaggccagtcagcccagacagaggtgcgcagatgacacagaagctcgcacccagcgtggcccaagatagaggcagagcagcaacgggatgatcctgacatgtagcagtggtagggccttgaggctcgaggcggagcagcggcgtggcctcgttcggcagataggagaccctgaacgctgttactgcttctgtcatccaaaggcagctgcgacgccgtcgacgatgatggaggtcaccatcgaaacacgggatgtagggtgcagggagctagcagcgtgcttttgtcttccttctttgcccgacggccaacctccaacacccaagccgcccacttcatcggtgcccatcaatcgaggaggcatggagctagcacaggtgctgcgaggaggtgcaacctcgtactccagatccgtggtggctccctccccaatggatccgaccatttatcgctagggtcgagtccgtcctaggcggtgacggagttaggggggcaagcttcgcctcgagcttgtcaaacacctcgttgaagtcgatcaatagcaggtagcggggcagcgtcattgagcggcttttctaggagcgcagcctcgagcttgcctagtggggcggcaccggcgccgccctccaccatgcgacttccatgggagtaggctccatcatgacggtgttgagcggctcccccacctccatccatccctcctcccatcgtcctctccacactgttgtcgactcgctggccgcctcgcactgccgggttagaaagggtagaaaaagagaaaagaaagaggggagaagaaaatgtgacacggacatgtgggtcccacatgctaagtgagctggttggactaggtcaaaacaccacgtcagcgaaaccgttctctaaaactgctgaggaagtcaaattacaccggtttcaatagttgagagagtcatgatatcagtattgtggttaaagaatacgaattagattggagctatattcgagggagacaaagtgaacttatgcctatttcttccgtgttgtttcaggttttcagcccaaagttaagcgaaaaatccggcctcttgtggcgcgtaattacggcccaagatagaacaggtgcaatttttggtccaaaactgctccaaattcctgggtaaaatggcgtgtatttcggcctatagtggcgcgtcacagagggagaaaagacccatcaagaagtgtgcagattcagaatgggccgtataatgggggccaaggcccaagtggggcaaggggttgtttctctcctttcctctcggcggcagcggcggcaatggcggacgacggcgacagcgaccgcgtgaacctggagccttccttctacgacgaggcagcgaccgtggccgaggcggcggcggcggcggagaggctggagcacgagaagcaagagagggagacatgtccgacttcgacctcgacgaggagtccggccttgctccgatgcgcttcaccgacgacaccgcctacaccccaccggcccgagccctccgcttcctgtgcgatatgatcaacgtgctcgccatccgcgtaatcgtcccctcctaccccgattttgattttggttgtgtgatgacgacgacgacgatgatgtgtgtttcccttccccatgagcttctagaccagtggaccaccttgatctgaaatgtgttcctctcttccgccgctccagacaagatgctcaactcatcgcctcagaggtcaccctccctacactagcaagcatcctattccatgaattgcattatgtacaacagatcatcgaacgatcagtacaatttatttcaattgtaggatgaatctttgacattgaccggccctcatcgaggactggtgctatatgacagcgtgtagtttgaggttgacctcaagatgaaggatgatcgtcgaggccacgcggacaaacaacttagtaaaggactgctagtgttggatggcgtacagcctgcaccaaaaattgagcaatatgcagactgcggttcaaacttcaaaagtctcgctcttcctagcagcagcatcaggctctgcaccgtgcacgtcgcctcagaggtcacctgaatcagggaggacatttctgtggagggatcacagctttgcaccagcaccaatgctgaatgcaccatccaagatagcattgtgcttcatgatagcaattttccagcagctggtgtggtggctgccgatggcaatggacattctatcccactattgcgccgtgtgatggctgtttctttggatgagatgctggtatagtgacaattgttgcacaagctggtgatggtgttaactactacagacgaaccattgattttacactagctgtcaatggtggagaggaagctcaaattgtgtgtggtgtcaccagtttgcttgtgaaggttaattggtcgttaatgagcccagttattgacctaaaatagtactttttctccgtttcatattatataatttgtttgacttttttagtcattgaccaaattcatagagaaatttagcaatatctaaaatatcaaattagtttaattaaaaatcgatcattgaatatattttgataatatgaatgattgtagaaggaattggaatgaggccttgaacgtgcaaggataaaattctgaaatattgaatatgtaacactagataacctcacgatttatcaaacatcaattcagaaattagaaaaataaaaattgagagttcaagtatgaatacaatttagaaataactaaaattcagaataaaaaataaatattgaaaaaaaagttcatacataacacaacacgagattaattaaaacaaataataataataatataaattccaaaaatgagagttcgagtaccaatacaatctagaaataaaaactaaaataaaaataaggagtactaaaagcagttcatctagaatacagtggtggcaaatgctataaaagagcagcgtgatggcggttaatggaacatttaaaaactataaataaaacctctcaatgaaaattaggtttgattcttagtatctcaatgacgattagaggaaatacgatgggtaagctatgaagcagaagggtcacatcagttgacatgatttatagaaactaaaaaaaaggaccccgacgattatcaggctcaactgttaaaaaaacctccttcatatatttcccattagcccgaatgtattggccaaattccctagacccattggtagatgtaatttcagtcaaaatctacacgtatatttggcctatcaaaactgcttaaaacagttagttccatagcgccaacttagttcaagagtagataggccacaaaacaactctaacccaagcaaagctacgtgccagtaaaataatttagctttttggggcgagctggcttagcggggcaagaaaaatctagctagcagggagagcccatttagcgatctccttcgacggcaaactttgctcacgcgaaaatattggaacgagggcgacacacacttctctgaaatcagcgacgtaaaatcagtgatatttttcaacgactcacccaatcttgccggccttttcttccagttcttgttgcgaactctcgctcaagctttatcgaaaattgccctctctaccaaacccataaacacagtgaacaatcagtctggacctaaaagaaaaaaatcgatttacagaaaaaacttagcaacaagaggtgaactcatatgtagcagataaccattaatccttgccacatgaagtaaaaccatccaaaaaaaaaagccacgacaagactagcaagctggcaaagagatggtttagcactgccgagctaggctagctgggcgagtgaaccaaacgcatcaaaagtccgctaatcatgagcacacctgtcacacacggcgtgagtgacaaatacatggtgtcttaatccgtggtagagacggcaacaggtctcttcactctgccccattcccaacgaagaaattccgcgtacgccgcctaacatcagacacgtgtccctcccgatccaaagcaaagttttcgcccatccccatcgccttcccctcgattcctcctccacctcctcctcctctccttccccacgtcgatctcacgctaccctcgatcgagctctctctgcggcaaacccctccctccttcccacccaagggggaaagctccgccgccatcgtcgtgctgctccccgttcccgcggatccatccggggctctgggttgatctacctcgccggtgacgtacccttatccttagcctacactgctttgcttgttccgagattttatcatactgttaaacttttgttttcttacacaaatcctttgtctgggaaatgtaaccaaccaatgaatggaatccccaatctgtgcagtttcctgctgtttcctgctgattcatttgctgttttggtagtgtgcttatatttcatcaaaaaaaaaattctagaattttgcgggtgttcaactgaatcccatgccccttgttaggtcctctcctgatctgatctgggagaacacttcggattgcaattccctttacaaccaatggcatgtctgaagtgggacaacatttcttttctttattttttttaagaaaaaaaaagtggaaccatatcaattgttcactatcaatgcagtgataatggtgaagcaaggcatggaatgattaatttgaactattagatggatcttggactgctaacactgacgtaattaaaatcagaaatgaagttaggaaggtcagctgtttttttccttacctgactagctgacatttccatgattgcagtcatgacaccatcagttttgcacgctgtcagtaattctagaacaaaactgggctgaatggctgatgacctatatatgagtccgtttgctgaccagttcttgatgtattgcacttgacaataaattcatctgctgacccattcaagttgtattgcacttgacaacaaacaaatttaaaacaaaggttgatgcctttttggtagagaaattgactgaatactgatgtggttagtgcttctttgctcatgtcatgttctgaattgaggtctaggtgagtgcatcttttcaagccacttttgactaaatatgcattgcttgcatcatttgtcatgtgcagttgaaattcctgcagacataggatagcagctgtatgaaaacatatatattctctagactgttatttagatttgtacagcctagattatatatatatttttaaatgcttgtgccttttgtcaagaaaaaggcccaaatagactagtatcgaatctagttgttggaaatatttgaaggttgaactgcaatctgtgccaagcatgtctgtcctccatcctcattcaattgtgctcatacatggtattttgcaagatcattgtgctttataaaggcgtgtacttgtttggaaattcggtattaataatgggaacggtattgtttttatcatagactaatcagaataatatgaactcttcttgagctgaaaataaacatgcaatgtatgcatcccctgtttcctcttttcctctgattgaatgcttaacaagcttacagtgacaaacagtgagtcggcataaattttggtacagttgagaagttcttgtgttggacatatccctcctcccctagaaataagaagctggtattagtctccttatttattttatgtacttctgctttcttctattgcataaaggaagggaacaataaacatctgccttttattctgtttctttttctgagaaacttttaccaccctcatgggccatcaaatacattatcttccttttttgtgtatgttagatggttagcgcatactgtgtgctattaaatgattctttgcaccatgagcgtggacactgaaattgaagtcttctctgcagcttaagttcactatgtctggaatgccatctgatgaggcaactggtcaagtgaggctcgaaggagatgtttctgacaaaaaggaagaaaaaactcaagagcagagcgaagcaagtggaatgccctcaccacaagaagaggtactatcttcatataagtccattcttgacccttgaactttatccagattctatttttcaccgtaaattcgtaaaccgtttattttcatcctgaacttctcaaattgttcactttacccccttgtgacgtttcctccttgcttcagtacatagtagtcaaggccacgttggctttgacctttgctgatgtggctgttggcttttggatgacgctggaaggcctctaaccattataagccatgttgtgagaccaaaaatcggttggaaatgatgcaacaccttatatagaggtgcaagccttctggtgttgtccacaatcaacagacacatcagcaaggttaaatccaacatgggctgtccactgtgtaccaaaactgggtggaaatgattcaagggaatagagtgaacagtttgagaaatttagggtggaaaatacccgattacaagttcagggtgaaaaatggagtcaggcaaagtgaaaaggatcttttgctacaccatttttcatgttactgtgtgtacttattcatgtggcatttattccataaatagtatgaatatctattaattagattactaatatttatatgcgaatatgttcaggaagcagccatcaagaaaaaatatggtggaatactgcccaagaggacgccacatataactaaggtcaatgccttctttattttagtatatttgtttttctctgttaaaatgatgattattgtataaaggtgaaacagatgtatggttaagttgcatttcttactgagcttatgtaatacttaaactggaataatctatcaggatcatgatcgggcttactttgattctgctgattgggctctaggcaaggtaatactaaagtcattatgaagttgaattgagtgctgcattaatattcaataattttcgaagaagaattcaattcttaccatgtttttccttttgcttgccgcagcaaggtggaagccacaaacctaaagggcctcttgaagcacttcgaccaaaacttcaggtactgacatttcagcacacaagatgcacaatttttttttttttgccatgtttttgtttcgctggaagattatggctgaatttaggggcggaattaggagtagggcaggtggggctagtgccctactcctgagtccttaacctaaacacccattgagataacacttcaaaatttaaaaattagaagaaaaaaaaggcaaattacactaattcagccctagtcttgaaaaaagtttggttcccgctcctggctgaaagtgaatacccagatcatttgcttttagcatgttgcttctgatatgctctcccctacatgttttgctatcaagactgacaacatttcttttatcactctgaacaagtatatgagaagtcatattgcattctatgtcatgctactatattcatttctttccttcggtgtgttactgtgtcccaatccactttcagcctactcaacaacatgcacgtgctcggcggactccctatgcatctgctgacaatgatggtacttcttgtctgtacatgaatgcatctcaactccgtgtacgtgcatttcattttcttatgttgtatgatggcattgtttattgtcctgtacagtgtatgaatttgcctcctgaggatttgatccagaatggtgatcccatcgaagacaagaacaaggaagaacagtaacgagtagctgcaccctgtctatttggagcgttgccaatcctgtcctcgagccaaactgttgccttggtaaataactagagccaatgcctacacttgtggggatgagctctgcagtgtttaacttaaacgtaagacgtggtatgtctggcgtctaccacattcagctgttcagtgtctttctggcatctgtaacagctaggaatgaaaacttacatatgatgctgtgataccgatgctgtagtacctgatgtgcaaagaaacaaataatgcttcaaattcagctccccatgaatggaaattagtcaaattactggtgatgcactacgatattaacatgttcctttagcgccatcagtgttgctgttatctaggtactatgggcttgtttgaatttttgaattgaagccaatactgcaactaccacattactgaggtttgcagtcgaaactgagatcgagaaacggacatgttaaccggtcattatgggcccaacatataagcaaactattctttgggctgagactagccatagtgtttctgtccataatctcaggcccatatggctagaattctccgaggtgttattcggaataagttcacttcatgaccctcaaatttgatcgaaatctaatcgatgaccctaaactacaaaaccggatatctcgacccccaaactcctaaaactgatgcaattcgactccctggcggttttgggaggcggttttgctgacgtggcgccacgtggcgcctacatggcaatattgaacaagtcttcgttacacgtgacgttgacgtggcacctacgtggcggtagaaataaaaaatatgcgtgggacccattagtcattcccccaaaaataaatgtgggcccactgacatgtagggcccacatgtcagtccctcctccctcactcccttctctctctttctctccccttcttcccccttcggccggtggcgcgcggggacagcaagaacggccggcggcggcggcgttcggcagcgtgcgacgggggccagcggcggcgtcaggaggaggccaagggccaacgctcctccttctcctccaccgtcgccgccatcaccataaaacggccggc

SEQ ID NO: 60023 - DNA, 6525 bp, Oryza sativa
ctgccgaacaccgccgccgccggatgccgcctccgccaccgccgaccgctgccgaagtccccgcgcgccaccggtcgaagggggaagaaggggagagaaagagagagaagggagtgagggaggaggaaggaggactgacttgtgggccctacatgtcagtgggcccacatttctttgtgtgtgaatgactaatgggtcccacacatattttttatttctaccgccacgtagttgccacgtcaacgccacgtgtaatgaagacttggtcaatatttccacgtggcgccacgtcagcaaaaccacctcccaaaaccgcctagggagtcgaattgcttcggttttaggagtttaggggtcgagatatccggttttatagtttagggttatggactagatttcgatcatatttgagggtcatgaactgaacttattcctattcgctcccttctccgtatccttttgattcgctgccaaagtttgccctcaatgttaagtggccatatttttttgttggttctttaaactgttgcaaaccatatttcactaatttgttaatgcacatttttaagtcaaatcttgccatacttacagataataatttttctatatactccctccattttttaatatatgacgccgatgactttttaaaatatgtttaatcatttgtcttattccaaaaaattatgtaattattatttattttattctgatttgatttattgtcaaatggtctttaagcatgacttaaatttttttatatttacaaaaaaattgaataagacgaatagtcaaacgttagctaaaaagtgaacggtgtcatatattaaaaaaaggttgattggatacataccattataaattttacggttttaaaatataccattactatttatctatttaagatcgtgccactacaaattcacaggtatttaagatataccactacttactccttttgtgtattttttaaaatttttggaccaaattgtactaatggagatggatccggcctgcatccgatgtcttggagctacagcactacagcaggtgacagtccactggaagaaatgtaaatatgtatccatccgctggaagcgattgaatgattcaaagcttggacactcaaattcagcaagttgatgtcgatgattgtcaatttttgtactgttaactgaagatgcaagatgcagagactgaacacgaaaaggaagcagtccagcagcagcagccgatgaagttcgcagccgcagcctcgaccgcggccaccgttgtcacgtccgccgccgccggcggcgagcaccgcgcctcctcgtgctccattcccatggcacgcgcttccccctgcgcttcacaaagccctttcatcattgaaaccatggtagagataaacaaactctgaataattcttcagaagccttgtaacctggaggacagagggtgtgggcaccaaggtcgcaccagagtgaggaggatggagatagcatcagatcgagaacgcaccgtcgcaagagccggccagatctagctccattagtggaaaatgaacaattcagtccaaaaatttttagagaacactttgaataagtagtggtatattttaaatatatatgaaattgtaatggtaacgtttcaaatagttaaatagtaatggtatattttaaaaccataaaatagttcaaaaccttacatcgggcctcgtatccccccacgtcgcctcccgctcaggcaactcgggcggcgacccaacccaccgccgccgccgttcttcccccctcccctctgcctcgccgccacctgagcaaacggccgggcagggctcgtggcggcggccaccctagatctggcatgggcgaatttgagggtggaggccggtcggagcggcgccgtcgtcgaggccggaggcgtgcagggcgcgcgggcgacgacagtaggtggacgtggtggcgacaggcggcgcagggcgcggggttggcggcggcaggcggaggcggagactggcggcggggtgtgggccgcggtggtgaaggcggcggtgacggagtctgcgacctcgggcatcaccgaatccacgtcgaccattgctggatctggagccaggtgcgggaggggaggcgggtggcggcggggatgcagtggcggcggcaggcagcggggatgcaggcggcagcgggagcagaggaggcgtggctctggtggtggtggcacgtggaggagcgtggaggcgaggcccgcggtgtggaggccggcgcggcccgtggagatgcggccggcggcgtggcgtggaggccggcccggcggcgtggagtcgggtgcgtcacgtggagtgtggaggctggctcagcagcgtggagacgcggctggcagcgggaggccggtgcggtgtgtagaggcgtggccggcggcgtggaggctggcgacggcgcgtggttgtgcggccggcggtggcagaggtcggtgcagcacgtggaagcgcggccggcggcatggatggctagccgagcttcgacgaccggtcccttggcggccttggccggttctggtcggtgcagcaggggagtgtgggcgacggtaggttgcgtcgagggttgaatgcttgtgagacgtcgtggactatcgtgtggccgtcgatgtggggggcttgtgtgggtaatgtgcagacgctggcgaaagccttgccgtgcctttggccagttcgatgatgacgacgctgttggcgctgtttcccttcttgaaggcgttgtcatggtgctctgccatttgccccacaaatctccaggtgaaaaccttgctccggcttcggacgagcggcgacggtgttacgcgtcgtgtccttcttgggggcgtcgcttcggggaagttccttacatcgatgactattgatggtcccttcggttcaaaaggtttctttccttggcattcggcgaggcctaaacctcttgggtctgcttcattctatggtggacgacacactcttcggttgcttctgcggatgaagtcggagctgctcgctgttggggtgcggcgacgcttggcaacgatgacgtgttgtagtcttttccaaagagttggtgctggccatgtggaggaagtggctctttggtggcttggctgatatccattgtggatgttggagctgctttcactttggcgacttttgtggcttcagtgtcgctgcagtggtgaagtcggcgctgctgggttgcttggacggctagctcggcaacgataacacctcttctgtgatgtcggagctgttgtgccgtttttgtgtttagcttggcaacgatgtcctgtatttgggctccgttgttgttgttagttgtgtgttaggtcccatgctttcttctgtccgttgggtttcagccggttccccataattaaccgtgcagctgtatggttttcgggcccggtttcccttataatttgggtcgttgtctcttgtctgtacagtttctctctctcttaatataaaaccagtaatgctggcttaggttttaaaaaaaccataaaatttataatggcatgaatctaattaactctattaaagaaggaggtagtatatcttaagactaacgaagacaccactaatgtatcgatcactgaaattataattagtcgtagattcaagcatctatgttaagtatagtacttgaatatgagtgcacagattccaccataagaaaattaatcagatgacactcatttcgttgtggataataatttgttggccaaactttttagtgactcgtcacaccttgggtaagttagcttgggtatagcatataaagttataaacaggcctcgtaatcactacagtgcttagcaaaccaaaccaggaatcactacttgtcttgtctctggaccattcatattcctctgcactgcactgcagatgccaaaagccgtctggttccatcacaatatcacatttcgcctcacacggcgtactcaccaatcgccccgggaggcgaggtctcacaagatgaggaaattcgcgcacgctctcgaccggagcggcgacgcgagtgctcgccgcccttttttttttttcttggcggacacgacgacacgtcgtcgcacccgctcgcgcgtgcgtaaaaaacgtgcgcgacgtggcaaccatggcgtgtacatagggcttatccatgaacccgcttatagacaaaattagtgtataacctatgggtttaactcgcgggttacatattaatttgatgtataaatatgttttatgtatcgacccacttgcatatctagatgcggctgagctacgacgcgaaaacctatgaattatcatttatttgacctataagtgaattcacgagtcggcccgcttgcatctctacgtgtacacctatatattcgaaagaatcaacttttaagagtaaatctgaacatgcatctatcttaaatacttttcttaagtatatatcaatatcataatccatccatttccaattaactcggttgcattatttgttggtaacaccatcattgaaggggatcagtgagtgacatgtatggcacggcttgtactcatcgacgttggcttactcggtcactaagttgtagtaaaatgatctctttcctcctcgtgcacggtcattattactttaccgtaataatggttcagccaaatccacagcgatagggagtaatcccagcggctcgtttcgaattattagcaggagccccatttccgttcgtttctattcgcatcatacactgtttctagcgacttccaagcaattaatcatcaacacgtaatcacagcacatttgtttggcgatgaattttgcttggggatttggggattttccgtacgttcatccttgcaaaattcgtgtggtttgaacatcacaagcagaagcaggacaacagaaaaccatgcttgtattgtatgcagctagggcaaaaaggaacagggagcccacaggggctagcgataatggagaaatcaatggctaatgacgatgcatggcaaaagcatgtaccgaacatttgcgccactaatctagtagaaaggagaaagcaattgccgcgaaatgaaaatgggttgtgcccgtggctgttgagtcgtgtcacttgtactgtaccccctttgtatatatggtgaggcttttagaaacgcttgtcgatgattgaggtttggggaaaaaaatctttgaaggaacatactactctcttcgtttcacaatataagtctttctagcattgttccatatacatatagattttttttagacaaaggcagcaccttatcgattaaattgcatcagcattgagtacgtctcgaaaatgatccgggattacatagcgaaatatattacaagtagcagactcggaacaacgagctaaggtatgtgctgcaacattggttaaacgataaaggagcattccaggaactcagtctccaatttcttaatatcacggacaataacgccaacaactgaaaggtctcgtgccccagattgaattctcttgataactgacaggcaatctgaggccatcaacacattctggaaaccttccgcctttgcatgttccaaggcgaaacggatcgccaaagcttccgctagttctggagagagcaatccggttatcctcttgtttgcagcaagcaggcaggtggcactgtgatcccgaattacaaaggccaaacccgtctgattagaagcttggaagagtgcagcatctgagttaattagtaccatgcctggcggcggtggtttccactttgtaactggaagggggagatcacacccagaggcattcctatccttggggcagtgctgcacaatcatatcgacatacgacacaattttgtgaatcacttggcgcgggtgggtagtaacagggttattcctagaaaaattcctcgcttcccaaatgtgccgcagagtaacagccaggactgtcttctgaatgtgagagctgcgagttaggaaatcaaacacccattgccttatattgcataattcccgtctgcacaagttaatctgaaacttctccttgatggcatcccaaacagttgcagcaaaggggcacacaaggaagacatgctcaattctatcatcatgaccacaaaagatgcatccctccgtagcaggaacatggcgtctccggagttggaaccctgtaggaagacaatcatgtactgacctccacaaatgtatcagcattttccccggcgcattgattgtccaaagtgccttccagaattgcgagtccacattcgctccagagtgttgtcctctcccattggaactctgagccaccacaaataaatttgatctcactaagttgtaagcagagcgaacagtaaacaacccccttttgtcatgtggccaagaaacaaaatcttctcccccatgacgacttatgggaacctgcaaaacttctcttgcaatatcatcgttgaaaactgtcttgacaatctcctcatcccaagcattcctttcaggattcatgagccaatcgacagtaacatcatcagggatagggaagcgggtattcaccatt

SEQ ID NO: 60024 - DNA, 1216 bp, Oryza sativa
agcaaccccaaagattcctttctttgcagcaaacaggacaacccctctgtacacaacaggaagaggtaagggctaactgggtccccctgtcttatgccccttgaaggtatcactagcctagttagctccccattaatgcgaacggcatatctgactgaggtgacgcatctcatcacagaactaacccaggcaggggcaaacccaagcttcgttaagcatccttggagataagaccactcaattcgatcataggctttcatcatatctatcttgagagcaaaaaaaggatttttgctatgttgccttcggattgagtgtaggcattcaaacgccacaagtgcactgtctgtaatgagccgcccgggcacaaatgcactttggaattccgacacgatgtcaggtaggaagattttgaggcgattagccaaaactttagaggcaatcttatagaggacgttacataagctgataggccgaaatttgagaggtgcaccagattgtggatctttgggatcaggacaatgatagagtcacacaggccttctggaatttcgtcccctgtaagaaaaccacgcactgccccgcagatgtcattctccaaaaaattccaatgagattggtagaaaagagctgggaaaccatctgggctgggtgccttagttggacccatttgaaataacgcctcttttatttcctcatccgagtaggccttgcacagttcttcatttatggattcgtccaccttacatggaatggcctctaggacttcctctactgactcacactgctcagaggtgaaaagttttttaaagaaatgctcagccatgagtttgatgccttgagattcgctacaggaggaaccatcatccctaaccagcaacttaatcttgttggtgcgcctccttgctgaggcacgggcatggaagaaggatgtatttcggtcaccttctttcagccattcaattcgagaccgctgttttgccatgatttcctctctttcaaagagatcacataactgctgttccaaaagtctctcttcccggatgatagcatccgtgaacacctcgttacgcaagaacttcagccttctttccaaccgctgtatctctttgcgcaccgacccgaaggagatcttgctccagtcttgcagtgaaactgccatccgttgtaagttcatccaagctgccaacagaggctgggagtccatatacatata

SEQ ID NO: 60025 - DNA, 730 bp, Oryza sativa
tcgtggttcttttggcaatataaggtataagcttatagccaacatagtattaaaatataggccaatggtgttcttattttgggggttgaatttcattgtgtttggtttcattttcaaagttaaatccaagaaagtaaatagcagtatgatgggtcaaacctgtataagtgcaatctattgatgtatatagaaactttttttatgataagtttgagtgaggtaaaaaaaagaagtgtcatgattacacagaacaaacgaagatttttttttcttattgatggatattttatctctatgaccaaacatcctaagaaaataaaccgaaaatgatggtagtggtagaagttggaacatagaatgaacctgtcatcccatcgggaaagacggccgatcaaatgtgcaattacttcatgagctgatctaggtgtttgacttccaccagcactaagcaactcctgcacagagttccacaagcatttaagatgaaaaattcacaagctaaatactattcagttcataccagcaaataagcctttgtttcaaaaggagtacctgcacttcagtcactcctaaaacatttatattggatgaagggcctttgacatgcattgcggtcacaagaaagttctgtgcttgccaagaccgaacacaatgggtatgtcttcctcttcacggtttggatctccgactgattgaccaagaagttcaaatagcagtcccccagcaactc

SEQ ID NO: 60026 - DNA, 14360 bp, Oryza sativa
tgttaaccagtcaggctgtcactgtacttgaaactgtcttgcatttgcagagtgtagtagtatcagagaatgtccaacttctctctctctctaaagaaattgtccaagttatatagaagcataatttagtacactagcaagttatagcatgctgactctgtgtatacctctatacctttttcttttaacctgtacctgcatctttcaatgaaaaaggactggagaaaaacgctttcctagtttccttaacccttgtgtagtgagcgtaggcacacctgtaatcacaattagcaaactccttttgttccttttagatcaggtagtgtggtgttgatggagactacaagaaacaatcactaatttgaaagcgagtcttaaaaataaaaattgaaagtgacactgccttcttccccttggatcttctacaggtggcgtccatctttttggccgtttgatctgcaccccgtcgtcaaggtgctacaggtgcatacacatcgtgccaaaaggaaagctgcatagctgcatggcacttctggtaagcaacccaaatcaagcaatttgcaaattaaattagaacatcactgtccagtggcggatccagaaaattaattcgttggtgtcatagaatgctaattataattagatcataatattataatatgtggataagcagtttaactataggttttaccgaaagttatcggtgtcgcctgacaccggccgctacactatagctccgcccctgtcactatctaactgactgttcgagtgaactgaactacaatctttagcctaattaaaagaaaagtaaattacactagcaatatactccctccgttttaaaatatttgacaccgttgattttttagcacatgtttgaccgttcgtcttattaaaaaaatttgtgaaatatgtaaaactatatgtgtacatgaaagtatatttaacaataatgaatcaaatgatatgaaaataataaataattacttaaattttttgaataagataaatagttaaatatgtactaaaaagtcaacggtgtcaaatattttgaaacggatggagtacaattttatgagctgagtgcattggtagataagcttacaaaatacgtgttctatacatgaatctgtacaactagcgcgtgcgaactaaaaccaaattaacacatgcataatatatagtagctagtattgttgaggccgacgtggattaagacgccacataggcatgcatatggatcaagtattttagtccaaacattcaaaattgtgttcgttgttccctaataatttgcgatcttttctagagaatattttcgtattggagatctatatacttcagcaatgttacgttctttcgatcaccacctattactaagttcatcgtacatgagacattaaaaatttaagactagacctacttggtgtcctagtcagtgttaaacccagcaagattagtcatcacggcgtccacgcaaattttctttaaaaatataattgctgacctgcagtagccgatacgtcggtccaatttacatgtaaagaaatgctctggttgctagtgactgttttggatttctgcagcgagaaattccaatttgcacggttctccttgccggcgagcacgtactccctccggtaatcgtaaaggaagtcgttttggataacgacacggtctctaaaatataactttaactttttgtttctataaatatatttattgagaagtgatatatgtatacttttataaaagtatttttcaagacaaatctattcatataatttatatattttcaaactcaataacttaagagttattcatgatttatattcctaagatttgacttaaaatattattctaaacgattttttttattagtacggagggattacgtttcagtactctccgtgtcacccaggcatactagtactacactcagctgtgctcgatcgtcgactggataatgccatgggggattagtagccgcacagtaaccatgttgagcatacttccaagggcgcagatcacgtgcgattctgcggtcaaatacgagtgcgatggctcgtgggagacagagagtggtagggtgattttcttggcgtttaatgtacttgcttatcgggtactgttaccagttgtggagagctagctagcacgcaccatatttttatgatttcattttttgtgtgtttttgtaatagtatgtttggattaacgatggttatccgaaagactccaagttcaacccttcatatacacgcatgtttgaataatatcggagccatcaaatccaagactggcatggtaaagaaaaatattgctgtggacatttcttgagtcatactttcaaaattctaaggccctctttaattagtaggagaaatatataaaaaattagaggattggatttcaagcctataaaaaaattcctagaaaggtctttgatacaaggattgaattaatcttaccatttactttgaaatttatgttgaatcaataatcttacatatattttagagaaaagttggtaagaactccaatttcctaaaagaatactttgagtctatcgcactcatctgattcttgtatttttcctaccgtctattcaaatgatcattcttattttttttcttgtaatttgcaattatccgttttacacttatatttctgtttaaaatcccgtgtttttttcctgtttatctatattttttaatcatgtgtttcgaaggagccataaacatgtgtgtgtggttttaaatatttgaatttgatgtatggaaataatagaacttgttatgggaactttacacaatattattgtttatgttggggttctataaatacatagtaataatggtaagagaaaagtacattttacccccctgaactatcgaggtcgaccgaattacactcccgaactcgaaaaccggacattctacaccctcaactattgaaaccggacaaattacccccctgagcactgttttaggtggttttgggatagacttgctgacgtggcattccagcgtggcaaaaaataaataaaaaaaataatggacccacatgtcagtctctatatctcctctctaattctctatcccctcgcaccggccagcctcctcccctcgcgccggcggagctcctcgggaggcagaggcggagctcctcaggcggcgggaggctgaggcgaaggcggagcgggcggctggcagcgggagacggagctcgcacgggccgtgcccgagctcgtcgtcgtcgtcttcaacctctttgtccacctcggttgcggcgctcgggcggccgccgaccaccgcattagcaaggggcgacgcccgtgccccctactgccgtgccgccgcgccccgccgccttcccgcgcgccaccgccggctctacatgctccctgctgccgcgctgtcgccgccgcgacgcccgaggagctccgcctccgccgctggccgcccacgccgtctccgcctccgtctcagccgcccgtcgccgccatcgccgtcgtcgttttcaacctcctcctcgtacaccgcgccgccgccgccgtcccgtgccgccgcctgctgtctgcctctgcgcgccgattattgtggatgcatggctagctgctgtggagccgcggcggggccgcgcgtggccgacggaggcggcggaggcgcgcttggccagcggaggcggcggagccgcgtgcggcccgcggaggcggtggagccgcgcgcagccggcggagacgacgaagccgcgtggagctggaaggcgagcggaggaggccctcgcggcggggccgtgcgcggccggcggaggcggcggagccgcgcgtggccggcggaggcggctcagcccgcggcgagcggaggaggtggtccgcgcgtggccggcggaggcgccttctcccgcggcgagaggaggaggctagccggcgagaggggatagagaggagataaagagactgacatgtgggtcccttatttttttttttttttttgccacgctagaatgccatgtcagcaagtctatcccaaaaccacctaaaacagtgctggggggggtaatttgcccggtttcaatagttgagggtgtagaatgtccggttttcgagttcaggggtgtaattcgatcgacctcgatagttcaggggggtaaaatgtacttttctctaatggtaaatatcatacttttgtattgtactacctcccttcttaaaaagtactccctctgtactcataaagaaaatcgttttggacagcgacacggtctccaaaacacaattttaacttcttatttctataaaaatatttattaaaaagtgatatatgtatacttttatgaaagtatttttcaagacaaatctattcatataatttttatattttcgatctcaatataatttttatattttcgaactcaacaacttgagagttattaataatttatattcccaaggtttgacttaaatattgtcctaaacgatttcttttacgagtacggaggaagtaatgtcctaaaatatgtgcagtcaaactataatatcttggtagttactacgccatgctaaaatatagtaactcttgactatgaatcttgacgtattaatttccatgtttaattgttatattttgcaatgtatatagtaaaaaaaattaaaacttaattatgaaaacgattacaatagacttgtcataaaaaatacaaaatatttttatatggttatattttaagtaagttctataaatatccaattagatagagtaatgataagacatgtaggcattatagactgtatccacaagtaaaaaaagacatgacatcaaaatatcaatgttcaaaacgacctgtttaaatggccgaagcgattatatcaatagcattaaacaggatccaattattatcaatcactactgttgactatccattattaacatctgcaatcatattacgccgacagaggcatgtgggtccatttggattaattacatcgccaattattaaagggaaagttaagaggagcgtccattattgcgagtcgtcgagctagcttgtgatcgatcgatgaatcgatcggtcgacggtggctgcttgctcatgtttctgtggtgctgtattgctgcacacgaaatggagaaatggatagatcgatctagtacagcattctagctagggccaccgactcttgctctcctgaggtactcttgattagctctccgtaaaaaaaaaaaatctatcatatgaatatggataagctgtagcgtagccaggaatttttcattgggtagtcctagttcacacgttcatgtcacgcggtaaaattttcttgcacgatgaaattgatatacaaatacaaatttagtgaaaatgtgatagaaataatgtcttccaacatacataagtagcttacttaacaaacaagttcaaaatgtacaaatattcacagactgactaatctctaatcacaattcacaaatcgatttagccatttagacagctatttgttaggctgagccatggaggggataggacggtggcacggcgtggacagcggggaggccggaggggaggacgcgcggcgccggcgcagaggaggggaggggatggcggtggcggcgtcagcgcccggcgcggagtcgcagaaggaggggaggggatggcgcagcgccggcgcggatagcggggagcctgccagccgagggcggcaccgagcgtggagtcgaggaggctggcggtgtcgggctcgggcgaacaggaactggcgctactggctggtgagacgctgagtggctaggaatccctccaaccgcatatatttccgggctatttggaccaagcaaccaatttaagcctaaactttttgggggtgggggtctctgggccagattttgggtagtcccgagcccaccaggactacccctagctacgcccctgtggataagtgcttattcatatttaggatagagttctgtatttagtacagagctatgctggatatgttggtttgttcgattgcatttttatcaattatacgctactttcgtgttaaactataacaatataatatataataagatatgttctattataatgaatttgatctctaactagataggctgttagtatattttaaaacgtaggtagtatttttttaaaaaaaaaagaatggtcgaaaaatgacaccctggtttccgtgcccaatgtttgaccgtccatcttatttgaaaaaattatgaaaaaaattaaaaagacaaatcatgcataaaatattaatcatgttttatcatctaacaacaatgaaaatatgaattataaaaaaatttcatataagacggacagtcaaagttagacacagaaacatagggtttgtctattttttagacggagagagtaggtattataattcgaccggtagacggactcctaagcccagatgacacagaaacagagtatctcatttctgtatagaaggatcgatgcattttgaaactgcaatagcactaagcgactacataagctatactacgtaggagtaactatatgattcgcaattacagacatgcagtatgaacagtagtgttgatacgtactctagtatgaacagtagtataaaataagtactctctcaattcgtaaccggtttgcaaggaaacaagttacgtcgcatctgagatatcaggccaaaattcgtccacactagcaataacacacacccatatgtatcacagttgccgtatataccaatcctgccagaaacgaaattaaaacaaaaacgacgcgacggtggagatccggccggcccatgtatgcattcaccgatccgccccccccccccccccccacccacccccgcaaatctgccaatctgcaccgcacggcacgacacgacacggacgacgcgacgtcgcgcggcgccggggctcgggctctctcgtccgtcgctcgcctgcagccaacttgcacgagacgcgcgcgccgtcgtacatgcggcgaccccctctcgctcagctagctagctgccgccgccgccgccgtcctcatcaatcgtatactctctctgtcccaaaagaaaaaaagataaaccctggggtttcgtgtcaacgtttgactgtctgttttatatgaaatttttctataattagtattttcattgttgttaaataataaaatatgattaataatttatgcgtgacttatctttttaatttttttaaataagatggacagttaaacgttggacacggaaatcaggtttgtctttttttttttaagacggagggagtagctagcaacaacaccaaaccgcgggatacctctcaccaatttcgatcggattcacgggaccggccgccgtcacgcgcgtcacctgcgcgcggatgtatcaacggcagggaggcggcaagcaccagcgccgcgaatcagccgcatgcggcttggccccgaaccggtcgatcggcccaccagcgcaccagcgccgcacgttggcttacattattaaggagcaacggtcggttaacgcgagagctggggacgtcgctttccgagaaatttctgtactctaaacgatacggagtaagaaaaaatggcgctaggccgctagctctgtcctgtctttgggtacggagatgtgatctgtccatatatgtataggccgctagcaagtgccaaacatatttgacagaatatgggcctgtttagatccctgccaaaaattttacaccatgtcatatcgaacgtttgaacacctacataaaatattaaatataagcttaaaaaaataactaattgcacagattgcgactaatttgtaagacgaatcttttaagtctaattgctcaatgatttgacaatttggtgctacagtaaacatttgcaaataatgtattaattaggcttaataaattcactagtattttaccgacggattctacaattagttttttttatcagtgtccgaatactccataggacaccctatataatatccgatgtgacacgtcaaaattttacacccctagatctaaataacccttaggctctgttcgctagagcgtgttcccaactagaacaatgcgcacggaaaacggaacggttcattagcgcatgattaattaagtattagctttttttggatcaatatgatttttcaagcaactttcgtatagaaactttttttgcaaaaagtgtgtgcgcggaaaacgagggaaatgagttaggaaacttggggtaaggctattcccaatctaagacactagacatagtttccataaactacacatcatcaagaaactagtactggacactactctttaaatgtaaacaacattttttcatacttaaatttaatgctatttatctcatatgatgtcttaaatattgtgtagaaaccatgtcttatggaagacctggtttccttccctttacttatttattcacttgtcacatcattttttattttagatggcagcttatttaatactatgggtaccatactaattattgagggaatggcataagaacacagccctagtcttgcgcgaagctggcgttttcatcgatgcatggacaccaacggaacgacgtggatgtcatctctccgtgtttattgtgactcattctatagctagagtcggtaaagggttcgctggtaatcgatcgatcatactttaacaaagaaaagttgggacgaagacgcgtgtgcaagtaaatcaacataagcacgcacgcatcacacgctaattataattttgctgtgtttgcttcagcgaacatccaagacccacgtgacaccgacaagacgatcgaaaagacgagattttcagtatgaaataagatggcttctaataatccatagtactataaatagttaaggttaagttcaatttgtggatattaaagtcttagttatccacaaatagggatataatttacaaatatattaaatacggttgaactctttagttggctctagccattactccatatcgaattttctattcccggtattccttccaatttacttgagttagcaattgctagtacatcagattttgcgtcttagagttgatataaagaaagaatggactcttctccctcctacacataatcaaaaagtttagtactgtgataactctatggcctaactcatttattgtctttccacacattttaagattgaaattattaattgtctgttcatctacttgcatagtcgactattattattgttagacacaaagaaatgtattttttcaaaattatcttttaggcttggctataattgaaggagataattaaatagacttaacgatcaatctagttcaaaggatattagttcagcagccaaactacaccttacagggtgcatgggagaaaatgtgaagacaactagctaaaatgtcattttccccttatttaaaatagcatagcaactcgtacacataattttagcaatgacagggcaacctaggaaaaagtcatagtttggacgcagcaatcaaaaagggggcaataatttacacaatgattgtttctcataatttaacagcattaaattctttattatccatataatgcaggaaaattttctaacaataaaacgctagctttcatctgtactgcacccgatctcacataaatgcatttaaaaattgtgtgtaatcaacccaaaaactttttctaccattatccgaaacaattaggaagtgtttagatttcagctgaccaaaaatgttctcaacttatcatcataaccctaaaatgggaacctaattgttttgattactctcactattaataaatattcaaaaagaaaatcccttgtatcatagataaatatgttaaaacaataaactacattaacccaaacatcaaataaattttcaactcataaagaacataaaaagttgcatattaagtattcaaactcaacataaaagtaacatagaaccatactaatacaaaattgcagttacaataaactaatactccctccatcttatatttatcttcccaaaataatcatcacctaacaaatatctctttgtttatttgtacaaagagtaaatgtgcatcattgaatgtattgcatacaaccaaccaatatctttctattggtgtaatgacatgcaatatttaaaacatgcgcaatccacgagacacgaagcgatggagcaacttaaccgatgatgattaattgaatgatgaatattttagcttctttagtcttggtgccttttgtttaggggattaccaaactggatggaactctgctatacgtatgaccgagccatccgactcatgtccgactatgtcatatcaaccaatcactgagcttgtttcttatcatgtggacccaaacaagcagcatttatacctatatatacactagtcgaatgtaagttgtacatatgagtcggacgcatagcaatttccaactggatggagagagtattgcacttttgcataacaatgcaattttagattagtggtgtgtagttttagataactgaaatctatcaaatcccaaactattaatattgtatcatttgaaaaatgtcaccattaatataaatatcaataaaaaatagattcatagttaaatagatttgtgaaaaaaatagtactccctccgtcccataatataagggattttgactttttacttgcactgtttgactattcgtcttattaaaaaatttaaaattattatttattttatttgtgacttactttattattcaaagtatttcaagcacaacttttctttttatatttgcacaattttttaataagacgagtggtcaaacagtacaagcaaaaagtaaaaaactcttgtattatgggatggagagagtactaatataagtaaaccgactctctggtttcccatcgtaattgatcgaaaactgacaacatgttagggttgtaaacgcaaagttgacagagcatgttagggcggggaaatcacacgtgatgcatatagacggtttaattggaataataattgcaaaaaggtatcgtagaaagaaaataaaaaaggagaaacagatatacacacagtgcatgcaaaagagcatgattagcatcacatgccatacacgactattttagaattcccggatcaaaaccttatcgtcttatatatctcgccaccccgggcaagtgaaccaacaccccagatctaaccaccgataattgcgatatcttatcatgttacatcgcacggcgcacgaagcttcgtacccaagggcgatgcacgatgagagaaaaaaggaaaaaaaaaggcctgaaaacccgatcagcttggtcatatatatggccatgtgattcgcacacctaaagcaacggcgagaggataaaatagggagaaaaaggtcgcgaaaacagcgtcaaccctgctcgccggcgcaccgaccgaccagagccgaaaacttccaccaccacaccacagcgtcaaaaggcactccaaaatcccacccaaaaaaaccaatccccaaccccaaccccggtgcccgccacgccacgccgcgtttgcgcttgcaccgagtgcgcccgaaacccaccaaccaacccggcggcacagcaccgcagtttcacggttggtttcaccgtttcgtgcgtgtttttagcgtgatcctcccggacccggaggccggaagcgacaggacagacagggacgaggagctctcgctacaactactacaactgcaagagctcgttggttttttttaacccccaccgcgtccgcgaccccgaccgatttttgcagtggttcgctcgcgacgccaacacgaactcccgaaggcgaggcggctttgcacgcacgcacgcacgcacgcacgcgcgggctacctcctcggcgcgagttgctcagtcgcagggggggaggtgggagcggggcggggcggggcgggcgtcccggtcggggattgcgctggttcgatccccccgcgcgtgtgggggtgtgggtgcgtgggatcgatctctccctctcgctcgctcgctcgctcgccctagcacctcgcgggcggggcgtcgcatgcggcggcgcggcgaggcgaggcaaatgcgggtggattcgtcgctggcggtggaggagaggtgagggggcggcggcggcgatggcgatgcagacgatgcagacggagcagcagcagcagcagcggaggaaggtgagaggaggtggcaattcattttttgttgcgcggtgtttctcgccgggggtggttgggtttttggtggagggtggtggtctcatggtcatgggtggttggcgtttggagatcggtttggtcgtcccgcgggtcgagacgatcttgagttatatggagtcgggggattttgtgcaaaagaacgatttgtttcccttcctttctttctcgtggagcttcggattcggatgcgtacgagcgtagtaagggtttgttcttgccgttgttttcctccgcttttttgctcgacttttatctgcggatgactccgtatgttggattgtggtgaatttcagtggattttgagctctgcagtcgctgtagttctcgattctcatgttccatttgttcgcaaaagagatttttcccccctccccttcgcctttctctggatcggaaattatccgaattgtcagaaggttctctattcgatttaaccgtggatgccttcttgataatatctgaaaccttctggtgctgggcgacgtctgctttttgtgccctcgaaaggaaatgacatcctttgacaacttttcccgagtcagtcgaatactcattgcgccttgatgaataactagtactccaattcagagaattttcccaccccacttctaatccgagataacactccaaggagagaagattaattcagatgctacttagaagcatcacaaatgcggtataagattcgctgagtagatatgtttatcctaagccagctctgcggtctttcttaccttcctggttttttttacttgcaagaaaagaatagccaatcattttaattgtcccagtggattatctaatcaatatattccatgcccactttggaggcatattgatcgagatggttttatgccccagaggccaagagcacttcttaagagtcattatttggctttttttttagtcttgttcggtcttaggctttgattgtttcgttttgctcattgctggagagtggagactaaggagtctttgcatcagaagggcaggtgtagctactgtcttttctgatacatcagctactagagtccagttgctcgttctaggatctatctgagtttgttgaactaggatctgtctgaatttgttgtacgcagattaaccatctgctgtttcagtggtctgttagcaagtactcttctatgcattcaaagacattagctttgaattatatactccctcttttttaaacaagctatctccagcatagtgttaactcaatttattgacttatgttcagggttcgccagagatggatttcttcagcgaatatggtgatgctaacagatacaaaatacaggaagtcattggcaaaggaagctatggtgtagtttgttcagctattgaccaacatactggcgacaaggttgcaatcaagaaaatacacaatatctttgagcacttatctgatgctgcccgaatcctccgtgagatcaaattgctccggctattacggcatcctgatatagttgagatcaagcatataatgctacctccatcaaggagggacttcaaggacatatatgttgtctttgagctgatggataccgatctccaccaagtcatcaaggcaaatgatgacttaaccaaagaacatcatcagttctttctttatcagatgcttcgtgctttgaaatatattcatactggtatgcttccttttagaaactgaggtctgagctagcacagcgtttattgatgactgtaatatttgtttagtgttgagggataatttattctctgaaatgttgggtaaagtttattcacatttttttgggttctttgttatgcttcatgaagagcataaacgatcttgtagtgtgctcgcacatgaatttggcacagtgctagcccaataaataagtccactataaataaaggaaattgtcattcccacatcatttgcctttagttgcttattctgttcattacattatttttgccctgtggagattctgtttgttgccatcctcttatttctttaaagtatttcccactattttgcatcttttattgattactagatactatacttgcactttctttgtctatctagaaattgactaattgtacaacatgtcatcattactgttttctgctattcactgttaagccattaacattatcaccactgaaaatcggggg

SEQ ID NO: 60027 - DNA, 1843 bp, Oryza sativa
gcatgctcttctgactgtacacattttatcatagagaaatgtaatatttttatatcataaagacataatatttcaatttaactagtgtaatacattgagtgttatgccaatagaatgataatggcagctattctagagcctagtattcatggccacacacactatactggtggtatgccaacatgctggtatacaatagttgtcacttgtcaatctgtggcccttccttgatatgcagccatttatgtcagtcatagcaactactgttgatgctaagtggacttcctaatatttagcaatcacaattcgaattaactagtgttacatatcgtcataaatcatacttcacattttgtggcctctttcccattcctccaagccttcatttggatctttgacaacgatcgtgtgactatattctgttttatgatgtctggctcaattttactttatcttgattaatcgggtgacttgattccaagctccctacagatatgcacatgttactgtttagaaacttcatatgcggtcattttttattttcctgaaaaattaatgtctatgtgttaaatttatcctgttgtacataaccctttttatgcacaagtacccccatagctatatgtgattttacatcaggccattcatcccctttgattccgatttggctttttaccagctggtataacagggatcattccttccaaattgtcttgttcagaagctgcattcataggcggcatttgctacctttttagtaggtattgccttcattgatcatcatagatagttttattagtattatttggttaggtttgaaaagtacagcatttacagtaacctgagagtttattcgtctgtttgacatctaggcgaagtgataggattaatgtagttagctgatattttcttcacttttacgccaactgttcaactaatatctgctcctctgtaaatttcaatggatgctaaatcgattgtactgtgcagtattcaccagctattgacatatggagtattggctgcatttttgctgagattttaactgggaagcctttgtttcctggtaaaaatgtggttcaccagttggatctgatgactgatctcttgggtactccatcaatggatactgttacaagggtatgctttgcctttcatcaatgactaatgctccaaagtgaactatccataataaatgccaggtatcatgttgtaactgcagattcggaatgagaaagcaaggaggtacttgagcagtatgaggaaaaagcagccagtacctttttctgagagattcccaaaagcagatcctgctgcactcaaacttctgcagaggcttttagcattcgacccgaaggatagaccaactgccgaagaggttagtttttattaatgaatgtcgaattaaaacttctgtagtttgtacttccatgtgatggctgcacctggtgtcatttggtgctgaaatcattctaatgatattcattttcattgatttacatatcaggcgttggctgatccatattttaaaggccttgcgaaagcagagagagaaccatcatgccagccaataacaaagatggagtttgagtttgagcggagaaaggtgactaaagaggatgtgaaggaacttatattccgtgaaatactggagtatcatcctcaacttcttaaggattacatgaatggaaccgaaaaaacaaacttcctatatcctaggttcgtcccatggattctcttccatcagtcatgctccccacctcctttctttttgtttattcccatcttctgcaccccattggttataactaatacattttcggttgcacctaattgttattac

SEQ ID NO: 60028 - DNA, 835 bp, Oryza sativa
cgagtagattcgatgcttccgaagtatttgacaagctgagaatcgctccggacacctatttcaagaatattaaagaagccggaagcatgggagcaggtttagcgctagcaatgaccaaatccctgtacccgaagatcgatattgatgccattgatggttttacggatgggacaagcgaagaggctgcccttgatcttatcaacgacactcaaaaagcagccgacaagattgcaggtgatgtcgtagatcggtttcaggataccgaccttcggccgactggtaacaataactctgatgatgagaagactgatactgattaaatgtaaatgtattggatgacgaatgatggaggcacaatttgtataataccggtgtatttatgctgtgcttggtgtttcttgcttagctgttgatttcttaaaagcctttatcaagctttgttgagcctaaaacccgcaaaagctattaaaaactttcagtcctcgtaaactaagtagaaaaatcaagcaaggcaatgatagaccaagtaagcaaattgaattgataaaaatcacactccattattattatagtagcccccgactgacaacctcaagaaaaaaaaggcttgatgttgacagtcaagatagggaaatacatagagaaacttaagcgtagaaacgacgaagatgttcgatattccaagaattgtcaacaagtgtaccatcttcacgcttgagtcggtaggaacctggccgggtgacttcagagattataaatgacccttcccatagaggagataactgtgccgatctcgtgtagtttggattttgtcacgtcctgataaattcatccc

SEQ ID NO: 60029 - DNA, 2537 bp, Oryza sativa
cctagcatggttacatcacaacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagcggatcctgcagtcttccggagcttcggcaaacaactgacgatatcttcttcttcactgacctgaccatctagtactagttgaaatccgaagaaggaagaacggagtaaaccttttgcaaatagcattaggggaaggagaaaaaggaactttcgcaaataattttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcgggctagcgggcctacggctccatcttcacaggcgctcaactggggtataagccaggactccacctaagacatcttctccaaagcttctcttactgaagaggggaaagattgagcaagaatgagtacaaccacagtactcagcaagtcacaccggcagatgcatgattaatgcaagggggggtacaaggggataataatatcggggttaagttttgcagaaaacagcatttaaaagtcacttagttgcccaaagccattttataaagacgatcctagagttacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagatatgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaacgtctaaagttgtaaaaccacctaatattgcctaattaatcagcgaagcatctacctaaattcatactagtggaaccatgaatagagtacccactagttggggttttgtttatcctagggtgaacaaggtaataataacaatagcaataataatgccttaacaaaggtaaataggcatggctaaataaaacagtgataacgcgggaatttaaataaagcgataatgcattaatttaaataaaaataattttataaactgggattcaatatgctcaaggatgatgtgacttgccttgctcagagggaacggccttccgaaccttcggcgacgaccacgaaccacgcttcgggaacctccgggacgacgaaagctacgcgaagcacacaagcaaagctacaagcctacaaagaagcaataacaatacataaaaagaaagcacagggttctttaggttataacaaacattaggagacttgaacgggtcgattcggagttcgtatgaccaagatatgatcatccgaagtttaatgctgttatatggggatttgcggattattataattaagctttgcaactataaaatatgtgtaagcactagcctggaaaagacaggaaggctgcgccgttgacatgcggaccccacatgtcaacctaaaggaccgcggtagaccgggtacacagagacggtccacgggtcgatggaagcggaccctgtgtgtcaaccgaggcgagtggtcgacaaacggactccactagacaccgagcgggcacactaacgcggacactacacggtcaccacccgcacgcgtgaacgactaccgacaccggtacacgggtaccggggccgacaaccgcacaacgagcacgggcgacacc

SEQ ID NO: 60030 - DNA, 1382 bp, Oryza sativa
tataaactgggattcaatatgctcaaggatgatgtgacttgccttgctcagagggaacggccttccgaaccttcggcgacgaccacgaaccacgcttcgggaacctccgggacgacgaaagttacgcgaagcacacaagcaaagctacaagcctacaaagaagcaataacaatacataaaaagaaagcacagggttctttaggttataacaaacattaggagacttgaacgggtcgattcggagttcgtatgaccaagatatgatcatccgaagtttaatgctgttatatggggatttgcggattattataattaagctttgcaactataaaatatgtgtaagcgctagcctggaaaagacaggaaggctgcgccgttgacatgcagaccccacatgtcaacctaaaggaccgcggtagaccgggtacacagagacggtccacgggtcgatggaagtggaccccgtgtgtcaaccgaggcgagtggccgacaaacggactccactagacaccacacggcctgcacacgtggaaaccacgcggctaccgagcgggcacactaacgcggacactacacggtcaccacccgcacgcgtgaacgactaccgacaccggtacacgggtaccggggccgacaaccgcacaacgagcacgggcgacaccgaaaggacgaggacggggcagcgagggagagggatccttaccaccacgcgacgaggcgtggggacgacaacgacgaacgggcgcggcggagacagctcggggacgacggaggcgaaccgcgagggaacgacttcggcggcgatccttggacgaaggcgagacgcggctggcacaaggcttgacgacgcggagctgaggacgaagacgaggacggggctgccgcggcttgcttgactgatgcggacgacggatgagaacggctcgacggagggacgaacgccacgacgaccgggaatgacgagaggacgacgacgacgacgaccggggccggcgaggaggcgacgagggcagccggcagcggctgcacgaatgcgaggatggcgtggaacacgccgcagcgatgacgatgacggaggcggcgccgcgagacgacgagccggcgaggatgaacgggcggccgaagggacgtcggcgacgatgaggatggagaggccagcacgggcgacggtgttccggcgaaacagaggagcagctggaggagaggacaacgcggcgacgtcgataggcgtaccggcgacgtacaggagccggccggaggcggggaggtactggacgccgacgtggaggccactccggcgagcttcaggcgaggaggaggtgatgccggggatgagggcggcgtcgcggagccgagggaggtggtggcgacgtcggccggcg

SEQ ID NO: 60031 - DNA, 704 bp, Oryza sativa
ggcgacgatgcctggatggaatctgttgtcgaccagggtagtggtaatcatcagctccgtggcacatctcggcctcgtcttgtgtgccgaagtccgccgaaatagtgcgacaggctttcggattgtcatcctgtgggtggcgaaccagatgtcacgttgggccccgaccaccgcgctggccatgctggccgccggacgcacgccgcaggaggagcagctggtgacgctctgggtggcgttcatgctgctacacgctggtatgccggacaacatcaccgcctacgccttggaagacggcgttctctcgtttcgccagagtgtaaacgtgtttcttcagcttgttggacctgtgtcacctgcctatatcctgcaccagaatatgttcgccatgcctggcgactccatgctgtgggtctcctcgatcatctgctgtatggccatctgcaaatatttggagggggcgtttttcgcgctgcagcgtggcaacctggaaaacatgcgaagcgaaagcaagaaggaggttccaagtcgaagagtaacaagcctccaaagtctaaggcgtggcggcaaaccagataatgaccaaatcatgctggttgctcatggcaatctccatatcaccaagggtgccttcatcgataatttgcaatacgagcatgatgcccagcaaccaagaaatactcccgaaaacattggatgaaaac

SEQ ID NO: 60032 - DNA, 12661 bp, Oryza sativa
aaaaaggtgaagttggcccattgcctagtagaaatggaacagaagccaagcttaaagaatgcgctgcgcagcaaatggagacctggtgtcagtggacactggctcaggccagaaaaggcaagtattctttacgacaagaatataattctctctgacggaacgagtttcgcgcgtgtgctgctaagtcgtataggcccgaacccatataccccggatgatataaatcttaattacacaagatatcagagacttatagatatgattcctgaattgaaagacgaaagtaacaggtttgatacatcgaaaatgatgcgccttatcttcagagcatgggtgcgtcttctggtgtatgcatccgtgcgatgcacaagggattcccatgccaagcagctcgcctgtggtggtgagctcacaacaatcgtctggattcttaatgaacacgctggtatatttcgtatcgacagcgacaaggatgacgacaaggatagactgacaagtttatatactaacgaagatcgtttgtacctttgactgcaactcaccaattaatttgttttccttgttgataacctatatatatagggtatgtatctcatttcttttgtatacttacgctctgtaattacctcactacactacttaaaaaaccattttcgcttgccttcaatttaagttcacatgcggatataaattaaattgcacaatgtcttactttatgtttactaggttagatcgaggtgattaaggccattcccaacccaaaacactacatatagtttccataaactacacatcatcaagaaactagtactagacactactcttccaatgcaaacacaactattctatacataaatttaatgctacttatctcacatgatgtcttggatgttgtgtagaaactgtcacgcccggaatttctatccaaaattccaaacgcttacatgtgtgtgaaccctcgtccaggaatcagccgaggcacacaataacaaattcataatagagtacaattattactctaattaataagcgaataaaatgtcattacagaggtagatagttcctctcaatcaataaagatctaagcagcggaaaaaaaaagagataaacggcgcagacgactccactccacaggcagcttgaccagggctacacctaatcctccacactatcagcatcactgtagaactcctcctctgatgaatgattgcaaggtgagtatatgacatactcagcaagccacgcagcaaatatgcaagtgcacaaggataccaaagaatggcataatatagagctcatttgcaaaagcagcatttagcaaacatttgagaattataaaacagtagagtaattaatcatcaattttaatcaacactaaacagcacacccatgctgctcaggcccaaccatccggaacaaccatacccggctgtacagatctatctccaaaccaggaatataccattccaaaccaggagctaaacaaatttttaccagttatagcatcttttattatggtgagaagtgtgaaactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggaggtgtgacagtacccctcgcacaacacaatccaccaaagcgcacctttcctggatcataatcatccccttataaacaaggcatgaactccccagcgacccccgtggacttatctccgccacttctcagtctggtgctacgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaaaaatagctttaaacgggatcaacatgctcaaagggttgtttgggacctgtgtgacttgccttgctggccttggaactcttcaaattcttctagtgcgaaaacgaactcttcggaaacgtcggaatctaaacagaaaagagaaaaaacaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaatcatttatttagattttaattgaattatgacgcaataatgaattatttttgaaaaggaaaagggaattattgcgtcagtggctagggttcgcggtggaccgggtgcacggcggtggctcacggaaacgaacggccgagatcgatcctatccaaaacggacggccaagatccaacggtctacgaccaggccacggggaacgacgacgatgacgtcagcggagatgtcactaccggcggcggctcgggcgtgcatgcttgccggcgaacgacggcgcggcggcacgaacagaggacaccaacacgtagagggcgacgcggcgaactcaccggtgaccaaaacaacggcggaagatcaacggacggcgacggcggtgaggaaaaggcggcggagatgatcggcttgacgacggcgacggtgttccggtggcctacggcgacgacggaggggcggacgaggtcggcgatggcttggcgatcacgacggcggccttcccgagcgacgacgacgaccggagcggcggcggcgcacggctggacgaacggcggcgacggcggcgcacggctgcacggtgctagggcgctaccgacagcggcgggcaaaggcaagggtggcggcaggtagcggcgggcttgggggtccttttaaaggggcaaggaggcggtggcgaaggcccacggcgaccggcgacgcgatggaaagattagggtccgggagagagagacaaatccgattcgagatcgaatccgtgaatttccaaacgaaattaaccgacgattccataagagaaaagatagaggggatcccggggatcatttcccttctattaatttcatcggaaacagaaaggggcgggtggatttggaaggagacgacggcggcgcggtgctagggttcgggcggtcggaggaagacgacggccctgacaggtgggccccacctgtcagcgggtggacgcgcgcgcgagcgggcggctcggctgcgggccggattaggccaggagagagagagagagaaggttttgggccgactctccgcccaaaaccaaaagagactctaaaaacctcccccaactcaaattatccattaaatgcaattccatttattaaaaatacttccttagctcaaataaatcccagaaaaatctaggaattatagagttaagcaaagtatttaatgaaattttatctggccccattttatattggaatttattaattaaaattagatcttctcttctaggcttttaaaataaattataataattccaattaaacaacaatttatatatttaggatttttagggtgtgacagaaaccatgtctcatgtaagacatagtttcattctctttcctcatttattcacttgccacatcatttttcatcctaggtggcagtttatttaatgctatagatatcatcctagtcattgggttgagaatggcctaagaagccgcccaccgccttgaaaattgtttcaatttacccgagcaacatagttaagaagctatctgtaataacacgatgcgcaccttgagggaccggctaaaactaaatatggatttccacatgcggctgcctcttgctcacacccgcggccacgaccgtcatgctccacccagcgctcacgtgcacgagctctcgccggtggcctttgaggcttctgtcctcaatgggatgtgaagaagaagaaaagaaaacaagggggatgaggaaagaaaaggatttgacgaaaaacataacggtagtggcacaaatcaatttttctgcaaatttaaatgacatgaatttaatagacgaatagaagtggtatttatctaaacgagcatatttgtaatggcatatatccaattgtccctaactaataccagccagcaaacaaatctttttgcatgcatgtgactagcaaggctgagcttggccaagacaagagttacaagccagcctaattagtgacagcaaccaaacagatccataattactgtcgggttaattaagtttgtttttcctgatataaaaattgcgagcatcttacgccataatccacacaagcgttgcgagctcaccgccgctgctgagttgcttggcgtgggactccctgctgcatcggtggctaacgtagtggagcatctccacccacaccttgaacagaaattccacactggccccgtcgtatttgttgagctttttgactagaaggagggcaagcggcagagcattgagcgagaccttactggggtcccggtcggtgactcccagctgcttggcaaggctctgtgttttctggacggatgactagatcctaattttgttgatatctcggatggtttcactgtaaatagtgcgtagtgcaaggccaggtaccatgtagggacgttccagaactaggaacatcatgtagttggaaataagattgattgcttcaacatactcggtggtctctgccttgtcggaggtgcggaggtagatgtccgtcgcgatgtgccagataatgatttgctgctggatctcgtcgcgaactaacctcaagaacaagtcgtacatttctgccttgagcaaccccgtcgagtccaatgggatacccggttgccccgttggtgctgcatcttgatcatcttaatttatccttattatcgatctcgcaatccttattgtacgtcgacgtcgattcttattatatctagcaaatagctgaacacctgctccatgacacgatcaggaatgaccgtggtgccggagtaggtgttgtctttcttgcgccacttgacatgtatcttcttggcaaggtcgtaccagacgtccttggagccgtcgcgtgtgcagtactgcaacatgttgtgctgccagatggtgccggaccaccttctgctgtcctccgcattgacaagccagcggatccacgtgagcgcgcggccgacctggcgccatcgtccgctgcagaccgccgcgtggtacagccaaccccgcagcggcatgcggatcaagaaggcgtacgcccaggtcgacccggctgccatgagcagccaccatgtgtctacaaggacggcgccaaccagcaatgtgtaggtgatggccacgtcgactagcatagccccatgcccaagggcgccgtggaggctgagatggaacatcaccaaggcaccggcggtggccagcggcgaaaagacacggatgcagtagccatgccacgtgtggatgacgccagccttggtgtacatgatgtcgtacagcagggagagctccatctggaggacaacccacgtctctgtaaaatcaaaggtgtttttgattattattctgtgatgaacaattgggcattggagattattggttttgttatttggaatttattcacgaagtggttttggagatgattggatttacaggtgaatcgcagggttatcattttatgtggaccggtcagactgggctctggtagccggtcagaccggcgtgtaatgcgcggtcagaccggcgcagcccgcggtctgaccggccgacactgtatcggtttcggtttcgggttgtttatttggatatccaagtttatttcatgattatgacttctagatggatactatacgtatgtaatactattgtttgctgctaatgagtcaagttggagataacttagtctcggaatatagtttctttgtttgttccatgtgtaggtgactcgatgtctcaggagagtatttgcggtgatggaccgggagtcggcttggggataagacgacgtccgtggtggtcagagatcatgcgggatacttaggctatagttgatgcacgtggttgatggagattccatatggcatacaatgaagttattgtgtacgtataggatgcgtagttgaatttggaaggagttcaaatttggtacgattggttatgtaaagtttctttcttgtactagagggtttcctaaggtgtttaggactcctagtataagtttggttcgtggctttaggctgcctacctcatgtataaatagagggggagcgtgaggcttcccggtatcgctttagagagcaattgagttgagttttgagttagggtttcgagtttagtcaaaatttttgtaaggagtgctgttggtgcactttgtaaacacagagagaatcaataaagtcgtcatccactttaagagttattcgatttgtgtttaccgggtttcggcggtctaaccggcgatctaccggcggtcaggccatgtcacatcctgattttttgtttcaggatttataaattatttaataaattaataatataatttatattaaatgatctttaatttacaagtgaagttaaatgtgggaaataaaatttcctaaatataaagcatggatggatttaatttttattaaattctccatggttaattatactctctgaaattttctcagatttttcagagctcaattcttaaataatacaaagaacagttcagtaattatttgattctccatggttaattatactctctgaaattttctcggatttttcagagctcaattcttaaataatacaaagaacagttcagtaattatttgatcattaatgatctaattataattgttaagagcttttcttgtttaaaatccttaaattataaattgttgtttaaaaggaataattagaaatgattttaaaagcctaaaggagaagatctaattttaatttgctaaatctcaatataaaattgggctagataaaattttgttaaatactttgcttaattctataattcctagatttttctgggatttatttgagctaaggaagtatttttaataaatggaattgcatttaagaaataatttaaattgaaaaaggttttaaaaagtcttcttttggctttgggccgaaagccggcccaaaacctctcttctctctctcctcggcccagtccggcccagtccgccgagccgccgctctcctctctctctcgctgtcgctgacaggtggggcccgcttgtcggagccgtcttcctccttcggccgccgccgcccgcaaaccctagccgagccgcgccgccgtcgctttccaattccgtcgctcctttccatctccggccgaattgatagaggggaaatgatcctcttgattccctcttccttttctcttttggaatcgtcacctaattcggtttggaaactcgatggaatcgaggtcgaatcggattcttctctcctccgaaccctagctttccttcgccgtcgccggtcgccgtgggcctccatcgccgctcgctagcccctttaaaaggacccccgagctctcctctatccgccgccacctttgccttagcctgccgtcgcgtctagcgccgcctccgcgtagccctagtcgccgccgtcgttgccgtcggttcagccgcgtcgcgccgccgttgcagccgccgtcgtcagtcgccgtcgccgccatcgtggtcgtcaagtcgccgccgtcctcgtccgcttctccgccgccgcttcttcctcgtcgccggcgccgtccgttgcccttccgccgttgttttggtcaccggtgagttcgccgcgtcgccctctacccgttggtgccctccgttcgcgccgacgtgccgtcgttcgccggcgagcatgcgcgcccgagccgcccgagtcgccgccggtgctgacgtcatcgctgccgtcatcgctgacgtcatcgggatcgtccgccgtaagccggtcgtggaccgtttgatctcggccgtccgttttggatagggttgatctcggccgttcgtttccgtgagccgctgccgtgcacccggtccaccgcaaaccctagccgctgacgcaataatccttcttttccttttcaaaaataattcattatggcgtcataattcaattaaaatcaatataagtgttttaatccgatttaatctttaaaaattcataactaattcatttgaactcagtttaatgtggttcaagttgcaaaagttgtgtaaaataaagatctacattttaaaattgtccataaattgaattaaatttatttaattctttttaaatgggctttaaatagatttaatcttgtaaaattcataataaattcatttgaagtcagaatgaggccgttcaagtctcataaatcatctaaaattatgatctacatgtttgtttactttttatgtactgtttatttggtttttattagtctttttcttcattttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgttaccttgggagattataatttgactagttgagctttatatattggttcagctagatattagaggtaattgctttgccatgcttagaaacattagcacacaattgggataactaatgtttcactatcacttatggttatatttaatggtagctcacgatggtcaattgtgattggttaattaattacttgtgattggttaattaattatttgccaactaaaactggataatggtgggttgtgagcacatggttttgagagtcgtgctcatgacaattaaggaccggttcgcgagctactattgtgaaacattaaccgtgccaaccacaaaccagcgtgggcaacggctttaccttttgtatagcatggttcactgcagagcaccaggttgagaagtggcggagataagcccacgggggtcgctggggagtccataccttgtttataagggggtgactatgatccgggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagttagatttgttcagccgggtatggttgtttagaatggttgggcctgtgcagcatgggcgtgttgttcagtgttgattaaaatttctgattaattactccactgttttacttcttttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggattataccccagttgagctgcctgtgggagtggagctggagcttcgctagattttattttccgctgcagttttcttcttggtgaggactaagtgcctcataagtaagtatttatcgttctagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactctcctctctcgttcaacttgagtagttctaaaactagtggttgaaactagaagatgctgatgtgggcaacttatggaggttaagtcaagtggatcgatgaataagaaggtgatggtcgatctgaagagccaagtggtcaagatggaatgaagtttggatcctatcttagaacctatgccgccaaagtgtctttgaagaatagttagtagggtagaacgtttgttgtttgcttgtgtgtaggtatggttgcattcccatcattggagtagttcaatgatgagtgtgtaactatactaggttgtttgcttaatcaacttgaacaatataatggtctacacacatcagatcagttttaacctggttaaggtcttgtctttagtgtaacccctctccttctatcttctctaatctgcaacagatggtgaacactcgcgcaagtggaagtggaaacaataacaatgaagataacccaactcttgctcaagttctggctcaacagactcagttaatgaacatgatgatacaacagatgcagaaccagctcaaccaaggaaataacaatgctccaccgccgcagaacaagttagctgattttcttcgtgtgaggccacctaccttttctagcacaaccaacccagtggaagcaggtgattggctgcacgctattgagaagaagttggaactgctccagtgcacggatcaggagaaagttgttttcgcttcacatcagttgcaaggacctgcatcagaatggtgggatcatttccggatgaacagagcagaaggacaaccaatcacttgggtggagttcacggaggcattcaagaagacacacatacctacaggagttgtttctttgaagaagcgtgagttcagggcattgaagcaaaaggatcaaaccgtggcagaatatcttcatgagttcaatcgtctggcacgttatgctccagaagatgtgcgtactgacgaggaaaggcaggagaagttcctggaaggtctgaaggatgaactatcagttacgttaatctcccatgactatgttgattttcagcagttggttgacaaagcaattcgacttgaagacaagaagaacaggatggataaccgtaaaaggaaaatgactgttttccaggaggcacaaggtagtagccagaggcagcgtatcaagccactccaaattggtgaatcctcttccgctggtcaaggacagtcgcagcagttgaacatcggtggtgagatcaaattagagactaatgaaagcaatgaacttaacatcgagcaagctaatcagtcggtgccagttcagcaggatcagtcgaataacagtagtggaagggagcagcaggtatgcttcaactgttacaagccaggccactttgctagagagtgtccgaagccgaagcatccgcagccacaaggtcaagtcaacaacattgtcgtcacaggagccaatgcagtgccagttgcgtcttcaagagttgtgtcttcaagtgttacaactcagccaccagtttcaaagcagcagtagttttctttaaagccttagaataattatcggagtgatggaataagatagactgcagtttgcctattccctttttctttctagccgttccgaatctcgggacgagattctttgtaaggggggtagtttgtcacatcctgattttttgtttcaggatttataaattatttaataaattaataatataatttatattaaatgatctttaatttacaagtgaagttaaatgtgggaaataaaatttcctaaatataaagcatggatggatttaatttttattaaattctccatggttaattatactctctgaaattttctcggatttttcagagctcaattcttaaataatacaaagaacagttcagtaattatttgattctccatggttaattatactctctgaaattttctcggatttttcagagctcaattcttaaataatacaaagaacagttcagtaattatttgatcattaatgatctaattataattgttaagagcttttctggtttaaaatccttaaattataaattgttgtttaaaaggaataattagaaatgattttaaaagcctaaaggagaagatctaatttaatttgctaaatctcaatataaaattgggctagataaaattttgttaaatactttgcttaattctataattcctagatttttctgggatttatttgagctaaaggagtatttttaataaatggaattgcattt

SEQ ID NO: 60033 - DNA, 1797 bp, Oryza sativa
gccatccttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagctggagcttcgctagattttattttccgctgcagttttcttcttggtgaggactaagtgcctcataagtaagtatttatcgttctagttaatttgatgaatctgtatattaaattgtcagtttgtgtacctcggctgattcctggacgaggattttatgcacaaataagttcggaaattactagtgaatttccgggcgtgacaggccagcggcaagcggcggtcagaccgacagcatacaggcgggcagaccggcggcggcgacaggcgcagcaggcgatctcggcggtcagaccggtggcatccactcagtcagaccggcagatcaatctcggtcagaccgactttcttcgatttcgagggtaacttttatttccactaaaagttttcagtttttgggtataccaatcattcaccccccctctggttggcttagttcttgtgattcgatcctacaagtggtatcagagccttgttttcttctttggatttttaccgatctagagtttttgccatggctactcccgctaggttttcaactaagcctcatgttttcgatggaacggatttttctcattgatgtagtaggatgcaatcttatattatggctgaagattatgatatttggagaaaagtttctcatgcttatgtgattcctgaagctattaatactgctgctgaaaaaactgcttttgaacaaaattgcaaagctcgcaacattcttttgagtggtatttcttgttcggattatgatcgtgttgttcatcttcaaactgctcatgagatttggattgctttgagtaattttcatcaaggaacaaataacattaaagagcttcgtcgagatctttttaaaaaggagtacattaaatttgatatgaaacctggaaaagctttggatgactatctttctaggtttaataaaattttgagtgatcttagatctgttgattcttcttatgatgctaattatccacaatctgagatttctcatcactttttgaatggtctcgacatgtctatttgggagatgaaagttgcatctattcaggagtctgttaacatgtatactttgactttggattcactttatactaaattgaaaacacatgagatgaatgttctttctcgaaaagttgattctaaatcgagtgctttggtttcttcttcttcttctttggatattgatgcctcttcatctaagtcgtcttttcttgctgttattaatgccacatccgatgatcaactcgaacaaatcgaggaggaggatttggctttggttgctaacagaattgctcgagctatgaataatgccaggaacaggaaaagaggtggtccaaatcgttgctttgaatgtggttcaattgatcatcttcgttcgcattgtcctaagtttgagagaggcaaaaaagaagacaaagatggtgagaagaccaacaacaacaagtccaacaacaacaagtcgaagggttcttaccaagggaggaagatggagaatcttagaaaggcttttcaacaagtttggtatgggtattctattaatcctattaagccctagcccaggatgtcaaattggggttattaaatgatttcaaatggaaaagtcaccaaaaccaaagttgtagaactcatcga

SEQ ID NO: 60034 - DNA, 1901 bp, Oryza sativa
aatttaaattcaaactgttcaaaagaaatgttatatagaaaaatgaccaaactaaaagttgaaaatcttgataagttatacaactttattgttgacattttttccatttgaaatcatttactacccgtaaaattgttttgactcataaaatgaattattatactgcacttaattattttcctatagtcaacttacaaatataaacatttcatatgaaaaatataaaaatagtcatcggtgacgggctttagttaatgcccgatagagattaagtatatagcccgtcactaatgagtcatctgtgacgggcctgttgttatctcaaacgggcctcaagttatggcccgtcacggatgatggtcatccgtgacgtgccacaacttgaggccgagatatggaatgttatctcaatcgggcctaaactacggcccgtcattgataggtgtcattcatgacgggcttaagttttatgcccatctaacatgtctgtacgaccatatctcaatcgggcacttttcggcccgattgagatgactttcttatgacggcccgctatttctaagcagattagagcccatcacagatagaaggatctgtactagtgttaacaaatcataaattaccatcctactgtggtttgtcttaaaaaaccgacaagcacaacactaaaatccactataatatatatatgttgctttgaaagtatggtttctgttggcattaaattaactaagaatgtttatagtcaatctatgtatttatctaaccatgatcgatcaaacaggtacaaaatagccaaggacattagatcgggtctgctctacctacatcacgagtgcgacccacatatcctgcatagagacatcaaaccaggcaatgtactcttggatgaaaatttcaacgccaagctcgccgaatttggcctatcgaggatggcaaaccaagacaatgcaacgttgctgacaactgccataggctcggaagggtaccttgatccacagtgtctgaaacacggtaaggtcccgttcaagcgtagctcagacgtgtacagcttcggcatcgcccttctcgagatcgcctgcgcaaggaggcacagggagcaaatctgggacctataccgaagaggtggcaatgttgtcgaggcggcggatacaaggttaaccattggtggtggccttgatatgagagagatagagcgtgtcatcgtattggggctctggtgctctgctttggagactcaacaccgcccttctatgcggcaagctatggatgtcctggagcgtgacggaccgttgcctgcccttaacagcttgatcgtcgtcaacactactttggcatcaacgacagaggaagacgcctccagtgcgccggcggcgggcaatcgctatgactgtgatgaggcaccactgctgattgaagggtagcagggtgagccatgcatgaccttaactgctggacaatatctcgtaagcaagcacgcatgcatgcttggttcttacaagagctgctgatcgagtgctgagtgcaaattctcatgttgtcactttattatgtaattgccttctttttttaaaaaagaaaaacttgcacggggaggctctttatggcacgagggagcaacggggaggccggggagtggctgttttggggcggcaacggccggcgacgtgggcgacatcttgggcgaaatggagctccatcccggcgtgatttttgggggaaacgtgaggagagtgtggaggaggtggaggggttgcggttgctctcggtttggatgcgagcgcgcgagtgagaggttgtgaaaacggcggcgtcgtgggcggcatggcggcatggcgtggttgggcttgggatggctggggattggggatggcacgtggggcccatgggtcccacctgtc

SEQ ID NO: 60035 - DNA, 1369 bp, Oryza sativa
agtgcctgcgaccaaggtctcgaagagcggagaaagcgatgctaagactaaaaagattcccctagatccttctgatcccactaaaactgctgtaataggcgccgagttagattgtaaataggaaagcgcgctcgtcacctttcttcaaaataataaagatatctttgcgtggaaaccatctgatatgcctgatattcctagagaggtgattgagcactccttgcacgtcaaagaagacgctaaacctattaaacaacgactccgccgcttcgcacaagacaagaaggatgcgatcaaggaggtattaaccaagctgttagcagcaggcttcattaaagaagtcctttatcccgactggctggctaacccggtcctagttcggaagaaaactgggcaatgacgtatgtgtgtcgattataccgacctcaacaagtcttgccctaaagatccttttgggttgcctcgcattgaccaggtagtcgattcgaccgccggctgcgagctactcagttttttggattgctactcggggtatcatcagatccgactgaaggaatccgactgcttgaagacttcattcatcacgcccttcggggcctattgctacatcaccatgccattcggactaaaaaatgcaggagcaacttatcaacgcatgattcagagatgcttctcgacgcaaattggccgcaatgtcgaagcttacgtggatgatgtagttgtcaagactaagcagaaggatgatttaatctcggacctagaagaaaccttcgcaagcatccgcgctttcaggatgaaactaaaccctgaaaagtgcaccttcggagtaccgtcagggaagctgcttggttttatggtgtctcatagaggcatacaagccaacccggagaaagtcaacgctatcctcaacatgaaaccgccaagctcccagaaagacgtccagaagctgactggatgcatggcggcgctcagccgattcgtttcacgacttggcgagcgggggatgcccttcttcaagatattaaagaaaacagacaatttccagtggggacccgaagcacagaaggctttcgaagacttcaagaaactcctcaccgagccaccagtcttagcctcgccacacctacaggagccgttgctactatacgtatcagccacctcccaggttgtgagtacagtcttggtcgtcgaacgtgaggaagaagcccatgtccaaaaagtccagcgaccgatctactttgtcagcgaggtcctagccgactccaaaacgagatatcctcaggttcagaagctgttatacggtattctgattactaccaggaaattatcccactacttccacggtcactcggtaacggtggttacatcg

SEQ ID NO: 60036 - DNA, 2334 bp, Oryza sativa
acgcagcctgtacgaaggtgccctcaaagcactgaacgaaattaagggcaaccaattacaatcttctgttaataacagcgtggaaggaaagaagaatctcgcccaactcctaatagacaaggagaaacagcccaaacccatgaggccgatgaatatcagcaactggaggccaggatatagtacccacaagtcgaggccagaactcgcaagtgctcttttcgaccagaatataattctctctgacggaactagcttcgccttggcgctgctaagtcgggtaatgaaaatcccaggagaaaagtccaacattacgacgcccaaaaccttcagctccgaatcccctggcttcgataggtataaaagacttaagcagttgattcctgaactgaaaaaatgggacaaggaggacttctctatgtcggaaatgctggaacatatcttcatggcatgggtgcgtcttctgatgtttgcgtcggtccgatgcacaagggattcccatgccaagcagctcgcctgtggcggcgagctcacaaccatcctctggatcctcaatgaacatgctggcgtatttcgcattgatcacagggatggcaaaaagaaaaagcctgaagagttcttttcctactaacatgctggcgtatcatatttcgtatttcgtactagtgtatttttaactgcagcaaattgtttaggactccatctcgatattttgttttccagtgtaactcactttgtatttgcagcgttatcaatgtatgcacaaggaattaccgtgccgggagcccgggacaaaagtttctgtaagattaatgaaatttcgaatggatgcaaaggttagttaattaaaacaagtaattagcaaagttttaaacgtgaacaattacattacttagacttcgataatcgcaagctatagatgtgaaatatatatatctgaggaagaagaaattcaatattagcagctttaattagtatggacatttaatttttcagcgaaaagtagccatatatagttgaacgaaactacatttggtggcactctgccaaatcaacatttctttttcatgtattcttgaagttgccagctgattgggccgacttcgatctgggatccttggaaatttaacagaaaagttgccatatatagttgaacgaaactagcttttggcgcatgttattagttaacaacatttacccgctgccgtcacatgcaggcacattgagcaagtcacgaggtactatctccgtcagccgccaaagacttggtttatctgccgtcgttttctcaatttcatgcgttactatctccgtcaatatacccccgctccgccccaaaataaaacagaacattttatttttaaaaaagtggatacttgtaaattgtattatttaatattatgcctgtcaaatcatttgattcatataggaaagtattttcgtgatgctaattttgttgttgttgataatatataatgcaagaaactaaagttcactataatattacatacgttagggtcgtcgtcgtcctccgtcgacttcgctaatttgattcgcatgaatttactacaaatgaatattagtatgatattttatgtgtatggatggaaatatatatgcttgtctaggccagatcttattatttagttttagatgtactccctccgggttgataatacttttcgttgataatacttttcgttttggacaagagcacggtctccaaaaataacttttacaactattttctattataatttatattgaaatatcaataaatatgtgattttattgaagtactttttaagactaatctatacatatagttttcatatttgcaagataaatattttaaaaattatttatagttaaagattttaaagtttgactttacccttattcaaaacgactaatattatcagtccgaagggagtatatataggggtataatcacttaatcaggaaacgagggttaaagactaatattggcagcccatttttgaccgaagaaatcgtatggccgccgaaaacattatgttttcttgtagtggtttcagctggatggcaaatgctgtttaatttacacccgatgtgttatcgagttccttatcattcaatttgagctctgttctgtaggtactctcgtcttcttcctcaccttgttttggcggcatcgcgcttccaacatcacctgccgagcatcgtctggctgacaaaatattttccagctgtgggattgtctagttttcagctacatgaaaatgtacacatattgacttttaaatggctaggaatacaccaagattcgtgcactacagtaaaaatcgatgctcgaga

SEQ ID NO: 60037 - DNA, 2094 bp, Oryza sativa
aggatggagaggatgcatgcacaggatggagataagggaggagaagaaaaattgataaggatgggagatggagagagagaggggctgtgcatgcacaggatgcagagagaagcgccggagacttggtgcgcgcgtgtgggtggacgtttttcttcctggttgttaaacaaccgggacaaaaatagatctttagtcctggttggttacagaaaaaatccacaagcatacggatataccattatagcatttcacccgggagtattccagggtatcgtatttatttaattctaagggaagatattgaaagagagaaccatgctaatgattatatacatatatattacttgccttcatcaaagcctagtaggggttaattcagcatatgggtagagtgacacgaagcgaagcttttagattccctctaataatgatcctaaactaagtagtcgcttttagattccctctaataatgatcctaaactaagtagaaggagaaatagaaaagaactcaattcctatacttctaatatacactcaatctttagtctacaattgctagtatacaatcatgtggccaatatcccctaatagtgccctcctggtgtttcgagagaccaccctgggttgccgaattccttacgacaacctgtcatggccgtccaaccggggctaaatacggaggaatttgtcttaggaatatatactatcgtggaggaagacctgtactgagctatcatcatcagcggcccacctctacagatccgtagcatatatgcccagataatgatacttattaatctaagtacctcgtttacattaataaataccactctgggaagctaaccatacaattaatacgacacaaatgtaaagtaaagccgatactcagactaaacaaagtaccgaaagtatataaagaagaatatttcattaatgctggaagtcttacaaaagccgatagaaaagatactagagccatacccgaactctttcgaagactccgaggactccgaaaactattctattctactttagttagcacaaaaactactaaataaagtgtagagagaaatcttgagcttgcttgactgtgttgagaagtgaagtgagctcctccttttatagggtcggtatgacggttatggagaaggcaaaatgtcctttctgcccctgaaccgtcattggcaagtgatcctggatgaccatgtgtagggccagccggagccacagctgccaggggttcggccgaacctgggtcggcccagcaggcccccaagtacagtagagtggctgacaggtgggtcctcatgatggttatggtagttgatgcagttttcaggacggttacacctatcatgtgggcccatcttatccatatgcttgcttaggagtgagttttcctcatttcttctcattttatttgctcagtacatgcaacaaattattctccaagtacaagtggaactaaattatttcaaaacaaaatatgcattatgagcataaccaattctctattattttagttatattagcggtcgaaattggtctataacgaccgtcaacagggatcaattttagatgaattttgcaagttgaatggctcaattcgttattcatatgaactatatatgaattttagaaattttgagccatttaaatggatttctggaattattatcgatttatgacgcaattaataattattttacaaagggaaaagccgattgctgatgtcagcaaggggagaggtgtggaccacatccacaaagggcaggccccactagtcagcggagccaaaggtgctagtcgaccgtggaccgagtccacagtggcggtgcacggcggaagggtgggttggctcgctagccaacccgactgggcggtggcggcgccagcctgacgaccaccggcggcaacaccggctgtgagtggcggcacggggagcggcggaaggaaccgagaaaaaggagatgggtgctcaccgaggggcacggagatggagggaggtggctggcagagctcagggcgaaggaaggcagcagcgctccggtgatgggcggcgccctggaagaggcggacgggcttgccctcgat

SEQ ID NO: 60038 - DNA, 822 bp, Oryza sativa
catatgggtgctggattttgcaaccagaacctttgagttctctcaaaggtgcctttgaggtctcaggaatgaaaagaaaaaaaggccgggtcgttgcatcagcttgatcaagccgatgcatcgggcaattagtccccatcaccccaaccatatttcatcgcacttttaactacatttaatccaagaaaatacaagaacaataagaacacaaaaacataaacataaacaacacaagcaatgtgaaaggaggggagggcgctaccgcctcctcccctcccgccgaatctgacggaggggagggcaccactgccgctgcctcccctctcgtcgaatttgttggaggggagggtgccgctgccacctctgagtcgctgggccgccgcagcctccccttctgccggatttggcgaaggggagggcgccaccaccaggtaatgcggtggagagagagggagcaagagttagctgagagagggggagagagagagggataggggaggaggcggagaggataagggagaggggtaataaagaaatagagcaaggggtgatcaaaagggagagatattggtggaaacaagctgtgattcggcttagtcgggtggttttcttaataagtgccattatttcataaaactgacacctacattataaatatagttatcggtttttaaaaaatcaggacctatgatatattataggtgttgatttttatttagaaccgacacctatctctcaacaaaggtaccggttctagccgatggtgtgtcatggatgcgcgttttggatggaaaaagcaagataggtgacggttttagcatt

SEQ ID NO: 60039 - DNA, 1822 bp, Oryza sativa
tgcataagtgcttggaaaaaaaattgaatgacttgtctcataaaaaactttagaaaatacctcacatgatgatattctaatgaaaaaaatgcatacgagtgaactgtggaaatttgatgtttcaattggcataatactctgttgcacattttatgtttagatctattttttaaatttttttcaatattttagccattgggacttgacgtttcacgtggctgttggtgttgcaatcactattttttaaaagttgcatttctttgaagagttttatcaagaaaattgaaacatttgagccagtgcagaaactatttcctacatgtggtgaaagcacctgattcttaggataaattagccatccaatctttagccatgtgctgaactcttgttgggcctgaatatccattacagaacacactagaaacgggttgtgtcatgtgttaatcgcaataactaaattattaaattttgtcatattttttagcaattattgctgccatgttttaatagattcaggctactaataattatccaacaaaactaatctaaaaaaaggaagaaaatggtaaatgtcgatcagctaaaagtaatgacggctcgctgtgttcaccacctgtagcaatattttaactatactcccttcatctcaaattttaactaccattatggttcatatgtagtacgaatgaagcaatattttgggacggaattaaggagtatacaggtgcagtaccatgaatacacttcctttcttatcatgtgaaacctcgttccacttgttctctcttgataccaaaacaggtcgccctgtaaacatcatgccccaaccatcgacattacctcctacctgtaattaagggcgtcgcataacgatgaacacatacgacaaaattgattgctgcaacaactcatgctctgcaacttgtttcatggcctacctagttgcaacttgcaagtgaggaggtggatgtgtccttggccatgtaccgcatgtatcccatgtatcgaacaagtgaggaagaacatatccccctatgtgttcgatacatgggactgggaaccatcttcttcacacggaaaacggagcggtccattagcgattgattaattaagtattcgctattttttttaaaaaatagattaatttgattttttaagcaactttcgtataaaattttttttgcaaaaaaaaaggtacagtttgaaaagtgtgcgcgcaaaaaacgagaaaaataggttgggaacaccctgaaacgaatgctattcttccctctactttcctaactcaggccctatttacttcccaaaacataaattttcatgttgtcacaatgaatgtttgaacacatgtatggagtattaaatgtaggaaaaaacaattaccagaccctaatggggtttcctgacagaatctataatttgtttcattattatactacgtttaatactttaaatgtgtgtccgtatatccgatgtgaaaatcaaacctaaaaattttcccgaactaaacaaggcctcacctcattctttttacccgtgcacgcttttcaaactgctaaataatgatattttttttcaaatattttctacaggaaacttgctttaaaaacctatctatatatctatctatactaatcgggcactttgaaagagctctcactttaatcagaaaactccgaccgttggttaaatgagccgtagcatcagaacaatgaattacaatctaataatctataacgctgttggctaattaagtctttaaacgtgatgccgtgatgggctcttttcaaagcccatatactctccaaccatgctcttttat

SEQ ID NO: 60040 - DNA, 802 bp, Oryza sativa
taccgccatagtacctcctaggcatcttgccaaacactcgggaagtatttcttcaagtatttcccgttgattgcccgctgaaaacgctccccttgaagtgtctccaaaaagtatgcgttccctcgaacaatgccgcacactcgataaggaccttcccaactaggagaccgcttaccgaactccttggatcgagtacccaaaggcaaaattgtcttccaaaccaagtctccaacttgaaacaattttgctttcaccctcttcttgtacgccttggccaccctcttcttctctttttctatctcttccaatgccttcaagcgcttgtcgatgacttcatcaaggttgtctcccatcaacatcttgtaatattcacttgacaaatcatcttgcttgatataatgaagagaaccaagatttacctccactggtaaaacggcttctcgaccataaaccaactcaaaaggagtgactttagtggcaccatgtttagatattctatgcgcccacaatgcttcagaaagcacgtcatgccacctcttcgggtgttcctcaatcttcttttttactagctttaacaatgttttattagtcgactcggcttgtccattagcctgagcgtagtaaggagaagaactcaacaatttaatgccataagatttggtaaaactcttcacttccttagacataaaagaagcaccttggtccgtagttaatgtttgcggaatactgaacctatgaataatatgctttaaaataaaatcaattacctccgtatgagtcatattcttcaaaggcacggctt

SEQ ID NO: 60041 - DNA, 3572 bp, Oryza sativa
ctaatgctgatgataccaccaacaaccatggttcttgccccattcatgaccacttagatcaagcgtgcaatgtcaacatcattcaccaagatatcgacgatagtatcaatgaaggcacccagaatgacaaccctagcaattttgactctgggaaggactccaatggtgatagcaataatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccgtacctgtgaggcctcatgttaattctaacccatagtagatacaatgtaccgatgttaagcaccgtccctttttgtttaaggcagtgccccgtattcatgtaatgagggagaaatgtgtaatacagacaagttccatgaggattcgtttgaaagatgcggatatgtgatcatgtgtataattggttactgacaaaggagacctagggtctcgtgtcagaggaactatattctaacctcgagttaatagccaacctgtggatggaaaagaaaaacaattaaactgtgttgggttaaaaagccaacgagacagtagttgaggataggagtttggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagcttttgacgagccacatcaaggtttcactgaaaggcagcaagccaaaggacctcatcatccccagaagcgtccgcaatccacattcaagaataccacctgttagagataagccgaaagatgattgataaaagagattggcaaagatgttctctagcatgaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctatgaaggcaaggagtgaaatcttcaactcggtatcagatgctacacgaagtgaaaagtgcaagcaccggttaccaggtaatgccaagtcttgggagatgatccaatgggaaagaacacatcaaggttaaaagtgtaaaggaatacgttgaatgctaactgaggacaacctgaagataataatgggaagtaaactgaatgtaaagaaagtgaatccgagctgcttgttcgtgagagccattcccagttatagaaccagtgatatgttcgaagatagtctatagaggtcagattaaaatcacctctcacaacgaagcctcagatttgacagggtaatgattagacaataacaaatccagcagtaaagccatttgggaagacgtcaaagtataacaagtaggataagttggctctcttgggaagcataattcaaaggtaaagttatcgacccttgcatcaaatagcagaagtagctatcacccggagaccaggaaagctaatatgagacagttgatggcgagttagaagcaaatgacaagcatggtatcctagtaatgacaagcaggttacgacgcatgacatgaagttgataacttgtccgaggttgactccgaagatatgaatcatgagaagttctggaacggaagcatcactgaactaccgcaacttagtctgagtcagccaaaaggtgcaccctggtccaagtcaggtgaagagaagattccatccgcaacaggaggtcaagccaagcagttccgagtggtaaagttttgctggaagttcgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcaccggaaataattattaagcaacaaaaacaattattagagtttattaaaaagaaaaacctaaaaataaatcctcttcctcctttgggccaagcccagcccaaagtctccctctcctccctctctttctctccctctccttctctccctcctcctcttgggcctcatcccctcctggcccagctccctcccttcccctcggcacagctccctcctccctctctctccgggctgcctctcccccccctcccctcccggcctgcccggcccaggccgcctccccctcctcttctcctgggccggccgcccggcccaacccgagcggcgccctcccgcccgtgccgcgcacgtgcgcgcgcgtgcgcgccgttgccgcgcgctgaccgcgcgcccgaccgcgtggggcccacgcgccaggcgcgtcgtcttcctcccgcccggcttctctctctcccgtgcgaaccctagctcgctccctcctccaaatccgcttgattcaattggccaattccaaaattaattggggggttttaatccccattgaatcctcttcaattgcccccaaattcccccttgattcgtgccttcaatccccgggaacggacgcgccaagtccggccgctttccatggccgtcggccgttattcccgtcgccgttccgccctctcccgagcccggctcccgcccccaccctataaaatgggatcccctcactccgttctatcgttttaaccccatcccgagcctccccgtggtccctagccctctccccgccgccctcctcctctctctcccacgccgccggccgcctccagccgcctgtgccgcctcgaccgtgcgccggccggtcgcgccgtcgcctcctccagcgtcgccgccacctcctccaccccggcctgccctccgtttcgcgcggtgaccgccggaggcgcgttcccgccgtcgcccttctctttcctccgcgccggccgcctccagccgcctctccctcctcgccggagcgccgtccggccgcgccgtcttctccctcggcctcgcagccacctcctctccctcggtcagccctccgtttcgcggggaaagcaccggagacgcgtcctcgccggcaaaacagtggcgttgtcgccact

SEQ ID NO: 60042 - DNA, 1432 bp, Oryza sativa
ttcaactgagagggaccttgagccaaaagtatttttctatgcccttcaagacctcaaacaaaggatggcatgccaactggttttatgtccaaaatcccgagcccgctcttcccgagtactcctgtcttcccctagtataccaagataattggaactcactgcccatgggagatgaagctgcccaagccttagaactgatggagcgcatgctgaagctcaaggagcaaggcttgcagggagagcaaatcactcggcatttcattaagtgccgattagctccaatcaaagagagatcccgcacagctttcgagtttgatggtaaacatgatccaaaccgtgaagacccagattctctggacttaagatcatgaaggagaggatgtacaagatattctcaaacgccatcgttgtcagttatttgcatctgctgccagtcgtgccatataatgcattcaacccatctccgctggtatgtatcagaactcttcaaaccgcgaccaaaacataattttgtcttcttgttgaattaacagaccgtggaggcatttcattcaggaatttgctttgatgaagtctgaccccccaattgctcaacgccgatctcctcgtcatcagaccgttcaggggagtggaggaccaaaaatcaggtcagactcccaatccaaaactcccaatccgactgggcaatcagattctcgcaagagaaaacttgtgctaagcgacgacgaaggcgacgacaataataaatttggggataagggatcacccaaaaaactaccaaagcacactgctccgaagaagaaaaagttcagaaaatcctccaggtataaaccattcggtaccatctcacttcgacatgcttctctcatgaagataatattgaaaactggaagaaaacttgcaggaaaccgtctgacatagatccatccgggaaggactctgatccagctaacacagagacaggttcatccaaagaagctgggccgacttctgaggaccacccgactggcgttcagacttcaactgattatgtcaacccaagcgaccagcccccgactggaaaccagttggcagaagcggaaactgcaacaagccaagagcccccgactggcaatcaatcggaagtaggtccagatcaagaaattcctgaagttgaagttcaggctacaacttcccaaggactggacgctggtaacgacccaacgcctgggtccccagataaagggcaaggatcgcctcacgctcaaccggaaattgcttcaggtaacccatcttctcaagtaatgccaatctgaataactccgacttgcttgtctaatgtttgggaatacatcaggaccactaggcggtgacggagaagaaatccctcgcataaaggcaactactgattctcgtccccccatcttaatcaaatggtgggacgacaacttgc

SEQ ID NO: 60043 - DNA, 7888 bp, Oryza sativa
ctcgaaaaagtagggggactcacacgcaagaaatcttgccaacttgttttggggaggtgggggtggattctggttttgattatttgcctgctgattctgtgcctgctgcactaacagattgatcagttgtgtttgttgagccaaaatctgagctagcgttgggttctcttcattgttattggctccacttccacttccacttccagtgccagtgcgcgtgttcaccatctgacgacaagcagagacaacaaggaaagaacgacagagagacacccttagaacggagttattcaattaatttaaattctatattgctcttaactgtgtatgattacatttaagttgcattaacactacctcaccaactttcttacactctgacaagcaaaagaactagactcatgctgttacatcccacccatgatgtaagcaacaactaaaacccacacactcacaaacaaacttaagcaagcaatctaacacagcgaactacggcaacgatctaactaagcgactaattccgccttgcgtcggaacgaagcgatgaatcttcttcctctggagtagctggctctctttcttcaggatcttcctcttcttcctcatcactaatgatgtcgatgacaggctcaacacgatcgggcacagcttcacccatcacgcgaatcttcgaagctaactggagacgagggggcggacaggttctctttcttgcagtgaggcgaagctaggatgttggcggcggcgtttctcctttaagttcagctaattccttctgtaggcggtacaccttgctcttcaacttgcaaatcttgcctcgattccagttttccctgtcatgagctgctttgtctcgctccacacttactgcatccatagcactaagcatatgcaccgcatgcatcagagtggcactctcttcaccatcaggacaggtataggttccatagtcttgaccatgaggcttgtggggatgatactggaaagctgatgaatccaattcttcttcaaagtgttgacgcaactctccaatggccaccaaagctgcttcttgacaagcatggcagtacgatcttcctccagcttcgaacttaaaagacggaaggtcttcactatcactagccaacgtcacacgaacacgacatttctcctcgtcggggtcatgggaaatctggcgatactcgggagcaacttcataacctacttcaaaagccatcaacctcagctccctgacgaatcctaacacctcgatcaaatttcttggtgaatggcgaggcatctaaagaaacatagaagagaagaattattgcatatttttctaagttagctgcaccaactagacttaactgattttgaccaaagaggaaggaattaaaagagaagacacatacaaaaaccattttataaatatattttttttagaatttaactttttggacagagacaagtatatttttttttgacaaataactaaaataaaactaaaatacttatgatctattataagcacggtacagtgtcaccataaggaagatgagtagtactagtgctaacatgattaaatcgataccataataaatgtacagtgccgactaatcaatgaaatttggtaaagagaaagaaagaaacattttgagaagagcaaccttttgcttttaaaagaaaagaaattgagtttcaataaattttgtgcataaccttgcatgtgctgccaacttaattaatttgtaagagaatagagaagagcagttctatttttttcaaaaatattttgaaggctacttaaggtttaccatttagcttatcctaaagtcaaggtggctctgataccaacttgtcacgcccagaatttctatccaaaattccaaacgcttacatgtgtgttaagccctcgtccaggaatcaaccgaggcacacaatgacaatattgataatagagtacaaatatttaactatggaatattcgaaaataataaattattacagaggtggatagttcctctcaaacaaaaataacattctacgcagcggaaaataaaactatggcaaactacggaacagcgatggcgactctactccgcaggcaacttaaccaagaacaggcctagtcctccagatcatcaccttcactgaagtactcctcttctgatgaatgaatattgcaagaatgagcatataacatactcaacaagccacacagcaaatatgcaagtgcacaggataacaaaggatggcataatatagctcatttgcagaaaacagcatttaataaatatttaagagaatagtaaaacagttgaataattaatcaatattaaataaacaccatacaacacacccgtgttgcataggcccaaccacatttgaacaaccaaccccaattgaacaaattaaacctccaaaccaggaattagccattccagaccaggaattaaatcaattacaccttttcaccaataatgagtagtgtgagactaatcacgaaaaacattgctcaactcacccataaccgcgggtacggctattcgaatagttttaaactctgatcagaggtgtaccactgtacccacaagacacaaccccacatcatgtcaccatgtgcctcagtaccaccacgatacctcggaaaggagtcgtgacaatacccctcgcataacacaattcaccacagtgcaccgtacctggatcataatcacccccttataaacaaggcatggactccccagcgacccccatggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgatttaccatcgtgagctaccattaaatgtaaccataattaataataataatgtaacatagtttataattaatcccctttagttagctaatgtttctaagcatagctaagcaaacttacatatagcatttagctgaaccaatccaatatataaggttcaagctaatcaatttattacccaaggtatcaaggaatagggcattcaatgcaaattggctataacaaaggagtaggttcacaccacccggtgacattcgaaaataaatgcacagttgaaataaatagagaatttaaatataggatcaacatgctcaaagggttgtggttaggatctgtgtgacttgccttgggcttccacaaacgcttcggaaccttcctcaacggaaacgctctcctccggaacgtcggaaactaaagcaaataaacaaaatcaacaaaacagtacaaaaacaagcataaacagtacatgtggatatttttaacatgtagatcttgattttagaaaagtttagaaacttgaaccacctaaaacggatctacggttatttagttatgattttccgaagttttaatctattagaaaatcgagaaaaaggaaaaagagagagagatgacgtcagccctaaggatgatgacgtcagcccttgcgatgacgtcggcatgacgtcagcacgacggccggctcgggtcgacgagctcgccggcgttagggaggttggcggcggaaacggagaccatctacacgtagaggacaacgagacgaacccgttggtactcaccacgacgagaaacgatgcacgacggcggccggcgacgagaaggaagacggcggcggctcgggtcgacggcgacgagcgagctccggtggtcggcggcaggaaagaaggggcggccgagcttccttgcaccacggcgcacctcttggcgatgacggcaagcgacggcgacggcggagacggcgcggcggcgttgccgaagacggccggcgacggcggcggacttggagagcgtcgcggcggcgctaggaggcacgggaggactcgggagagggggcaaacggaagaggagatcaaggggaagctttatatgagctcggattgaagagatcgagctccaaacgggaggaatcgaatcgggaagaaatcgaactcggttttagggataaaagcaaaacgaactcgattcggacccaatcctcaacgattctctttgattattgggggaaaagaaagaggagaacgagaggaacaaaacccctcaaaatcccaaaggaattgggctcggatttgggcggaatcggagcgggaagcggcggctagggttcgggctcgcgcggcggcggccggaggtcggggacggacttgacaggtgggccccacctgtcggcctccgtgagagaggggcgggcggcggcggcttgggccggcgtgggccgcgcgcggggagagagagaaaagggagagttgggccgaaaacggcccaacggcctaagagggggatttttgaactttttcgaataaaacaatttgtgaaatgttgtttcaattattaaaaatacttcccttactcaaataattcccagaaaattctagaacatagaggagcaagcatagtatttaataaaattttatctagctcatttttatgttgaaaattttcctagaaaattagggtttagcttgtaggcttttaaaataatttctaaaaattccaattaaaccacaatttatatatttaagatttttagggtgtgacatacacgaagccaaagaacttgctaaaaagacagagcatgaactaagggaccggattacccaactccaggattcaaactttgaactgagtggctcatcaaaaggtaacctcaagatctgccccattaatttgtgttgttataatcgtatcctcaactatctggaatcaaaacagtgcaagctgccaagatagctcaactggagaaacgaattcaggccttagaaagtgtcacgtcctgataaattcatcccaaaataaaaatcatcttctaaaaggaataatagaattaattaaaattcgaaaagaaattggcaaacactaaaatacgtacaagaaaaattcaaatatggcccggagaatttttgttaaattctccttggtctaaaaggagccctcaaattttagtggaattttcagagcacaaataataattgaaaagaaataaacaaagttgaaaaggtttataaaaagaaaatcctaaaagaagtcttttccccctcctcctcccttcttgggccggctcggcccattccctccctctctctctctctttccccccggcccatcggctcctcccccgtgcgcgcgccgctgacaggcgggcccgcccgccgctctcgctgacgggtggggcccacctgtcatcgccttcctcccgccgcgcccgccgcccgcccgtgccctagcgccgccgccgccgctgaatccgccgcatcccgctttccccgcgcgccttaatgaggggggaattactccccgcgtttccctctcccgattcccccccttttccctctctctctccctcggattcgtccggattcatcccgcgaagttcgccggcgtcttcaatggcggccgaaatccccgcggccggtttccttcctcctcggccgccttctctcccttccgacgctataaaatcgttgcccgagctccgctcttccgtttccgccgctcgccgctcgctctcgccgtcgatttcgtgcccgcgccgtgctccgctctctccgccatcgccgccgagctccgttccgccgccgccgccgctccggacttcctccttactcggcgacacctccgtccgcttcgccgagtggtcgccgaccccgtccgccgctccgcttcgcccgtcgaccgccggagcaccgtcgtcatcgtcatcccgagccgcgccgccgtcttcctccgctctgtccgccgtttccaccgccttcgccgtcttggggtgagccgtggaccgctccgttcgtttcccccttccctcctctctctcgggtgccgctccgccgcgccgttggtcgccggcggcgaccatcggggcgcgggcgcgccgctcccgtcggccgtgccggcgaggccgccttcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctcccccggctgacgcaataaataggattttttaattgaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgtaaaagcccttttcttttccgttggtcgtgtagacgctgcagcttcggaagatccgcttttcgtggaagtcgaagccggcgtttgggaaagcgagcaaggcaagtcacatcatccttgagcatattgaaatcccagtttacaaaattattttaatttaaattaatgcattatcgctttatttaaattcccgcgttatcactgttttatttagccatgcctatttacctttgttatgaccttacttttattgttattgttattattaccttgttcaccctagaataaacaaaaccccaactagtgggtactctattcctggttccactagtatgaatttaggtagatgcttcgctgattaattaggcaaccttaggtggttttacaactttagactttgggaattctcatatcatttggacactatggaatggttggcttatgttggaattggacacacacctctcttcctctttcaaaacccctaaaacctgtttttggtggggtttgggtgcatgccagttgtgggaagtagcaccccggccactataaggattaagctcgggcctctgttgcaaagcactaccgtacttccacatgtctaatgggtaaggcttagtttgtggctcagtctaatcataaacaaaagtacacggattggagatggatgaagtcgggtgtcgatggacatactccaggacaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtttatggctaggatgggttgggaactatgtcacgtcttccgtccgtataccgtggtggtatgtggcacgtgtttgcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttataaaatggctttgggcaactaagtgacttttaaatgctgtttactgcaaaccttaaaccctatattattatccccttgtactcctttgcattaattgtgcatctccggtgtggcttgctgagtactgtggttgtactcattcttgctcaatccttcccctcttcagtaagagaagctttggagaagatgtcttaggtggagtcctggcttataccc

SEQ ID NO: 60044 - DNA, 3126 bp, Oryza sativa
aaacgaactcgattcggacccaatcctcaacgattctctttgattcttgggggaaaagaaagaggagaacgagaggaacaaaacccctcaaaatcccaaaggaattgggctcggatttgggcgcaatcggagcgggaagcggcggctagggttcgggttcgcgcggcggcggccggaggtcggggacggacctgacaggtgggccccacctgtcggcctccgtgagagaggggcgggcggcggcggcttgggccggcgtgggccgcgcgtggggagagagagaaaagggagagttgggccgaaaacggcccaacggcctaagagggggatttttgaactttttcgaataaaacaatttgtgaaatgttgtttcaattattaaaaatacttcccttactcaaataattcccagaaaattctagaaaatagaggagcaagcatagtatttaataaaattttatctagctcatttttatgttgaaaattttcctagaaaattagggtttagcttgtaggcttttaaaataatttctaaaaattccaattaaaccacaatttatatatttaagatttttagggtgtgacaaacctaccccccttaaacagaatctcgtcctcgagattcagaagaactagcgaacagatgaggatgagctgacttcaattcatcttctcgctcccaagtggcttcttcttccgaatgattactccattgaaccttgcagaaccgtataacacgattcctggttttcctctcacttacttccaaaattctaactggcttctcaacataagttaaatcttcttgaagctctatacgatcaggatctgcttcctccgtaggtactcgtaaacatttcttcaactgagacacatggaacacgtcatgtattcccgccattgacggaggcaactctaactgataagctacttcacctcttcgactcacgatcttaaaaggtcctacaaaacgcggtgctaatttccctttggtttggaaacgatgaacacctcgtaacggcgtgacccgaaggtatacataatctccttcttcgaaaaccaaatctctgcgacgattgtcggcatagctcttctgacgcgactgggcaacgcgcaacctttcttggataatcttcactttttcttccgcctctcgcaatatgtcagtcccaaaaacttgacgttcaccggtttgatcccaaaggagcggcgtacggcactttcgaccatataatgcttcattcggagacatttgcaaactagcttgataactatggttatatgagaattccgcatacggcaaattcttatcccaacttccaccaaaatctagaacacaagctctcaacatatcttctaaaatttggtttactctttccgtctgaccatctgtttgagggtgataagcagtactgaaattcaaacgggtacccaattctgattgtaacttctgccaaaacttcgaagtaaactggcttcctctatctgacactatcttcttaggaacaccatgcaaacataccactctggccatgtataactctgcaagcttattccccgtgtaagttgttttgaccggtatgaaatgagcgactttggtcaacctatcaaccactacccaaatagaatcatgtcctgccgacgttctgggtagaccggttataaaatccattcctatttcttcccacttccactctggaatcttcaatggttgtaacagaccggctggcttctgatgttctgctttgacccgctgacatacatcacatagagccacatattctgctatctcacgtcgcatactggcccaccagaattgtagctttaagtcttgatacatcttagtgcttccagggtgaatggaatacaaagtttcatgtgcttctttcatgatagtatccttcaactccttattctctgggacacaaattctttctcctaaccacacagttccttgctcatcttctacaaaaccgatggctttaccccttctcatgttcttctttatttcctggatatcaggatcattcacttgagcttctctaacttgatcaaacagagtaggtttagcttctaatgcggccacaaaacctttactgactattcccaagttcaacttttcaaattcttggcacaactcccaaggtaaacgttgaccttctgacatattacagtagcttttcctgctaagagcatcggctacaacatttgccttccccgggtgataatggatttccatatcatagtctttaatcaactctaaccatcttcgctgacgcatattcaaatcaggttgagtgaaaatgtacttcaaacttttatgatccgtatatatttctgtacggttaccgaaaagataatgacgccaaatcttcaatgcatgcaccacagctgccaactctaggtcatgcgttgggtagttattctcatgaggacgcaattgcctagatgcataagcaaccacctttccttcttgcatcaacacacaacccaaaccgagtcgggatgcatcacaatacacttggaaacctttcctcgaatcaggcaaaattaacacaggcgcagtcactagccttttcttcagtacttggaaacttcgttcacaatcctccgtccacttgtacttcacttccttctgaagtagacgagtcattggtctggcgatctttgaaaagttctcaataaacctgcggtaatactgtcacgtcccaaaacgactctaaaatacatcctcgaaattatgcaaagaataagtaaaatccatgtgaaagcctccaacaattaaaatgtgcaaatgtaaaagtcaaataaggcttggaggatttttgtatatttcctaaaagcctaaaatgcgtaaataaattttagtggaattttcagagcacaaataataattgagaagaaataaacaaagttaaaaaggttttataaaaagaaaatccctaaaagaagtcctctttcccccccttcctctcttgggccggctcggcccaactctccctccctctctctcctctcccccgcggcccatcggccttcccccgcgcgcgcgccgctgacaggtgggcccgccccgccaccctcgctgacgggtggggacccacctgtcatcgcctacctcgcgcc

SEQ ID NO: 60045 - DNA, 2697 bp, Oryza sativa
ccgtggaccgctcctttcgcttcccccttccctcctctctctcgggcgccgctccgtcgcgccggaggtcgccgccggcgaccatcggggcgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggccggcgtcagccgcgtgcgcccggtccaccgtggaccgagaggctgacgcgtgggccccactcccgtggacccggtccgcgcgccctctctcccggctgacgcaatagatgagtttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgctttatttaaattcccgcgttatcactgttttatttagccatgcctatttacgtttgttatgaccatattattattgttattgttattattattaccttgttcaccctagattaaacaaaacctcaactagtggacactctactgcatggcagccagctagttgtaattttagagtagatgcttcgcaatttaattaggtaacattaggtggtttttcaactatagactttgggaaatattcatatcacctggacactttggaactgttggattattgtggaattggattcacaccgccccctctattcaaaatccccaaaagaggttttaggctgggctcggggtgcatggttttgatagtagcacctcggccatataaggaccggtcttcgggcctctgttgcaaagcactaccatacttccacatgtctagtgggtaaggcttagtttgttgctcagtctagtcataaacaaaagtgcacggattggagatggatgaagtcgggggtcgatggacattctccagggtaaatgaaggctacacgagctgcggcccggtagtcgagatgtcatagcacagagttggtgccctgctgctaggggctcagtcctgcctgcctatcccggaggttccggccgtaggtgggattgggtcggtactcttgtctatggctaggatgggttggaaactatgtcacgtctttcgtctgtataccgtggtggtatgtggcacgtggttgcacgtgagaaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataacattgtatagttctaggatcgggtttacaaaatagctttgagcaactaaatgtctttaaatgctgtttactgcaaccctaacccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccactgtttcccgtttgtctttgtgtgtgctgggccttcgctgcccatgtaataagttaactatttacgcttccgcttgttaaactctgaattgtatcaactgttggtgtaccttgcctcctgggacaaggattaatgcacgcacgtcaggaacgcccgttgggttatttccggtcgtgacaaatacccagcaagtccaaggaaactacgaatttctgaaaccgtcttgggttgcttccaacttaatactgactccacattgcttggatctactgccactcctccagacgagatgacatgaccaagaaacttcacttcggacaaccaaaattcacatttactgaacttggcataaagctgatgctcacgtagtttctctaaagctagacgaagatgctcttcatgttcttctttcgtcttggagtaaatgagaatgtcatcgataaacaccacgacaaacttatccagatattccataaacaccttgttcatcagattcatgaaaaaggctggggcattagtgagtccaaacgacataacggtacattcgaacaaaccataccgagttgtgaaggcggtctttggtatatcttcctcacggattcgaagttgatgatatccagaacggagatctatcttggaaaaaactgtagcaccttccaattgatcaaacaggtcatcaattctaggtaaagggtattattcttgata

SEQ ID NO: 60046 - DNA, 719 bp, Oryza sativa
tgaggtgagagaggaaacaagccaggaaagaatagaccagaactagagacaggaccttaaaggaactaactcttcttattgatgtattgtttgttttgcttattctgcaagttgcttaagcaaacaacctagcatggttacatcacaccccactgatgcaaaccacgcgctacacacacaagcaaggaaacacacaactaacgactctaccctagagggcggcttaggttctgcgactggttctccaagatcttcactccttcttcacagctggcttcactgcttcctacacttcgctagcggatcctgcagtcttccggagcttcggcaaacaattggcgacatcttcttcttcgcaaagctgaccatctagtactagttgaaatttgaaggaagaaaagagtaaaccttttgcaaatagcattaggggaaggagaaaaagaggaactttcgcaaatagttttatttataaaatatgtccttaggttttatccacttggcttatcctacagtcgagatggctctgataccagcttgtcacgaccgggaaaattgccttttcccgaacgctagtgcattaatccccgtcccaggaaaagccggggtacaccacacaaacatgatataaaagacacatctttattatatcgataatatgtacattatcaccaaagcgccctaagcctgacaatcaaaaataaacagcagcgactagcggg

SEQ ID NO: 60047 - DNA, 11957 bp, Oryza sativa
taggccggtctgaccgccgtgtgttgggcggtcagaccgccggttgaaggccggtcagaccggcggtatgtggccggtctgaccgacaggcccgagtccgattctgttgcgtcgggtttcgaggtttccttgctttggaaggcatgtttcgggtttcctttggtttttaccccgagttggacatggagaagggcctgtagagggcaagaccaacccctatataagggacaaggctggttcattgttaaaatcaatctactatcaatcaatcgaatcattctttttatattgcttttagttttctcttagtttgtccatctttgtcggtttgcgccgtaaaccgtccgctaccgctgcgagagtgcgacatctctttgtaggtttgtcttgaaaaccttccgtttgcccacgagacgggtagttatctagaaatcggctccgctagccggtttagttatcaaaacccatctaggtttagctctttgctagatcgaggtggttggcgactttagaatcaccgcaaggcttaaggtgctacgatcgtgcttgtcaacttgtcaaaaaagttgccaacacgatttttggcgactccaatggggaagagatccgttcatcgtcaactcaacttcgacttcgccatgacgaagccatcatctaagacggaggtggagccatctcatgtgataccggtcacattagatgactttgaaggagaggatcgcaaagatgtccaggaatacatcaccgagctcacacgggaggcgttgatgaggttgactactaggactcgtcaaggcgtgatcatcaagcccgggccacgtcctaagctcgctcccgacgtggtaagtaatgacgaggtatcacaatctatcgaccaacaaattgcaaatacaatagattcatctatggctaattttaaagatagattagatgtgatgtttaaggaaaaagttgatgggtttttaaggagtaggctaggctcttttatggatgattacacattaaaagataaagcctataccactgctgatcaacctcctatagatccaatagggtccaaaaccaacggagcggcgttcgtgaccggttcgatcgggcctgacggccggtcagaccgcgacacagccgtcggtcagaccggccagacggccggtcagaccgggtattatgccgtcggtccgaccggccagatggccggtccgaccgggtattatcccaccggtcagaccggccctcaggctggtccgaccatgcaacatgacgccggtcagaccgggccctgggccggtcagaccggcgcaattgtgccgatacagggaattgatccaatgactaatgctagttattcgtaccactttagaacatttgatccccctgtatctactgccaccactagtcctcaaattcccccacatatccctaatgcctacaatgatgtttctagaggatatcctcccgatactagtcaaggccaatataatcatattgcgccacaaaccaaacctattaggccaccaaacccaccaccaaatccacaaggacctaataacatggagaacatgattagtgatattatgaggactaaattcgggatcgaaactaggaatcgtgataggccttacaaaaaaccatatccggattattatgataatgtgtcgttccctagaaattatagagttcccgaatttacaaaatttagtggtgaggatggtaagaccacatgggagcatataggtcaatttttagcgcaatgtggtgaggctaatagtgatacttttaaattgcgcttgttttctttatctttatccggtaatgcttttatatggtttacttctttaccggcaaattcaattcatacttgggctcaattagaggaacaatttcatgattatttctatactggagaaactgagcttaggttatgtgatttaacatcggttaagcaaaaattgtcacgaccggaattaacccaatgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacaacggaagactagggcgacgaccacaggcgcttgacgacaggcacgagctagacaccaaagccttcatcttccagggcctcctcttctgggtttgggaaaaattgagcaagactgagtacaaccactgtactcaacaagacacacccacaagtgcagaataaatgcaagggggtacaaggaagccataatatagggggttaggatttgcagtaaacagcattaaaagacacttagttgctcaaagttattttgtaaacatgatcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggtttttaagaattaaaacgctaacttgggtacattgctcggcttgcccctaaccgagggcgcggctattcgaataggttttactctgatcagaggtgtacatctttacccataagacacgtcttcctcacgtgtaaccacgtgccacataccaccacggcatatggacggaagacatgacatagtttccaacccatcctagccatagacaagagtaccgacccaaccccacctacggccggaacccccgggacaggtaggcaggactgagcccctagcagcaggacaccggtactgtgccatgacatctcgactaccgggccgcagctcgtgtagccttcatttgtcctagagatgtccatcgaccgccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagtgggaggtgtgaatccaattccacaataatccaaccattccatagtgtccaggtgatatgaatattcccaaagtctagagttgtaaaaccacctaatgttgcctaattaattagcgaagcatctacctaaaatcatactagtggtaccatgagtagagtgtccactagttggggttttgtttattctagggtgaacaaggaaataataacaatagcaataataaggtcataacaaaggtaagtaggcatggctaaataaaacagtgataatgcgggaatttaagtaaagcgacaatgcaataatttaaatcaaaataactttataaactgggattcaatatgctcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaaatggatttattgcgtcagccgggggagggggcgcgcggaccgggtccacgggagtgggacccacgcggcagtctcacggcccacggtggaccgggtgcacccggctcacaccggccggcgccgtgggccccacgcgtcagccgcacccgagggcgcgggcggctgacggccgggccccacgcggcagccgctaggcgtgcctgaagacggcctcggcggtgcggccggcgggaggtggcgcgcccgcgcccctatggtcgccggcggcggccataggcacggcggagcggcggccgagggaagggagggaaagggggaaacgaagcggcggtccacggctcaccccgggtcgacggtgacgatggaaacggcgaccggagcggaggaaggcggcggcgcggctcgggtggacggggtcgacggtgctccggcggtcggcgaccgaaacggagaggtggacgaggtcggtgaggatgcggcgaagccgaaggaggcggcgccgaggtgggaggtggtccggggcgacgacggcggtggaccggagctcggcggcgacggcggagagagagagcgacggcgcgagctcgattccggcgggggaagagggcggtgagtggcggaaacggcggtggggagctcggggagggtttatatagggttgggagtgagagagggcggccggaggagggggaaatgggcgcgggagacctggccgccattaatggcgccggcgaggttaggggagaggtttccaaatgaatccgagggagagagggagggaaaaatggggggaaagggggatgggatcccggggaataattccccccactttattgcgcgcggggacggcgggaggcggcgggattcgcggcggcggcggcgctagggcgcgggcgaggcggcgggagcggcaggaggaaggggatgacgggtgggccccacccgtcagcgaggttggtgggcgggcccgcccgtcagcggcgcgcgcgcagggagaggccggatgggccgcggggaggaggagggagagggagggagctgggccgaaccggcccaagagggagagggggagggaaaggggactttttagggtttttctttttataaaatcattttaactttgtttatttcttaataattattatttgtgctctgaaaattccagtaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgcgacaaaaatataataaatctgttgttgattatattaagagatttagagatgttagaaaccgatgttatactttgaatataactgatagagatttggccgggcttgcttttaatggttttgttgctcctcttagagagaaactagatggccaataatttcttgatgttagtcaacttatgcaaagggctctggctcaggaatgccgggttaaggataataaaaaatttgctagaccattcaacaaaaagcctaatgttaatgtagttgattactctgatgctagtgatagtgaagaggagggtgatcatgatatttatgttgccgaatggtcatggaccaacaaaaataaaccttttgtttgttctaatttaatgccgactcctcgtaaagatcggcaaagtgaagttaagtatagttttgatgtggccaagtgtgataagatttttgattatcttttacaagagaaacaaattagattacctaaaggccatgtcataccatcacaagaagagttaaaacgtcgggcatattgtaagtggcatgattctcattctcactctactaatgattgcaatgtgtttcaacgacaggttcaatcggccatagatgaaggacgattgaaattcaccgatggctccaagatgaagcttgatcatgatccttttccagtaaatacaattaatttcaataataagaaggtgttgattcggccggagcaagccgaatctactaagggaaaggaagtggtcattggtgagccaaggcctaagatgatggtgccaaagaagccggaggttggtgtttggaaggagaataagggtgaagcttcgacttctaaggctcctaggaaaaccaaagtgacctttgatatgcttttggagaagtatgagaagcaaggtggtgagaggaatcacgacaaatggaaaagaccaagatcacctcctaaggggcgatttggtcattcactaagacggttgcgttcacctccatactttcatccacaagacatgtcattgggttcttatccaatgccgccgccgggttattcttatccttacttcatgtcatggggggcaacgccgccaatgtacaaccatatgcctccaatgcaattcaaccaagggtggggacgaccacggaggccaatccatgagcgcttatcttcaccaaacaaaagccaattttatggtaaaaatcgggttaatgaagaaaagagggaaggaaagcgcaccaaggtggaggaaaggacttcggaggtgattactatcaaaataggatcccatgatgtgcctataccttctggagatggagttgaaaagtccccaaacaaaaaatccgaagccggtaccagctcatcgcagtcggccggtctgaccacggccatgtagccggtctgaccgggcaatcaggccggtctgaccgccgactagacagcggtccgaccgaggcttcaggccggtctgaccggcgcgtctggccggtctgaccggtggtctacgaccggtctgaccggtggtctacgaccggtctgactgggctccagcgccggtttgatgagagggctacaaagggcgatgtgagggtttcatcgtcttcgagcaaggttaatagaggacattatttacctcctggaacagagccaaatcctaggtggatgcctaaagatttaacggctacacaaaagagaaggttgcaacgtcttcggacccaagaactaagagagaaaaaggcgaaagaacaaagggataaaaagttcaatgagttgcgaccaccaccggtatggaggcctaagtccatagagaaggcaaaaccgattgatgttgaggagaaggaagaacaatcggttgacgaaggaaaatcgtctccataggaagacatggatatcaacatggtgtgtatgttgcctatggagttttgtgctatggatgaagccgaggttgctcaattctcattaggtcctaaagacacggttttttagaagcccgatgaatcaaaccgtcacatgaagcttctctacctcaaaggccatgttgatgggaagccggtctctaggatgctattggatataggtgctgctgtgaacttgatgtcgtactcgttattcaagaagttggggcacgaggatgatgagttgaagaagactaacatgattctcaatggcttcaacggttaaccaacggaggcgaggggtatcgtttcagcggagctcaccgtgggaaacaagacgctaccaaccgctttcttcatcgtcgatgtgcaaggtaactacaatgttattttgggtcgttgttcgattcatgccaattgttgtgtgccttctacctgcatcaatgtttaatccaatgggacggcgatgatgttgaaattgtgcaagcggatacatcggcagaggttgcgatggccgatgctacttttgagtggcgccatgggaatatctaatacttatcggggagggatttttctagctatgattttattagtatctccgatggcaaatttgtacctatctctgtaaagccggctagtgtagcacggctaagccatataaacttgtataatgagtaaagaggctagtttagagtggttaaaaaaagggtgcaagaatatcggtctacaaagaacgatattggagaaactgttagagattttgatgaggtagagaagcttggacaagggtttacatcggccgatccattagaggaagtagacataggtgatggaattaaaccaaggccgacttttgtaaacaaaaacatgaagccgattataaggttaaggtaatcgagttacttaaagagtatgttgattgctttgcatgggaataccatgagatgccgggtcttagccgtgagcttgttgagcctcggcttccaattaaaccgggttttaggccttataagcaaccacctcgtcgttttaatcctttattatatgaccgagtcaaagaagagattgatcggttattgaaggcggggtttattaggccatgtcgttatgcggagtgggtttctagcatagtcccggtggagaagaaggggagtggtaagattagagtttgcatagattttagagatttaaataaagctactcctaaagatgagtatcctatgcctatagccgacatgatgattaatgatgcctcgggtcataaggtgattagctttttagatggtaatgccggttacaatcaaatctttgtggcggaggaggatatgtacaagacggcttttaggtgcccgggatttgttggtttgtttgagtgggttgtcatgacttttaggttgaagaatgccggtgcaatatatcaaagggcaatgaatttgatcttccatgatttgctaggtattatcttagagatctatattgatgatattattgtcaaatcggatggtatggaaggccatatagccgatttgagattagcttttgagaggatgcgccggtatggtttgaagatgaacccacttaaatgtgcttttggtgtgtcggcggggaggttcttaggattcatggtgcatgagagaggagttgagattgatcctaagaagatagaaaaaattcatgatttcaaagcgccgacatgcaagaaagaggtccaaaagttgctaggtaaggtgaattatttgaggaggtttatttctaacctagcgggtaaaatcgatgcttttttttctatacttcgtttgaaaaaagaagccgatttcacttggggggcaaaacaacaagaggcgtttgaagagttgaagaagtatttatctactccacctgttgtgcgagcgcctaaagccggaaagccttttcggttatatattgcctccgaggacaaagtcattggtcccgttttgacgcaagaggaagatggcaaggaatatatcattacatatttgagccgccgtcttttggatgccgaaacaaggtatgtttttatagagagactttgtctatgcttatactatgcttgtaccaagttgaggcattatttgttgtctagtacatgcatagttacttgtcaagccgatgttattaaacacatgttgcaaaggccaattctaaatgggagaattggcaagtgggcatatgctttgatagaatatgatttgacttatgaatcattaaaaattataaagggccaaattgtatgtgattttatagtggaccatcatatagatgttgcttatgagggagaggtttgcttagttgaagttataccttggaagatttattttgatggttcttcttgcaaagaaggtcaaggcataggggtcgttttaatttcacctaatggcatgtgttatgaggtatcggttcgtttggaatattattgcacaaataatcaagccgaatacaatgctttattgttcggcttacaagtgatagggatgtttggagctaaatatgtggaggcctttggtgactcggaattggtggtgcaacaagtcgccggaatctacaaatgcttggatggatcactaaataggtacctcgattcatgtttagatattattgccaattttgataattttgctattagatatattgctaggtgtgataattctagagcaaatggcttggcgcaacaagcagaggttataatgtaaaaagggggttatttctgatattagaagagccggtgcttgattttaaatttttgtgcgaaattggcaaagttggggaccagaggcggtctgaccggcgttgcacggccggtctgaccggtgaccaggggcggtctgaccggccgcatgccgccggtctgaccggcgtccctgagaggtctgatcggccctgtgtggccggtctgaccggttctaggcagggtgctggagggcacgtttcaagtaattttgaggccgaattaattgtgaattcggacgtttgtgcccaagatacagaagaggattggagaattcctttgattcaatatttgaaagatcccacacataaggttgatcgaaagattcgacggcaagcattcaaatatacattgcttgatggagatttatatcgccgaaacatagatggtgtcttgttgaagtgcttagatgaagatcaatctaaagtggctaagggagaagtacatgaagaaatttgtggaactcgtcaatcggaccacaagatgaattggttgcttagaagagcggggttttattggccgaggatgattgatgattgcttcaaatatatatagggaatgcgaggcttgtcaacggttcggcaatgttcaattggcgcccgccgccgtattgaaccatataatcaaaccatggccgttccgaggatgggctttggatttcattggtcaaatttatccttcgtcatcaaaagggcataggttcgtgctagtcgctacggattacttcaccaagtgggccgaagccgtgtctttgaagaatatgactcatacggaggtaattgactttattttgaagcatattattcatagattcggtattccgcaaacattaactacggaccaaggtgcttcttttatgtctaaggaagtgaagagttttaccgaatcttatgatattaaattgttgagttcttcttcttactacgctcaggctaatggacaagccgagtcgagtaataagacattgttaaagctagtaaaaaagaagattgaggaacacctgaagaggtggcatgaggtgctttccgaagcgtagtgggcgcataggatatctaaacatggtgccactaaagtcactccttttgagttggtttatggttaagaagccgttttaccggtagaggtgaatcttggttctcttcgttatatcaagcaagatgatttgtcaagtgaagattacaagacattgatgggagacaaccttgatgaagttatcgacaagcgcttgaaggcgttggaagagatagagaaagagaagaagagggtggccaaggcgtacaacaagagggtgaaagcaaaattgtttcaagttggagacttggtttggaagacaattttgcctttgggtactcgatccaaggagttcggtaagtggtctcctagttggaaaggtccttattgagttagtggcattgttcgaggaaacgcatactttttggagacactacaaggggagcgttttcaacgagcaatcaatggaaaatacttgaagaaatacttcccgagtatttggcaagacgcttaggaggtactatggccggtaattggattatcgtcctaagaccaaaaacatgttctatgcttttagattcacgttgttcatcaaaaaggcaggggggcatgtgtttacacccaaatttggcacctaggcttaaaataggaaatattgccaaaatttggaagtctaccggtttccttggaggtaggccggtctgaccgccgtgtgttgggcggtcagaccggcggtatgtggccagtctgaccggtaggcccgagtccgattctgttgcgtcgggtttcgaggtttccttgctcgggaaagcatgtttcgggtttcctttggtttttaccccgagttggacgtggagaagggcctgtagaaggcaagaccaacccctatataagggacaaggctggttcattgtaaaaatcaatctactatcaatcaatcgaatcgttcttttcatattgcttttagttttctcttagtttgtccatctttgttggtttgcgccataaaccgtccgctgccgctgcgagagtgcgacatctctttgtaggtttgtcttgaaaaccttccgtttgcctacgagacgggtagttatctagaaatcggctccgctagccggtttagttattaaaacccatctagatttagctctttgctagatcgaggtggttggcgactcttggatcaccgcaaagcttaagggtgctatgatcgtgc

SEQ ID NO: 60048 - DNA, 1871 bp, Oryza sativa
aaagagatcatgattgaagcagccaacatatgaattagtaaaagtgagcaggtccagattattacacttaagttccatggctgcctgccccagatctgatatctcacgatatgagatactgctcattcgaaaccatggccctacaagaaattttaggtgtttataagtatgtgaactacctaaggaacacaggcattaaaagtctagaggcaattgtggatcattacgaattaaatgagaagatcaacagatgcatcaatttatacagaaatgtagcaaacccaaggtaattattgtagtatagtaatacacaatataaaatccctagaactcatagattaatcatgtaagacttaatcactttcaagaggtaagaaagctgcgcagagaacatttcaaagttaatgagtggatagtctaggcaatcaagtagcacagctagccccttctgaaaatagtgctcccaaattcatgctgcacatctgctatttatgtaaaaataaatatgtaatcaagaatgaagtaaaatgagcatctcagttattacttgatgccgatatagcaaccttttcgagtgtagatcctaacaaagagcctttgtccatcatctggtaacaactgaaaagagtctgttgaggataagaacagagtcctcgatgagtactttctaattcacaaatataagatatatatagtggggaggaaataagaaacaacctaaaaatgacttttccttgtcactaaaaaggtgtgaatggtttgccatcacatctgttatcatcgaactaaaatttgtctggtatctcgtactgctaggttgcagcaaatttccatttccaacagcacatatgaaattttcccataagaactgtggatgcttcagatcatcatatgtctcattttcatctgtatatttctggcacttaagctggatgggaacatgatcaagttgttgttcaggcacgccaaccacacatccctaacaaaaaaagaataattagaagttgaatggttattaacttggtagtacagagtcacagaaaaagaaacattacatccttcctaaagtaaataaagtgaatagttatttccaccaaaattaatacaactgataaagtgaccaccaaataatttcaagaagaaatagaaatgcgggggttaggtgaaataacatcgtcccaacgctccgactggaatgagtcgcttaaagagaaggacaagctagagagcatgacagtagcatataaagtaatatctgattatgaagctgtcatatctaatgcatgcattaacatcagggaccattagcgaagatggcatggggtgagatactgagatttcaaagataatctaatgcacaggtcaatgttggttcccttaccacctataggatagtaaagtagaacttgaagggaaacatagcaatagctgcagtttcatcagtgtaatgcattctacataaatacaacacttatatccaacagaatatgttaattcaacaaggtaacctaatgacagcggttctgctgcgatatacaaagaagtaagctcacctcgcattcaatgtagtgtctgtccagtagaggagccaaaactttagccagctctcgaggtaagtatccaagcatctgttcacattcatagcctgcataaagcacctatgcatggtgttaagaaaaaaatgtccacagaagaggcatatcacaggaatttatttagacaaaatggaaaaccttgatagcgtcagggtcctttgcattctgaggatctcggagaagagtaatgctcgcaccttcttgcaattctatgttttcatggaacctcctgcccactatgacagtgtcaactactaccgaattgctagaatctgt

SEQ ID NO: 60049 - DNA, 13075 bp, Oryza sativa
cagcctagaaacatgaatatgccaatttgtagctgggcatgccaatttgtagctaatcgcagaaagctggctgcttaggcctttgggtgggtataatcagagcaacgtttagccagctcggggatggaactaggctactggcagaatttccgaccaaacacgcgcggcacagccagctttcccaatcactctcctctccaccgtagcaacacaggggaacacccaacatcccgcggattcacggattcgagtacgaaccgaggtgcgtgttgacgcagtaatccgtgccgcggatggactcgccgcagacggggcacgccacccaccccgccgcgccggcggcgtcgccccctcccgacgaagaaccacccgccgcggcttccctctccgcatcggccgcatcatcctggagaacacagaaggagccggagcagaagcggtgagaacggtggaaccggcgatgccgcgggtgggtgagttcgccgcgccgcgcgaggtttgaccaaacctgaagggagcgggaggggggcacggcgagggcgagggcggcggggagaggggagcggcggcgccgcccgatgaggcggacaaggctctcccgcccggtcagcatggcctccttcgccgccgccgcgggggagacgaggtggcggcgcggcgagcccgggaaggaatggaagtggtcgagagagccgcggcgcgcggttttttttcttttttttttttttttttggaattgctataaaacttctgcaagttttttttctaataaaacttttaaatttatgattatcgaattatctcgagatatgtacatgaaattaaaatactagaaaaaattttcgcacaaatcatgtgtaagatatcggtgctaaccaaccaatccatagttgatatatcgtatttatggtgtaattataagggcatccacaatgtatcatatgaatgagctataaaactttatgactagccatatatattgcagcactagccataagacattaaatgctaaaactagccatagacttatggttcaaccttaagaaataaaataatgagaaaaacacacctgcaatgcagttataatatagttattgggtaattacagtataattatattttaatcataattaattatattatgagtgtatttcaaatataattacatttaattataatatgtatgacagttttataaacctaccgcagtttttaaattatttttatttggaattctgtttttcgcggggtagggtggttttggtacatggaggggtgcaccgtggcagagattgttacgaaagattgcaggtttcgtgcacgttgtttttgactttgagccagctatgagctaacccttgtccttcagagggaaaagagagatcatcagtactgaagcttgtacgataccacacaactttcttgtgtacattgaaatttatgctatggtatttgtatatagttttcttgttgaaatggtttgtcttagagattttacaaggaccacattttttatcatcaaaagaatttttgtagttaaatatatcaaataaatatttgtgtataccatccactatgctttggagtttagtatgtcatattgtcacgaacaatataaatccagatttatttgtgtttcacatttagggttcagcatttaacttggacattgaaactacatgttacgaaaaaaatatatatagataaatatagtatggatttgttgtgacatatatgggtgagcgattgtttgacttggctatatcaatttgcatatgtgaaggtttaacatgcgaaaaaagtttataaaaatataaacaatataaagtgttgtcttaactgagaaatctgattttatccccgttacttaaaagcgcatacatctatccattctcctcccctatattacagtcacacgaacaatgctccttctaaagaaaaacagaaaaatcgtttcccttagaaacaacgtgctctaaaaaagctctacatgcaaccgttaactcatagaaaactaaaccattgatcaatttccatcatattacaacacacgttcaaggagtctttagtaataagaagagcacaaaacattttactacaagaaacttaatgaagaaaatgcaagagctatatatcgtgaataagaccatcaataacacatgaaatttgcccctttcaaccaaaacctttctttctttaggatatatatatatatatatatatatatatatatatatatatatatatatatatatatatatatatcatattttgcttcacacctaaaataaaagctacacaatattatctcacttatagtgtgacggagctcgtggcccctcaccgggaggccgcacaggcccccctttgccggttcggccgggggctcagggtgagatctcaagctctctcggtacgtggaaagatcgccacctctcaagaacgcgagacacgggcgatgtatacaggttcgggccgctgagaagcgtaataccctactcctgtgtttttggtggatctgtgtatgaaggagctacaaagtgcgagccgacctctcctttgttctaaactctgaatcttcagagaatcaaccccccaccacctatggcaaggtcctccttttatacttcaaggggataccacatgcacccctccctttccaaactggacttttcttcttttcataaatggacggagatttgcacggtcgtcctccgaacatccttctgatgggacggcacatacctacctccacttctgactgaggcgggcacgttgcgggaaggcggctgtgtactgacggcatgagcagtgtcagaccggtcacaaatcggtcattcttgtccaccacacgccggctcagcaacgtgcatgtttgccctttttcaaacaacatcttgcttgtaatggttaggatgaagcctggcatatatcgatcggggctaacgtgtcatctctgggacgtaacacgctagctccagccggggacgagtgcctaggagctctcgtctagacaggatggggcgaagcatgcgtctgaccgcctgtcgccacctaacccgcgatttgaccggtctgtgactggtcacagaccggataatcgagtgcactgcactgcatttcgtgcggcgtgacacgcttagccgtggtgcaataaatgcggttaggtgagccccgctgtgctcacctaacccatacacgtggagtaaaaaacgcgaggggtcggggcgcctccaccctcgggggcgaggctggagtggcccgccccccccccctcgggaagaccaagaggtgggcgcacacatcaccctcgggcccgacgtcccccgagggtgccaggccacgtgggcgattgtgtctgcctcaagcctcgagtcatgatactcccggtcccatgtcaccgacagtagcccccggcgttacgcctgggcgatcgtccttcttatggggagcggccgggcgtgacgccattcctaaagcctggtgacaggtgggaccggtctccatggttgggcaaaaacccaacggtctcaaaccatgcacaccagtaatggtaatttggctgtcaataatgggcggtctcttcaagactgccacatcaactgagtggcgcacgaatctgggcgagctgatttgcctcgcctggagatacgggaatgtcgcttcggtcggcgagcgtaattaacgcgcgcacgatacgatctatctcgactgccgcaaccgcatatccatctcacgcgccataggcgggcgaatgggattagtggaagcgtgggcgcgagaaacgagggggcgaaataatgggcgcgagaaacgaggagccgggcgcagcgtttggcaagggtataaaagcactgaggatgggatttgtctctttcctttcgccatcatttcccttgccttcgccgcttgcgtcctaactccttcttccctgcgcccttctttcgccgcacgcgctcgctcttcatcttctcttcgtccggcgccatggcacggggctccgcactgcttgatggtagcgtgctgccgccttctcgcattgtgagcgagaagcaggctgggttgccgcgccgcttcatgccggaatccgcctccggccgtgagatagtaatgctgggtgagggacgcccggcgccagactacccggggcggtccgtcttctttctccccttcgcaatggcggggctggttccgccattttcttctttcttcatggatgtcctggagttctgcgatctccagatggcgcaccttacccccaacgcagtgatgacattgggcatcttcgcacacctgtgcgagatgttcattggggtgcgcccatctctccggctgttccggtggttctttaccgtgcagtcggtatcgccaccgtcggtggtcggcggctgctatttcctgccgcgggggccggtgttgaaccgctacatcccctgcgtcctccgtaaaaagtgggatgactggaagagcgactggttctacacccccctcgccgacgaagcgcgcctccgacttccaagtcagcccccggcgcaggcctccagctggcgggcgccggtagatctgggggatggctatgacgccgtccttgaccgcctcgcgggcctgcgatcccaggggctcaccggggccatggtgtacggcgactacctccgtcgtcggattgcgccgctccagcggcgcgctcgggccgcctgggagtacaccgggtccgaagactacatgcggactcaccagggagccagatgggattgggcccccgaggacttcaagatactggtccaacgggtgctaaatctcaactccgtggaggcgtcccttatcccccacggtatcctccccctctgcagcgacccagatcgcacctccatcttgaccattatgacggcggtcggggcctcagaggagcaggctcctaagggccatgacggcgcaggtggaagccgccggggggatcaatctacccccggagggggtcgtgcttctgggccccgcgttgggggctcggggagcaaccgccctaccgacgcccgggggaagaggaaattgggaggaacacctcccccatctcctccccgagggggcggggcggtgcgtgccagcagcaggcgcccggagggggccgcgccaacatcgcagcccgagggggagcgcaagaagaagcggctgcgcaagatgggggagacagaaccatcccggggaaacctaatttcccctccaaggtggtcatttaaccgaccccctcgcaggttcgtcccacgctcattgcgaccgtcttttcttctatcccaaaagcaagttttctcttacccatcttgtttgccttctggtttttctttctgcttcagtgatatcccatcgcgttcctcccaccatcccaagtccggccagtccgaggccgaagatccggcggctacagaggcacggaggcgggaatctgaccggcgggaggccgcagaccgcctacgggaagctgaagaggccgcccgggaagccgcccgggcccgccaggctaaggataccgctcgggaggaggccgcccgggcccgccaagccgaggaagccgctcgggaggaggccgcccgggttcgcctggccgaagaagccgctcgggaggaggccgcccgggcccgccaagccgaggaagccgctcgggaggaggccgcccgggaggaggccgcccgggaagccgcccgggaggaggccgcccgggttcgccgggctgaggcgatggcggcttccgaggcagttcacgatgaggccgtggacgcctcgcttgggcccaccccttcgggcgacgcccaagaccaaacaggtccgggggtggcccgcgatgaagccggcgcgtccatgggcgggttgagccacgcggcgtcttcttcaaggcagctcttccccacgccttccgccgccccgctgagcgcagagccccttctgcaggccttagccgccgccaataccgcggtgttggacgggctcaatgcccaggtggtggccctgcaggcggagcgcgcggagctcgacgccgcatgggcgcgtgtcgaggaggggcggcgctcggtggaggccatggtagaagcgggccgcaaggcacaccgccggcacgtctcagatcttgagacccgcaagacggcactggcggagatcgcccgagaggtggaggaggagcggggggctgccctcatcgccacctctgtgatgatcgaggcgcaggactccctcctccttcagcacgggaactgggaggcggagctgaagaaaaagctcgacgccgcccagggggttcttgatgccgccgctgcccgagagcagcgagcgacggagaccgaagcggcgctccggcggcgcgaagaggtcctcgaggcgcgcgccatggcgctggaggagcgcgcctgcgtcgcggagaaagtcctggcggaccgcgagaccgccgtcacctcccgggaggcaacgctggcggcgcacgagtctgcctgcgccgaagaggagtccgcactccgcctccgcgaagacgcgcttgccgagcgggagcgagctctcgaagaggccgaggccgaagcgcaacggttggcggactccctgtccctccgtgaggcggcgctgacggaacaggcgcgccgtaatctagaatgtgtccgcgccgagagggccgcactggaccagcgggccgctgacctcgaggcgcgggagaaggaggtggacgcgagggcgcgcagcggcggggtggccgcaggcgaaagcgagttaactgcccgcctcgcagctgccgaacacaccatcgccgatctgcagggcgcgctggactcgtccgccggggaggccgaggccctccgcctggcaagcgaggtagggcccggcatgcttcgggacgccgtctcccgtctagaccgcgccggtcggcaggcgggcctctggggcaggcggactgcgaagtacgccgccaaccaggggggcctcgcccagcgcctttcggagatagccgggactctccaacggctccccgaggagctcgagaggacgattaagtcatcctcgagggacctcgcccaaggagcggtggaactcgttctagcgagttaccaggccaggaaccccaacttctccccatggatggcgctggatgaattccctcccgggaccgaggacgacgcgcgcgcgcgggtccgggatgccgccgaccacatcgtccacagcttcgaggggtcggcccctcggctcgcgttcgcccccaactccgacgaggagggcgatctcagcggtgcagacgaccgtgacgacgaggccgacgacccgggcgcatcggactgagcccccaggcccccgccagtcttcaattttcttcttttttctttcttctaaggcccttgggcctgttttttgtataaatcatcttacaatctgcaatcaaaaatgatgaaaaaactctttatgttaattttattttgctatgcgaatgagatgaggatgatctgtgccgtgatcctctttttgtgtcttagcttgatttaagggcccgtgcccaagtcccagtcctcgaaaagcgcgggtcggggctagtgcctggggagatccgcatgtcgagactggccaggccgggaacgtggcgaccgagggttatgggtgacccgattgtgggtttttgccgattcccccccggagttcaccacgccccggggcacggctcggttttgggccccgtttggcgattttagctgaccgacccgagcccccgagggcaaggttgagcacgagtgaccttatttcaagtcaaaattcttcaaaaggaaaaaacggcacagacacaaccttcaggaaattgaaactgcttttattgaaatactgaaaagagagaaatgagaatgtgcatgcgtggtagcccccggccaaccctgcacacccgagggggggtgcggggttggcccgagcccgaaacctgacacccgacccccccctcctcaggggtagaaacgacgaaggtgttcgatgttccatgggttaggcagctcagtgccgtcgcccgtggccagccgtacggagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccttcttcgctcttccaagtagtcgaggtcatctctgcgaagctgatcttgatcagcttcgcagtacatggtggcccgaggagacctcagggtgagctcggatgggagaaccgcttctgcgccgtagacgaggaagaagggcgtttccccggttgctcggcttggtgtggttcggtgtcacgccccgaaattctcaaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgttgcaggatataacccaaggaggctagaggttcttttgcataaagctagcatttaaaagcagtagttgaaagcagtaaaacagctgtagtaattaatcaatattaaccaaacactgtccaacgctacaccacgttgcaacaggcccaaccaacctcctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaccaacatctagtcattttgatacccaggttatcaatggcataaggtaaacaataaatggctgagtattaggacccatcccacatgatattgtaaaagaatgcaacatttaatagaaatgcgggatatttgtaaattgggtacaatatgatcaaacgtaaagcatgacttgccttgctctcgcactgatgagatcacagcaacgtcttcgagaaactgcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagtccttaattaattattgcgcaataaagcccagggctgacgtcagcgaggggaggggcgggcgccgacaggcgggccccactggtcagcgacactaagagagggaaaggagggtggctggcaagcgggccgtactggcagcggcacaaggggaaaggagagggaggcgccggcatgtgggccccacgggcagtggctcaagggggagggagtgggcggcggcatgctcggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacgggggagaggaaaggaaggaggaaaagggattcctcaccgaggcgatggcggcgaccggcgtgggaagagacgagcggcgatgaccggcgacgcggaggcacggacgggcggcggcgacaccctaggagaagatggagaggcgttaggagaggagacgacgaccacggcggcttgaattgccggccggagatggaggggagggaaaaactcaccggctcgcgaggggagaggtgctccggtgggattccggcgacgcgaggcggcggccgggaaagctcttgcggcggcgaagctaacggcggcggcggtttggcgcggcgggactctagcggcggcggctcgcggccgaaggcggcggccagcggcggagctcgggtgcgacggcgcgagggcggtagacggcacgggagagcgcggcgagtgcgaaaaacgagagaggaagacgcggggaacgatttataggcggagggggaggcggacgtggccgggaacccatcctattgcgccggcgacgtgggaaggtgggggagagagagaggggtgggattcaaattcgaatcccgcccatttgcgaggcgcgcgagggcgggagacgcgggggagaggcggcgacgtgggagggggacgcgggagcggcgcggcgtgggcgcgggaagagcggaggaggcggcgacgtggcggattcggcggcggttgccgtcggaggcgggtggctggaggaaggggacgacctgacaggtgggccccacctgtcagcgtcccggagagagggggaaggggaacgggccggcccaaaggaaaagaggccgagcgcgggagatgtgggccgacggcccaatagagaaaaaaagaaggaaaagaaaaggaaaaagaagaaaggatttttcctgggattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagtcaattttttttaaagcaagcaaaagggggaaaacttcagggcgtgacattcggtttgcccagagcaccgctggcaactcctcgatccacgaatcgccatgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagtgcagagtgcttatcgatcttgacgaccggataagcctcgggccacttagtgaacttgtcgatcgcgacatacaggtactcaaacccgcccggggcccgcttaaacggtcccaggatatcgagcccccagacagcaaatggccacgaaagtggtatgatctgcagggcctgggccggctgatggatttgcttggcgtgaaactgacacgctttgcatcgccggaccaaatcaactgcatcattgagagctgtcggccaatagaacccttgacgaaaggccttgccaaccaaggtgcgcgaggcggaatgggctccgcactcgccttcatggatgtcggcaagaagctcaacgccttgttcctgaggaatgcacttcaggaggattccgttggccgcgcgccgatagagggtcccttctaccagcacgtagcgtttggaaatgcgttggacgcgttcactcccttcacggtcctcaggtagagtcttatctgcgaggtatgcttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaaccatgttatcccgtctgggtacatgccgaagctctatcccgtcaaaatggcgctccatacgccgcacttggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattagtcgctcgaaagtcgagacggaccaagtatctgaggaagtctccgttcggagaggtcaacatgacccccgcaccggcgccctggagagacagcgaaccgtcgaactgcatcacccagtgggcggcgtgaggcagctgagaggggtccgtgccggcctcggggattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgaggcggggctgcagga

SEQ ID NO: 60050 - DNA, 2372 bp, Oryza sativa
aaagaagaaaggatttttcctgggattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaatttttttaaagcaagcaaaagggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaatccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgatcccagaagagtggagtacgacaccttcgtccatacagtgcttcaaacggtgccatctgcagactagcttggtaactgttgttgtacgagaactcagcatacggcaagcttttgtcccatgccccaccaaagtcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgggccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccaaaacttctctttgaggtcttggtacatcttagtactaccgggataatggaatattgagtttgatgagcctcggttagtatcaggtcttttaattccttgttttcgggtacacacaatctttctccatccagattgttccttgttcatcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcagatgttccaaatcgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcaggttgagtaaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttctacaaaactcctattgcattcagcagaccagataaacttttcttccttcttcaatagctgtgtcatggcttagcaattttagagaagttctcaatga

SEQ ID NO: 60051 - DNA, 9782 bp, Oryza sativa
gtgcttaggttacagagaaaggagaaagaaaagaaaaaaaaggagaagaagaaaaagaaaaagaaaaagaaaaaatgaatatatattttgagagtttaggaaccaagatgacatatctctataagtttaaagacaacctgtgcactttactaaaataaatacttcctccatttcaaaatattataatctagaacaagatttgatccattctaggatgaatctagtatatagttttgtccagattataacttaatataatacttacatgtatcccagtccggctacctactcattgtttgcaccgtacttgataaaaaccgtggaaaaataaatgaaattaactaaaaaaaattataagtagacttttatatgtatgtttctagcaatttaaaagatactgttaaaaaattaatctgttctgaaaattcttataactaacttttaatcaagttctaaaatttagattttaggtacgggcgtacggctcataagcaatcaagcaaagctttggacagggagcatcatgcactgtgcgcgggggtagcagccgcagcgaaccaagcaatgggagacaacacacgaggtcgagctctgcctggaaccctgcaaacatcatgaactgtctggatcgagtaaggcagtaagcaggtagagtatgaactaaagggattcaaatattcagagatgttccccaaaaaaaaaaaaagatattcagagatgtttcagggtttcagagataatagggttttagggattcagaaattcagagttttgtcgtctgaaaaaggagttccagggttccaattaagagacgttaatcagtcgttcgacacctcttttttttcccgcaactgggattggaaccataaaaacactgtagtaccaaaggaacaaaaacatttcaacatacacaaatatcctctcaaaagaaaatatacatactcatgttacgaatcgacgattagatattgcatgatatgacgctgcgaattattccctgacatacgcccatctttcatttgactttatgcatgctgctttacctctagaatctggaccggaaagacagccattccatcaccacttggtaaacagccagattctcaatctcctttctacagtaatacataactagaggtaaaaaaaataaattaagtggtcacagtgacttgagtagcattttaaggtcctgaatttaaatctccgtaggagtgaatttcagattgggttatttgaggagttaagtttccgatttaaaaggttgcatatattcggttggatgtagagaccgaataaaaaatatccttctctaaaaaggttaaaaaaaaggtacaaaaatctgtctcaaaagctatttttaaggttgcatatattcagttgaatgtagagaccggataaaaaaaatatcctcctctaaaaaaagttttaaaaaatctgtctcaaaagctatttttaggccattcatctgcgcaagaaatacttgtgcaaatcatagatgggcctcaaagaacacacttgctttgcatgtatggcattttctacttggaggtaggggtcagagtttaatactccgactgcggccccagttctctcaattctctcgcatcttctcatggcatccatctctgaagaaaattaagaacttgctatcaatcattctgcaaaccatacatcatagctgaatgttcaggagtatacaaactggtagtctttgcaagaagataaaatttaccacaggacatctaaaaatcatgtaattaattagaagacacccaaaaaacacgacactttcaatggatactacaaaatttgtgtaattagctgtaggacacccgaggtaatattttattattttcggtgaaaaagaggagagagaaatttcaaaaggacggaaatgcccttagcctcagtacctgaaatccccatccaacttcaactgcggcggcgaactccggcgaaggcaccacgccgccgccgtggtgcgtcgtgcatgccagctgcatggacaaaaacccgagctcttccaaatggagaatcctaagctctctcgccgcccataaatcctttacccagcacagcgtcctccgccttcctcgcgagctctcgccttgccatggcgtcgttaggcgacgccgcgccgttctgctgctggtggtggtggtgctcgtcgcgggcgcggtggcggcggcggccgacatggcgggcgaccgcgcggcgctgctggcgctgcgggacgcggtgggggggcggcacctgccgtgggacccgtccgcgcccacgccgtgcggcggcgcgtagcacggcgtcgggtgctccactgctccgccgccggcgaccgcgtcaccgagctccggctccccgggaagagcctgagaggagcggtgcccgtgggcacggtcggcaacctcaccgcgctgcggacgctgtcgctccggacgaacgcgatatccggcggggtccccgcggacatcggcggctgcgtccagctccggtcgctgaacctctccgggaaccggctcgccggcaggttgccggaggggctcttctcgctggcgctgctcgagaaggtggacctctccgggaaccgcctcaacggcggcgtctcgccggagttcagccggctcgcgagcctgaccacgctgaacctcgaccgcaacggcttcaatggcacgctccccggtaacctgatgctgccgaagctcgcgcagttcaacgtgtcgtacaatggccagctcggtggcgccgtgccggcgtcgctcaccgggatgccggcgagcgccttcctcggcacggcgctctgcggcggcccgctcgccccgtgcgccaacccctcgccgccgtcgcccgggggcagcaagggcgtacgtgaggaagaagaggataggagagagaggtgtggaccccacttatgattagcaaatagtaatctctctactaattacgaataaattagtccatgactcatgggcccaggaggttaaaaacctattaaaaattagattaaacataggctgtccgtgacatgtgggacccaccggtatttaaagaaggaaagagaaagggcaatccaagcatttagataaatatctcacctttttttacccagaaataataaaataatgcgaccggtgttctacagtcaattatatgttttttttttccatgagccgtgtcacattttcgcggtgtctctcagctaattacatgttttttttgcgtgttctggggcaaattttgtcttgcaagaatcatacttcataattacctagtagagatagctgctgattagttcatctatgcatccaaccagcacaggccggatgatgtgataacaaagagcagagtttttgtggtggtggtgatgactgacgaattgtgttctgatggtctcttccagatgccatgaaaaatgcaattgcaggatgaggcctgaagagacgcagagttgcagagccaagtttcagaatcgccttgcagctttcaacaggcaccacatgaactaactctggagttcaacgagcaaaaatgggtggagttcaacatgctggctaatatgtaaaatgaacgttggatggttcagttacgcgccgaacacttccagggatgatgcaacttggaacaaaaagtttcctgcagaagttcatttacagccagattcttcattccagggatgatggaacttgcgataacttctgcaaacaatatgcactttacagtcagattcttcatttatttttcattattgccttgtaggtatttttgatcattcatctgccagacaaaaatttgtgaaaaatgcaaatcatagatgggcctcaagaacacacttgctctggtatggccttttctacctggagcggggttcggagtttgattctccgaacccctgttttctcaatatcctagcttctttccttggcagcatgaaggttagctgcaacgaaaatcacctcaaatgttcacccaagatttatgcattagttttgggtaccatcaccctgatttgtgagaaaattcaattatgatacagagcttctcatcggaacatctgacatcatcagctatcaacttgcggcacaaccgagggataatatgtaataattctctaccattgtttatgtcttagatctaatcagtttctgctttctccagtagtcataagttcatgtgttcagagaaattttcttcagatcagatgatcgacttgatgctgatgacatgctttttagagcaggtacaatagcaagttattagccagctacaaacatattttaatgagataaagataagagagaagagtagcgggctacagatttgtagccagctgcagcacggactccaagatgcaatgtgtgtatgacatatgagaccatatattaatagtatagtaagcaactattatatgaattggctattagattagctatatataaattggagctagtagtgggctatactattaaacttgctcttaggagcgtaaaatttggaaatcttcagtgaactgcgatgatactgacatggatacagtcagggaagctttagctagctgctgcagagaactaggattaacctgaatatacaggcttgaccatgaacattcgataatcagcttattctcccagagcagtacgccatgtagcaatgaacagatgcttgtatcctaactcctaagtagattttgaaatgaagctgctgtgaattcctgcctgagctatgatgccaatcttttttttgagatgtaattcagatagttccaatcttcactgagatgtacagcattgtttgtctacatggaggtgtgggtcggagtttaaaattccgacccccagttttctcaaaatccttcgcttctcttcgtggcaacatcaaggtagccgtaacacaaaaacacctctaaacaagaacattcattggtgtcaggatccattgcttttggatgcagggtgcagcctgactgcctgggcgatgcatagtctcacagccataaccataagtagatcgttggagctacagccatagtcgcacaggcaaatctgcaatgctgcatgggcttgaattgcaaccgtgcgcgcaagcggaaattcagatcgcatgattcgcgtcaatctcgtcaaaaaaaaaaaaaaagagaacaatcaagaactgcagtatctccgatggtcatctgttctggtgctatgagaagatttctttatagcagatgctctgcattagcgcctgatactgaattcctgatgttgatactgcgttgctgaagtgcctgagtatacaaattggcagcctatgcaataacctgaatcacacctacgtacataatttctttcatttcatattataagtcgtttcgactttattctatatcgaacttctataataagttagatcaaatatattttaatagcacttttgtacaaattggcttaataataatatgaaagaggatgtagtagagatcagatagctgctgattagttcatgtatacatccaatccaactagcacaggccacacaacaagataggagtaggatcgataacaaaaaagagcatttgcagtggttttgtggcggtgacacagaaggtctcttccagacagcctggagagacgccgagttccagagccaagcttcagaatatatgagtgcaactttcaacaggtatcacacgaactaactccggagttccaaaaaacttctgcagtattaatgtgcatatctcaattgcactgcaaacaatatgcactttataaccaccactgaaacaattacccaacacacgttcacttgatgatttcaagaaatgtgcagggtggggctaccgatttgcaaaatcagagttgttgctcaccaatactgaccactgtgaactgagtggtgatcactgatacgaattggtgtttactaaaagcataggaattcaagaacacacaacattattcctaaaatagccaatgaaatttaagtacagatcaaacataacaatgcctgacagccatttactaacagaacacacagccaaataggaacgaacgcatctttctcacatcccaagttctttaaaaaagaaagaagcaggcaaagttcaaggcttcaacagttcagctcaatccagccacattaacaagatttttcgtatttaacaggtaacccttagcaaagacccacagatacgcaaattttctactccctccgtttcacaatgtaacaaaaattatcaaggtgatatggacattactacaaaacaacatgcatacattatgcagaggggaagagtactactgatagaggtgaggaaagttacttcttcaagtaacagccgtctactaagtaatttacattagaaaccgcagcctagtgacaaagcttggtacttgacaaacggcacgattcacaacgcaaggacgaacacaagcacagatttgaattagtcacaattgatagaagataaaagagggtaaacattaagcaaaattaagtcacgagctcatatcatatctcaaacttaacatgcggcataataagactaagcacttttgagttcgatccaaatcacacgagcatcgagctcacacgctacaaaagattggttcccccttcttgttttcttgcatatagcacttaaaaggaaactactaccaagaacaaacgggacatcaccggcggagcggcccggcgcgtctacttctcggaggagttgggcccgcgcttcttgccgaatccgacgacggcggtgacgaagcggcggttgtactgcatcctcttgtgggcgcggccgcggggcttcttcttcttgtcctgcttcgccaccttgggcgtctggccgcgcaccttcccggcgcgagcgagcgatccgtgcaccttacctgcggccgaatcccatcagcaaaaggcgcgagggggtagggagagaaagagaggcgatcgagaggacacttacccatgtcgacggcggcgaggctgcggcggcggcggcggcttcgagggcgcggaggaggagcggcggcggcggcgagcgcggagacgggagaggaaaccctaggcgagggtaagggcttttatagacgtggggttgggtgcggattgggttggattttcgtgggccttgaggcttcaaatttggcccagtagtttcggcccaaggttactcttgtggacccaatgtactgggccgtactctaatctgggccgcgcattttaatccagtaaaggaaaaaggaaaaagtccacttagactcccttaattgttaatcgaatctaattcgtgacccttaactagaaaaccgggtagactgactcccccaattactaaaaccagtacaaattgaatcccttggcggttttgaatagttgtttcgctgacgtggcatctacatggcaatgttgacttggtctgcagttgacgtgacgcttaggtggcattataactaaaaacatacacgtgggacccattcgtcattcacatagaagaagaattcgtggggccacatgtcagtctatcccttcctcatcctccccaatctccccccttatctctctctccctcccaattcagcaagcgggggccggcgccagcggtgacggcaagcgaggggcagcgccggcgacggcaggcagggggcggcggccgctgagctccgcatctgggcgacgccgagcttcgctctcgagcctcggtcaggtctgggcggtagcgggcgcgacctcaacgaggaagttgggctgcgcgccatgtcggactcccagacgcggtcgtcggggtagcggacggggtcggtgggagggggtgccgaagttgatgcgggtggcgagggagaggaagaaggcaccctcgaagataaaggggtgaccggtggtggcgttgatgaggcagtcggagaggaaggcccagggttgagccagcgccaccagcttcgagcacagcggcggctggatacacgcgctgctggaggaggccgagaacgagcggatgcacctcatgaccttcatggaggcggtcaagccgaggtggtacgagcgcacgctcgtgctcgccgtccagcgcgtcttcttcaacgcctacttcctcggctacctcctctcccccaagctcgcgcaccgcgtcgtcggctacctcgaggaggaggccatccacccctacaccgagtacctcaaggacatcgaggccggcaagatcgagaacgtccccgcaccgccgatcgccattgactactggcggctccccgccggcgccacgctcaaggacgttgtcatcgtccgcgccgacgaggcgcaccaccgcgacgtcaaccatttcgcatcggtacgtgcgtgcgtgtgaattcccaagcttgatgtgtgctttgtgtaggtttgtgatgactgaattatttttacttgtgatgtgcatgcaggatgtccatttccgggggatggatctcaaggatacgcctgccccgctcgattatcactgatgataaattttcaaaagaagattatcactgatgaaatcttgcggcggcttgtgtcctgctcagctctgcagttgttaccaggaaacacgagttgctgttgatctgttgtatcctctctcggcctccccgccaggcggacgcgcgacgggtgcagcgtctcggcgacaaggttgcgccggaggatttgccacatgggcccgcatctgcagcgcgtgatggtgtagccgttctctccgaggagcgagcgcgccacctccaggcggtcggcgagagtggtgccgcgctccacaagggtggcgtgcgcgacgcagcagtcggccacgaaggatgaggaggagggcgacgaggcaaagcggtgccacagacaaccatcactatcgccatccaccgctgccgcccgcaccaccgccatcgccatcgccggcggcggcgattgctctgctgttttttttttaagatagagggagaagagggccctgacaagctggccctacgtttttttatatttttccctaatcaattgcatgtgggcctcatgactgggttgacacgtcagcataatgggccaagtcagcatgccacatcagcaaaaccgccctctaaaaccgctgagagattcaatttgtactggttttagtaattgagggagtcatcctgcctggttttgtagttaagggtcacgaattagattcggtaaacaattaagggagtcaaagtggactttttccaaggaaaaagtacaccaaagttccctcaacttgtcgtcgggattaaaaaacgtcctcgaaccgtaaaaccagatatggggtcccttaactatacaaaaccggtcacccgaaatcctttggtggttttgaccccggttttatctacgtggcggttgagtcagcatgaaacctacgtgggccccacatatcatttgtccacgtcaccctctctttcccctcttctctccctcatctttctctctctttcccctctctctctctcgcgcgcacatggaacgccaggaagtagtggcggaagcccttctgccaccccgcccacaggaagaacgggagcgcgagcggcggcggcggtggcgggcgagcgctggggacctcggcgacgagctcgggagccacgcggcggagcttggagaggtccgtgacgacgggcgggccccagcgttggtggcggcggaacgtgttgaggaggaaccgcgcgagcggggagaggcggcgggcggccgcggtggcggaaggcgaaggcggggaggaggaggaggaggaggaggagggaggaggcccctaccgcctctgcttgggaggaggcaccggtggcgtggaggtc

SEQ ID NO: 60052 - DNA, 5462 bp, Oryza sativa
gcggcgcggtggccagcgtcctcctcctcctccgccgccgcatcgacggcgtgcgctgcttctccttcccggccgcctccgcggcgtcgtccatgccgggctcctgcatcccactagcgagctcctgcatcagccccgcctcctccagcctcttcgcatgctgcatcatcgttttcatcagctcgtgattaatctcagctaattaattacactcttagttcagttcgttgccaattcgccatcgccattgttgccaactcgccaatgccaataatgatgaattgatgatgcagatatatgtggagagcgagcttgccgccggtgagcttgccggtgaccggcgagttgactgactgacctcgtggccgtcgttggcggagtcgcggcggacgatgccggcggcgcgtggctgcttcatcccgaaccggatggctgcaggtgcgtcggcacgcagtcgatgacatcgccgtcggggctgccgcgtcgccatgtttcccgctgcggccgccgctgccgccgggtgccggccgccgtcctctctcccgcctcgcctgctggcctctggccctctgcacccgcgcgccgctttgcctcgcccagaaagagagaagagaagaaaaagggagggtgatgacgtggattaccctgatatgtggggcccacgtaggtcccatgctgactcagcagccacttaggacaaaatcgggatcaaaaccgttgagggaccttctgttttttagtttgaggatgattttatatctttgatgacaagttgagggacgttgggtgtactttttccatccagtaaatgggttttccattcaagggcttgaattggagtgtactgtgtacgtgatccgcttacaataacagcccattccaatcaaacaaagtttcggaagagaactcgggataacgaaggggcaatattttcgggacattaaactatttttttgaaacctaaaaaagaaaacaaaatttgaaacctagacattttactattcgtcactcttaaatttagccttaaccatttagcactaatacgtcaatgaaatgtgagtctcatatgttaattaccgcatgcgaggacagataacaatggctaattaccacatctaagtgataaatagttaaatattcttatattttcggaacatttctaaattttcgcgcgaatttctggcaaaatttaccgccgccaccgggcaaggccgccggcggcagaccagaggcggcggcgccgccgcgcgtcggcagggacgattcgtccatatccccatctgtttcctctctctcttttattaagatttttttttctcgcggtgcggcagccaagatgggatcgaaaagttcgaaccatattccacctgtccctcgccttcaagaatccgcatctcgtcttcatcattcgcgtcctccgccattgatgccgatggagagcacatgcttcgcttcgcgtgccctcacgatagcagcgaatcttgctgccgctgtcgctgccgttcttgctgattctttccattaattgctgacgccgatgaaattgtttcactgtgatttttaagcatccgtgttgttaatggttaattagccgtctgattagattagctcaacgcagtggctgaatggtttggtttacctatcttttaactactagccgttcgagcgtcacaagtggatcgaatcgattgaattaaaagtagtgcaaattaggtggagttcacgcgtaattgcagctgaaaaccagcctaaaccacactgttgtagcgcatcaccaatccattatgtcaaccttgtagagttgttatctaattatctgtaaccatcagaaggggcaatcaaatagaagaagagcattatgcatccacttgtactgtcactctgtcactagtgtagatttggcatcccccacatgggcagcaaagagtaatctaattgcttagctgcaggctcagctcagctcaggccttgacactttcttgcatgattcagtaattgacaattaaattatcatcatcatcttgtgcaggccccagatccaagcttggaatttcttaattaccgtgatagagatctgagagatattagtaaaacatctcacagtgcttgtggctgattgttgaaatgtcatttcattaacctggtcacagtttttaactggtctttgcagtctcagccaaagttcagaacgagacgaaactggtggtgaggcctttctgacacttggcaatttggttgccaggtttacgttgcaagggtagcgtaagcacaaggctatagagctcatagcctttaaatcgaagacaacgactttgcataaatttcacagaaacgacatgtatcggtgctactaggttgtatagacttcagtaatttgtttttgcaagacgagaagaacatgaaaaaacatgttttttttttcatggatcaaagctttgtacagagaaaagacaaaggagaagtcaaattctcctttttgcaagtaatactactcgttgggaaattagttcttgtctgagggtctttgaggtcctgaccacgtaaaggtaatacatgaatgaccatctcaaatatttgaccattgaatttttcaaggaaaaatcatcaaaatttgaacaccaagaaaaaaaaattaccttgaattttcgaagtaaaaaaacagaacaggagcacatgtgaacccatgccgcagaagaccacaagattcagtcttgtgatcacagaagaacagaataatcttacttagctaccttgttcataccgccaagaacttggtagctttctccatgaacaagccaactttacagatcaactattaaaaaaaattatgataatttgccttcagaaactatgccattggaatcatacaccagtaaggctcaagcataatacagaggccgaattaacagctaataatatcaattaaacctttccatttcagccactgtttcttttggacaaattaataacctgacagtaggtagcaggaactaatatttacatgcatatatttgaaacttgtcagtcaaaacaggcactgaattacgaggttaattagactgcaaaaaagagagaaaaaaaaccaaagaaagtgatcaagaacaggtgggaagaaacacaaagcgagcgagaagaagaagctggttagtcttcaactccactcacaaacaattgattttttgctttgatttctctctcccgccgatcgatctgcgagcctcgtcgtgtccaagaacaaattgaggttacttgcctttgcgaatccgctccgaattttggtttttgaatttgaatttgatagaagttggagattgcccgccttggtgctaggccttgacgacggtcatcatgcgcttgaactcctcgaagctgaccatgccgtcgccgtcgctgtcgacgaggcggatcatgtcgcggcactcggcgacggcggggcggccgccgtgctggcggaggccgagggactcgagcacggtgccgagctcctcggcggagatgaggccgtccttgttgccgtcgaacacgtcgaacgcctccctcaggtccctctcctcctcctctgcttcatactcctcgtcagcggcggcggcttcctcgtcggcggcggcggtggaggggagcgggtgctgctggtggctcttgcgccgcttggggatggagtcgtagagctcgcggaactcgtggatatcgatgagcccgtcgctgttggcgtcgacgcgggccaccagggcggcggcctcggcggcggacgacacggcgatgccgaggcgcttcagggactcctccagctccgccgccgtgatgaagccgtcgccgtcgtggtcgaacgtggagaacacgatcccgaggtcggcgtccgggtcaggccgccgcggctcctcctccggcctcttcttggccaccaccaccacctcctccccctcctcctctctccgcttcttggcatcgccgcacttcttggtcgctggcgaggaggaggcgagggagaagagggcgcagaggccgccgaggaggaagaggaggaggagaggcgccatgggtggtggttggggttggcagcgagtgaatgtgaatgggagaagtggaggagacagggaggttaatatatgcggaggttggaagcgatggtgctggcgaagaagaagaagaggaggcagtcgcagtcgtcagttgccgatcgtgcgacctggtggtggtagtagatcgatgggtaattttcacttgcgtccttgtgtgatgctaatattacagtttaagaacttgggagaatagtactcccttcgcttcgtattataagcagcgaattaaatttgaaaatataatgttcatttattttatttatagaaatatccgggattcaaaacttttacaaaaatataccgtcgatctcgcacaaccattgcacgaaagtgacatgggcgtgacgtcgcgggcggtctcgcgcagggaaagcgcgagaccgcgcggtctcatgaaatggaagagcggtctcgcttaaccaatcagcgataccggatttcaaaatagttaattagtgattaattaccataattagtgattaattaattattatttaatcactaattattattagttaaataattaattaggtcattagtcactaaccaaatgcagtttaggacggtgtcgctctctgcttgagcgagaccgctcgtccatcctgcgctctcgcaccgtcgctgcgcaagactgcgccgtctcgcgctttctccgcacgatatcgctcacccttgcgttattttcgctcaacggttgtgcaagatcgatggtatatttctgcaataaaatttatatcctgaatattcttgaaaataaattgaataaacaatatatttttaaatttaattctataaatagcttacactttttaaagtcaaattgcttgaaactttaacaaaatttatagaaaaatatagcaatatttataatattaaattagttttgttaaatgtaagtatgtaacattgaatatattttaatagtttatttgttttatgttgataatattgctatatttgtttataaacttatacaaagctagagaaggttgattaataaaaaagtcaaatcgatttataatatggaatgatgttgtatccaaaagtggctagtactattggttgaggttaccgaccaattttaaattttaatttttaattagatatgtaataataaaaaaaaggtggctagcttgtatccggtgttttatgaaacattccgaaactttgattttatgaaacatattgcaaatcataggatggtatgaaacatatttaatcttcatataactacgagtttatttattactagtttcttttgtcaggaaattatcacgtacatttaacattttcctttctgataataaaaggaataaacaggacatgtactgatgtactattatctaaaaaatgtactgatgtacttacatagtactgtactgt

SEQ ID NO: 60053 - DNA, 2375 bp, Oryza sativa
cgtggtacggaggggtagctttgtaacggcaggtaggcgcatcagcggttatgttggtgtagtacttgggcttgcttttcactagcttttggacggtcagtggagtggacggagagactagtaaggccttgtttatagtttctaaacaaaaactttttatccatcacatcgtatatttgacacatacatagagtattaaatataaaaaaaatcaattacatagtttacgtgtaaattacgagacaaatattttaagcataattgcgtcatgatttgacaatgtggtgttacattaaatatttgctaataatggattaattaggcttaataaaatcatctcgcagattcctggcggaatctataatttgttttgttattagattgtatttaataatttaaatgtatgcacgtatatccgatgtgacaaccaaaccaaaaaaaatttccccaactaaacaagccctaagattttctaaggttgcacccaggataacgagtgggtcgacccacgaacccacttatagataaaattagtgagtaatccacgaatcaattattaatttaacatataaatagatttatgggttggtccacatccttagataaaaataaaccggaccacgacattgccagttactatttggcatataaacgggttggcgggtgagcttgtttgcatctctggactctagttgtgtcgtacggagtgtactagtatttggcttcggcaccccgtggagtgcgtgcgtacctcccacggtgtggtgtgatacgtgtgatttgtgccgttaaacgtgacacatggacctttttttttctgagaaacacacatggaccttgttgatagtagtatttttctagttttgccgttgtcactctaggcaacccacaaattcacaagatttggcatgaaaaattaaatcttcacaagtaaatttcattttgggtcactttcattactgttttggtttagaccacactttaagaaatatttttattttgaactaagtaaatttaactttgtggcattttagaccaccctaaactatttttatccatttgtatctacttgtcatatcaaagcaatagtctacgtataatttaactatttttagtctatgtaaggttcattgacaagcaaaagtcgtcgtactcgaaattgttcatatgcttgataagagagtcaggtagtctaaagtaaagtaaaggtaaaattatccaatccaaaataaatacgtttgttaaaagttaatccaaaacaaaatatcggtaataaaagacaacccaaagagaaattaactcaatattcacagctatacctttggctttcaccggttaggttacgactacaagaggaacacgactgcaacataaaatcacatcgatcccatgctcccttgtcgtcaagcagcagcagcaacaatccaagcacacattaccgtagaaaaaaagccactggaacacgtagacagatggacggctgattgagcgaacagcaaacaaaggagacgtttggggcacacataaactcaggaaaacaacacggcagcagctagcaacagggcgtaccacctattttttctacaagatacacgagcgaccacgtattgctcggacctggagttttatcaaatgcggtatatatgcgtcgtatataccccgggccctctttaactccgacaaatatgtgttcagaagaacaagtcgttgctctgtaataataagtgaagcaatcactggcttaaatagtttcctgacctgttcatcaccttccacctgagataatgaacagagaaatcagatgcagacaggtggcagattagtagatgttagagacttgttagttgcctgcgcatcagggcggaaggcttgtgattatcctttttttttctttccttttctttacaaatgttcactacacttttccaggatctttgaacaattttttagaccaaaggatatttcttctttttcctaagataatctctagtgctgcttgcgtcatttgtgccaacttttattgtttgttataagcccgaaatggacctaccaaagtaccacatataagctgaaccacttgcccttcaaaatggttgcaacacgcagaaactgagctagtggaatggaacagtttttcttataagttggaaccccaaattatctggacatatacatattgtttcaacagatcataaaagcttttgtgactaattaattgcacacattgcacgagttattctcaccaggttagtgttccctccacaaaacgtaaagtccacctttctcccaaatccaaccaagagtcacaggaaacaaggggggaaaatagaacaaaattcttggcatgcaatgatgcaactaaggggctgcaggaa

SEQ ID NO: 60054 - DNA, 1395 bp, Oryza sativa
tgtcctaccgggcagctatatcaactattctcagtaacctctttttggtcttgatggtttataccaactttgcagaaggatatcatcagctttgggtgtttgcacgactcagtatgatatatgcaacatcaaatcaattatgacaaaatgaaagcctacgagaaggaaatagaagcaagcaagcatagtctttacttcatcagccttttataacttctattagttaggcattagacttacatgataaaaggtcacactagaaaaagaaaaaaatattaaacacgacatatgaaacaaaaactgcacggagaatacctgaatatttaagtaatggagacctgcaactagggtaggaaaaacaaggcccgaagaaccatgtggaaactcggtcaagttatgaaaccacagaataccaccctgtataattgtcaaaaaaaatgaaaacaaaaggttaaacctgaagaaggtcaaaataaaataaataaattaaaatggagtagacagtataagaatgtgaatatatctattgtattaagaaccagaaaccttgaacatttgcaattgtgcatctgattcatagaaatgggaaagaaaattaaacttctcttatggcaacaaaaaaaaaacaaatttaccaagtttaatggccatttacttaccatgctctgttcacaaggtttcctttatttaaacatgaaaacaactcatttgctgcttttataaaaatggtgaaatgtacttctgactcacaatgtcaccagtacctatttgtatcacaacttaaatagatattatgtgctctagctcttttgaaagaatagtctaagtcaccttggacaatatagtacaaataacgttctttgcaattccacatcgcattttaatttttcagggctaaatgacccaatgcatgtgtgacagcatttgttaactgtattccatttgatccggcaaacatgccaaaggcatagccaaaaaaatattacaaagtttttattctattaaaattctaaaaagacgcatcataattttaattaatagaaatgtttttttagcatatgaaattataaaggaccttcggcaatggaatttaaagcatcaaaacaatactaaaaatgagcgtagctcatgaatggttataaaacaggggggaacactacatataataaagtatagctgctagtacaaatgtgtaatataataaaaaaaataccttgtacatacattatctagtccagggtgattgctcaaacacatagtccttattgttgacatccacagtataaagcacgggaactgcgtatacaacaaacaataatgaacaattcggaaaacaaattatgatgccaatgtaagattcgtagctattattagacaatatcaaggatagaagac

SEQ ID NO: 60055 - DNA, 2760 bp, Oryza sativa
  unsure (1)..(2760): unsure at all n locations
caaaccaactaaaccaatgaagagctcatttaaaatgtacgaaatttacagcaaacatatcagtttcccccattactaaaccggagagctcccacatttcaaatggggcctagagttccaaccaattgcagcaagagcagtaacgacagcgaaggacgcataccatgggatcccggtgaggttatgaaatccgtcgaggatgtcaatcagcgagctgacagcgaaccccgacgcgcttccgccatctcctgcggcggctactccggctgcatccgccgacgccgcgctggtggcgaccacttccccgaaatcagcaccacccgcgtcgtgcaggtacgcgccttccccctcggcgcgcacgtcctcctcgggagccttctccgccgcggcggggccggccggcggcggcgagcgggggtaccaggagaagcttcgcgcggggacggcagcgaaagggactagcagcggcggcaagcgagggggtgacgggagcagcggcgcgcgggtggtggggcttggatccgaggcggagaggtggtggtggtggagcacggccagcggccgcgggaggcgccgaccgccgccgccgccgccgccggcgaggcggccgaggaggcgaagcggaagcgccatgtggtttgtcgtgacgtggcgtgacgtcacaggagggtgtaaagcacgtgacgagttctctccgagccgttcgattaggaatggacggctcagatccaatatggcacatacattttcacaaaacccccttgtttttgtagtaattacaattctgggcctaggcatctcccctcttctcgggcaagaaccctagccaccttcgccagtctccggctcgaacgcggccacggcgaggctgcgcggccagtgatcttgcggtctaggcggcggcggcggaggaggaggaggaggaggaggcgtcgagatggtggtggcatccggtggagggcggaacgcgtgggcgaaggagatgaccatccgccgcaggattaccagcatgtgagctacctaacctgaactcctcggattttctttttttaaagaaaagatttagctgtcaagttcatgagtttgatgctttgtgtggataacgatctcagattcaacaagacgcgggagcattttccgtccctgaaagattacaacgactatcttgaggaagtcgaggatatgagtaagttgttttataacttgtctctaggttggtcatcattcaacagtaaggaagcaaatgtgattgatcaagatttgcttgtttgaaattcgtttttcaagctttcaacctgatcgaggggatagatgtcgaggtgattgaagctaaaattgccagatatcaacaggaaaatgctgaacagatatatttgtcccgggctaaaagggtatgctgttcatcattgcgggctctcgtgctgtatttgaattttatgattgataaccatcttatttcaacatctttttgtctgtaggccgaagatcttgctgccgcacttaaagcaagcagaatgaaccctggcaaggctggtgccaatgacacggttagttgatagtattagcattagattatacagttaatatatttttgctccttcaacagtataggtgttgaggattttatggttggatgtgtattttttatatatacatgagaaattccatcatctttgaatgattgcaagtcttcctctttggagagcatcatgtatgaatcttaatagattctagctgtaaaaagctctgataaaatttcttcagaaaatggtattgaaggcatactgaattttactcccgactgtacaaagatctaataaaatttcttcaggaaatgatatttaaggaattactgaattttaaagtgcaaaactttagaatctttttaacttgacatcctatcaaaagacgtttgatacaagacttgaaagaagaaatactgtcatcaaattgtgatcaagctgaaacatgccaccacatgagtacatgactaaagtagaaattatagggtgccgatgtaaaggccaaccattggtttcagaaatgatgtctcagttgacaatgcatttcatatccttaaacaatttggtttgcatagtaatctttcagcttcacaaattggctgtttaaattatctggctatattatggcattactatgtaccatgtcagtttggaccttactttgtagtatttgctaattttgttgagctattctatttcatctgatttgactacttcatgtgatgtgaggtagaattgtagaaagaatttgatgtaaacttctcgttcttcttctctgtaacagcaacacttgaaattggtgcattcatctattgattcgatacactgtaatatgttctgttcttttgtttattagaaagatgtggtatttattccaatacttggtactcttgcaacttgtaacaggctgctggaagctctcagggcattagtagtggcgcgggagttcaggaaggccagtatgcgcctgctgctgttcccggtgggctagctcagcctcggccaacagggatggccctcaaccgatcggcggttcatcggttcctcttcaaggagatgatgaggagaccatgaggctacgtgcggagagcggggctcgagctggtggatggtccatcgaaantgtgcaagagaagagcattgcaggaagcgttcagtaccatattcgtctgacggtcagattagacgcaagagcacctaacatgtaggatgcctgataattttgtggacatccttt

SEQ ID NO: 60056 - DNA, 4828 bp, Oryza sativa
  unsure (1)..(4828): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcaaaagaaggcacgaaaccaaatcttgtcacataatagagttggagagccatgaccatataaactttctatagtacttgccttctaaatatgtaggtaccttgcatctacatcctaaaattggtgaaagctccaactaaccttgctgtcaattgacctctctctgtaatttcccacagctttattgaactgcacactcgtgcaagcaaaatccacacatagggatgctaatctctctcaaagatgcagttcaagaaagctgtggaagaccacaaagaggaccatcttcttttgcaggtgcacagctaataacatgcaataattcatgtcaagaagctggcaagaaactgtggctagctaagctagttgttcacttctttgtatagttcaggtgctcatgtagctgaagaagagttgaaatgaaggaagaaggcacaagaagcagctagttcttgtaagcttcagcttagggaggtggagggagaaagaggggagagttagggctatttataccagcaaggtgaggaggaggccaagcatggggttggtgagaggttaaggaccccaatcccaagaagaatatggaggccttcctcattcactttctccctctctcaactctgatgaactctgaagaaaaaggagaatttttggctcatcaatccaagggaggctgtaaatcagacaggagacagagccaatttctttacttgacacacttgtagccaaatgtgccactggcttcttagaaaaaaagattggcatttcactttgttttctttctgttggtggttttgatatgtgggttgcacaaaacatgcaaagagatgttgctgaaagcagtgaaaagatggagctttttctgcctttctggttgagttgagtaagctattgcacaccctacaggcaggtcagcactgagcaggtgtgatcagtgagctaagtggggtacagatcaccagtgggtataatgtgccaatattttcaagaacaattctaaagtaagatttccatggggtctccagtgattctatacttgattgtatcccttaaaaaatggatgaaatggtcttgtctgtttatcacttgatttagaattgtgatcttgtttcaaaacaaatatttttttgaaaggaaatatcaaaacaaatataaaggtgactgttattgtcggtcccatagtttaaccgtctatagttaggttgagttcaggttcgaaactacagaatttctctgaaaaaaggggtctgtaactatagttcatctaaatgtaatttttgttttgcctatatttcaatattaatttcggttcacaattttgagccgaaattttgggtactggtaaggatgtgcttttggctgaatttttttttccttaaaaaaaggaaaatttgttcaaactcagtaataaagtttcccaacttttccctaaaatttccaaaatgttggatgtcaccccctctgaaatgtttttgttttttaaaatagttaaaatcctagttttaatcgtattatcgtttttcactagctacatgaaaagtcaaaggtatgttggtagcattagatgtggtgtttcaacattaccaaaattttggcacattttagtgttgctatgttggtagcattagatgtggtgtttcgttttaaagcctcatattttagtgttgtcaatttttttagcgttggatgtggtgtttggtgtatattgttgccaaatgattttagtagagtttttaagagcaaaaacttccgtaattacctcacttgataaggtaacaatgataagaatatgttcgatttgttgccttatcaaaatttggtgggattgaaagtggttgtccagagagtgattttggttgataacctgtgcttgacacctgaattaacaacccggtccatgttgaagcgtagaaaaagggggaaagcatgcgccaggttctcgcgcaaaggtcataccgatctgacatgcgtgaacagaggcctgcctgccaatgccaatgctttctcttctctattgcttggggccatcaagcaagcagtagttattaattagttaattataaatttataatcagttgagcaatctcagaaggagaagctaggtagaggagatctcggggcaaaacacacaccaatgctagtagcttctctgaacaaatttaattttactaaattcaacatcatcgctagctgtcccgacacgatcgaccggactgtccaatgctggctcaaatggagcaagaacctgaatttcctcttgtgccagatgataactacacccggatgcagacatgcagtcaaagcatggctgtgaaatttctgaatccagagatctgaagccttctcgggtgatcagtcgacgacggccacgtacgtttagtaactactagcatgctgtaaaagtgtaaattatgattttttttaaattacacagtacaacacagacactcacaacgcacgcacactcacccctaagaacgcatgcacgcgaaccctacccctatgagcatcttcgaagactaggccggtaaatccatcctggagattgatcaagtcagcacaggcacctcgctgtcgatgagtatatcgtctaccactgaaagcacaaaactgttaaatcctgaaaaattcgttcccatgagaagttgaacccaggatctgaggtgctactggggctctggtaaaagtgtgaattaagtagtggtaattacgcagatcgatgctgtaatattatgatgagatactagtaatagagaattcaggtaaatttgcaggttcgatgcttctctgacatgcgtccggtgtcaggccggcgtcagagcgctcccggatcagacggcgccctgcgcgctgcatcgcctgcacgcgcgcatggcttccgcgagcttcttccattatcccaaggctaattacgttcttgatgatcaggtacttaccggtgatcggtcggtgtggcgttgtttggaagcaaatggaggtagtagcttgcttgctgtcagactggctgtcagtcaagagtgtcagtgagtgagtgaagcacgcgtgtttcgatcactagctagctgaagctgattaattctgcttaattagcttgcatgctttgaccagattcatgcatatcagcagaaatgcagaggcaatggctgggtggtggggtgcttggaatttggacggatcaacctgaattatgcagaggcagcgcggcatgggggggaggccgtgcgcgcgtgcggcgtgtggggagcagggcgagcgaggcggagacatcctgctcgcgcgcggccgcgagggcgccatcgatcttcgaagctgagactgagagctgcccgagatgtgactcggcaaccggcggcatattattcacttgctttagtttgccttggactaaacctagggtccatttgaaacgcggaataggaaaaacgaatagaaaaaacgtaggaattaaagttgtatgtttttctaattctataggaattgaaaacacaagaaatgaagagaagagtcctttgattacaccataggatacactcaacaaaggaaagtttcacaagaggtctaacctcttgcttattttcctatggaattgatcataggaatgcaatcctatggaagttttcctatcctcttcctatgaatcaaagggctctataggaaaaaatccttatgaaaatgaatcctctaaaattcctttgctaattcaaaggggcccttagacgggtacgtgtgtctaaatttatagtatgagaacttttataatgagagaaaaattttataatgagaggagtgtatatctctactattataaaaactaggtgggtggcccgcgcaattgcgcggctagcacccaagcaaatcatatatttttagtatgattttactaaaaatttattaaatagctatctcattgtcttaagaatttgaaagaccaaaccttatcatcccgtgtttctaattatatagtttttaaaagtcacatcagttgctaccccttatgtcatcttcttctttatttgcttgctcgatctaccactatttcaattcattctccttgtaacctttaaaaattggaacttaagtttttagagtttattgtaacgttgggtttcgtttttataatttgtagacgtcccgtcaagcattgccattatgctcctctatagcatgttcattgtcttttctctttactgtcattgagattttaaaaatcgaacatgattatcgttgggttcatttttactttttagaagtcccgccaaaccttcagcggttttaccattgtacttctctacggctcgtccgctgcctcctttctttattgtcattgagattttaaaatcgagcatgattatcattgtttttttattttttagaagttacgaacctttaaaaattggacattgtagtttttatagtttattatcttgttgggttttatttttttataatttcagaagtttcgtcaaacgatgccactatgctcctctacggcccgtccgccgcctactctttattgtcattgtgattctaacaacaaacataactatcattgtaattcatattttattt

SEQ ID NO: 60057 - DNA, 800 bp, Oryza sativa
acttctttcaatattgcttatttttaatttcgaatttcaggtatttttaaattgtatttccacttggactcttttttttttaattttggattttattttatttttatttcgaattttaattaatcttgtattggtttcttatatggaaacttctttcaatattgcatatatttaattacgaatttcagctatttttatattgtatttttgcttggactctccttttcttttttttctttttctccgattaatctgggaatttctagcccccacaacgaacgtggtgtttcatttcaaagctgttttaataatataatagaaagatagatagatagattatgactttacgtagagggtcaaagaatcgggtgtgcagccgtcttggaatgacgtgctcggtgacatccgccgatctggtgttctggtgacatgcgactcgcaaggaggtggcgaagatcggccgcaaaaacgttcagtgcgggtgtcatccttgtggcatggtcggtttagaaggatagggtattcgaagacaaagcaaccttggtgactcagctatgcgcgaccatgacggatgagtggggaactaattagacagcggtcggtctcttggcgctcataagcgaaacctgaacgttgcgaggtggacccaggcatcgggccaactgagccacggcccaaggcactgaaaagcctattatgcagtacaaaacttcgccatgtaaattcaagtttagcccaaaataaatcctacatggcgttgatatgacatgccacatagatatgatgtggcataatcttga

SEQ ID NO: 60058 - DNA, 6595 bp, Oryza sativa
aatcccaaatgggtatagaatgtcaacatcaccacacttctttaggcacctatcgtccggcaatgatgcgccgtctgccatgaactgtagggagatcacgaggcctatgaacagcagcagacgcattgctagtttttcaactgggagcttgtagtagcagtccatagttgggttcgatatgctacagtttcagtgctgatgaaatgtatatgcaatggacatcttcgtctcttatttctctaaatatagtagcttccacaccctacttggttatctttatattgaacttgttataattaattggtcaaacacaactatataattaattatttaattggtcaaacacgtgctatagtatggttctgccttctcaatcaagtaggaaaaatcttctttctgagttgttttcttctattttgttcttcgcgagctgggatgagatgcaacttgcaatactaaacaattcttagatatcttttcctctcgtgcccccggtcgctccgtcccagggagagatttttgataataaaccactaaatacgcgcgccattgcaatccgcatgtcttctctaatacatcactaggagtgctaattttttgatttcataccactttctctcattcccgtcattttttcttttttttttcgttttctgtttttcccttttctttggactgttttacccctggctccacctgtcaggtaaaagagagagggagatggggttttatctgctgctgtgcgccggttgccctgcccttgcctcttctcgccagagagaacaaaatggcatcaggagtacgcctgctgccctgctgttcctcttctctgagcaggatagtggcatataactgttgcatatattgctgcatgtatagtatatatgtgtatacataaacggttgctccggatgccaaaattttgacagcttgtaagcaaaattttgacagaatgtaccctaaattttggcagcatgtaccttgcaatttgtatagcatttgacacaagtcaagaaagtacccataatttggtcacagataaaaaaaatggcagcatgtacccataatgcatataaaatcatttcagaacaaacaagttcaatagcaaacttgagaacatcatccagattacataaccatttggcaagttgagagaacaaaatgaaatcaaccagctttgtcccatgtttcacattacaaaagcatccagaacactaaatattatatttagaaaagcattcattttttccctttctttggagtgatcttccttgcagctctagtagggcctcggaggggttgccatttgactcgatccttctccaacaacattagtcaatgccaattgccttcaatgaactgagtgttagtaaaattttgagaatcaatcataccattgaactaaagaaaaatcataccttctagtgacaagcccaggactcatattgctggaatcattgattgcaaccttttgtcttttgggtgtgctagaacccgctgcatcactagttgaacctagtggtcttccttgtttggcacgatttttcctaaaaaatgtaaaacaagttaaatgatctataaagattaatgtacaatatgctagaagtaaatgtatgtggctacctttttttcttggtaccatttaaaggacattttgaggatgtttgcctatggcccatgttaagacacctcttacattgaatctgccaccttcctttggtcctaggtttgcttcctttctcaaggcacccaactatcctattctttctttgcctccctacgtccctcatagtgagaggtggcagcaacttgaaaccaatatttacttttggccattgggacttatctggaagtggatgaataactcctgcatatgccagcttatacttttccactgaataacaaggatccaggtaatcagccattcttgggtttctagctgatattatgagagctaatgcatgtgggcatgatttgccagaaacttgccactctctacaagtgcatgtatgttctgtaagattgacagcatgcctactaatatcatgttcaggagtaatctccgccatttctgcttggtccctattaccttgcactaccttcaagtgacccaaatctctagtcattgcattcagttgacgaactacaatagggagcatcacaccatctagtttctcacctatcttcctccgtctcgcaaatagatccattgtctttgctctgatgccttctgcaagatctgcaataggacgatccttcatatccttgacccatttgttccatgactctgctagattgttggtgatgaagtcacattttatcttttctgagatcttgtcctccacattaacaaacaaaatcaactttctatcactcttcctaacaaacaatgcatgggctacatccatattatccttaaacagtgtttcctcaccagtgctcatgtcgtagccacttatcacaacatgttggctgctgccccattttacccttgctgcaagatccttttccaagctctccaatgtgcactgatgataatccacaacctattcaagccatttacgcgccacttcaacacaagtaccatcatcaagtttagctataaactgaccgaactgaacacacacgctaaactccacatcatggttggtcctatcacatacgaacaagaaaaacgagagtaaaaaatcattagttcacctgctaaccaaatatgtcctagttttgctccttagcccgttagtgcaaataatggagatgtggagagttatagcattacctagaagggagttcacttggaatcgaggagcttgccgcttgcgccatgatctcttgaaccgtgacccccttccccctctctatcttcaaaccctagggtccggaggctggccggcggcggggcaaggaggctagctggcggtggcgggtggcagggtgatggggaggctggtggcggcgcccggcgaggaggcggcgcggcgacgggactggagacggcacgacaacaggacgggagtgcacgcgctctgcgtccccttcccgatccccttctctcgatccctctatctcttttacctcacaggtggggccaggggtaaaacagtccaaaaaaagaaaggaaaacagaaaatgaaaatgaaaatgaaaaaatgacgggaaggagagaaagtggtatgaaatcaaagaattatcactcctagtggtgcattagagaaggcatgcggattgggtggtaagtttgcaaaggcgcgcatatctagtggcttattgtaaaaaatcggcgtatgaagccgcaccgccccctcccttcccctgctctctcccgcctcgccgccgctagagcagctgccagcaaagccgggtggaggcaaggaaggcgacgacggggctttccctctccctcgctcgtgatcaaggcggttggggcgccgacaggagcgaggcaccggcgacaatgtccagttccagcgctgccgagcatggatccggccctcccttggccggatctggtgctcctaccggcgggagtcgcgggggacagcggccctcggtctggcgatggggatggccggtttcgttgcccattggctagatccgccgccctcccagccggaagcgacgaagccgtggtttgtcaaggagaggtaggaaccggcgcgccctcgccggtgcggagacggtagccgtggcgggaggccgacgacggaggaaggagtccgatgcgtgccatcgtcagcgggggatggcggcagatataggacgccggtgatagaggagagagttgggaggacggcgatggaggtgggagccgggcgtgaggacggcggccgccggctgtgcccaccggtggttgtgggaggctggtgatggcggcagtaagaggctggcaccggtggcagcgggaggaaggtgcagccggcagggtgaggccggcgcgggtggcgccgacagctgcgggaggtcgactcggtcgaggcgagctattcatgggcaacttggtcgaggcaacgacgacaacattgccataaggggggtgttgaagccttcggcaagattcattccaggcgattgttctcttgcggcggcggcttgccgccgtaggatggtcacgttttaattaggtttttttttcatgtccaagggtttttttttttttcgggctttcctttttttgtcgatttggtttgttcgttgccttttttttttaccgatctcagttcgatccaatgtgctgcacacgcacaatgcccctccggccactaccctagccaaatcctagcgccaccgcgatatcgatctacctccctatgcttttttccttcaactagaaaaatgtccgtgcgttacaacgggtgaatgttatattaatcttatcattattattattattatacggtttacttaaagtgaaattcactgtgagaattagcttgtatatatatatttccagaaaatcatgagctataattaggagtccgattaattatctcaagttagcatccgagttttcttaaagggatttcttatacgactcctttgtttccaaaagcaaacaaatttaaaacccgactcaaatacaaatctgtattttcaaaaacgaacaaacttaaaaaccgactcatacacgagactcatacacgagtaatatatcaaagtaccgataaaaaatcttcaattttataacgtatcaaagtaccagtaaaaatatcttcaatttttataataagtagagacagatagaaagatacatagatagctagctagatggatagaagaaaaaggaactcgtgaaaatcccgtgggccgatcgtacgcacacagtttttgtttaccttttttacatgtcttgcttatactacgtacgtatacatgggttattagcgcctgcttatactacgtacgtacatgggttattagcgcctgtaggcaggcgtttttctcttttttccaatatatctcttgcatacgtgcgcgtactgagagagaagatattagccggttttagcatggagtaattagttaatagatccgattaacggttgataataaagggtccaccaatttaaatggaaatcgatggttggatatttttcttttttcttagaatttctatgattttgtctaatttattagagtgccatgttgcagcgtaggagcgtttgtagagtaccacgtgactgtttgagagtgtttttaagaagtttaatggacttttagtatagaataaataggtagattgattgcaaaaaattgttccgcacttcttcctcattattctctccatgatttcccctttcaattccattttaattcttcggatttgatctccattaaagatggccgatcggcgagcttccctgaactttttatcttgagttttgctaattttctctgattttggagaaacggaaagaggagattgagtagataaaaaattctcaactaattataggacatcgagaaagattcggccggatttgatagggagtgtcggctccggcatcatatgggcatggccgcacgggactatgttctggaggttgaagattgtagtcagccatgcgagctgagcctgtgactccacttatacttgtgggttgggtcgaacagagatagaccgagcggagggaacatttatacttgtggctgggtcgaacagagatagaccgagcggagtgaaggaaagaatggcctttcagccaaaaacatacgaaggattttcattatttttttcaattactagaaaaaatgcccgtgcgttgcaacggttgaaggctattttaattttattattgctatacggtttaattaaggtaaattcattttgagaattcgcttggacatatattttttctagaaaatcatgagctgcaattaggagccatatcatcttaagttagcatgtatgttaaatttttaaagagatttcttatacgactgctcatgtatttccaaaagcgaacgaatttagaacccgactcaaatacatatctgtatataaaaaagcgaacaaacttaaaaaccgactcatacacggatgacgtactaaagtaccagcaaaaacatattcaatctttataatagtttcactgtgagaattcgcttagatatatatttttctagaaaatcatgagctgcaattagaagtctaatcatctcaagttagcaacttagcatgcaagattttttaaagagatttcttataagacccctcctgtattttcaaaagtgaacgaacttacaaaccgactcatacatggatgacgtaccaaaataccggcaaaaatattttcaatttttataatagtaaaatgtacggacgaagaaatcacgtttaactttaacttttttattaagtagtagagattatagttttatagtgatttagttatttttaattttggatcgatcatgaaatattcacacacactgtagaatatccatatatttttagctttggcctatttcaattttgaactttatttttaacctttgagtaggtgcaaagccgcatgcgtgcaaagtcatcagtcgagcgtgtgagtggcttgatctctggatggcaatcatggcatgcagtcgaaggcttgcatgt

SEQ ID NO: 60059 - DNA, 19294 bp, Oryza sativa
aaattcctatggtttttccttcaaatcaaaagagcccttaagctgtgttctttccccacctttcccaactcacaccctcatctttcacgcgcacgcttttcaaactgataaacggtgtatttttttcaaaatatttatatacaagagttgctttaaaaaatcatattaatccagttttttaaaaaataataaatacttaattagtcataagaaaatacatcgctccatcttatacgtcgctccgttttacgtgtgcgggaggtgagttcccgactcacccaaatcataagcaccaaacttgagtttctgctctccatagatgatatcatcctagactcatgcatgcactttgacagtgcgtgttactagttgggttggttaaaataaaagagaaaattccaccttttaaaattaatagaaaagatacccgtgcattacaatagaataaactaaaattttgataaacattagatccgtactttgaccttttccgaaaattcctcaaagtcaataaatttcaaagtggattcaattttttcctatcaaattacttttttaaaaaagcaatcttccctcatttaaaatttgttcagattcttatatatcaaaatccaccgcaagatgaaaaaaaatccttatgatcccgcatagggactgatgatggatgaaaaaaaaaaagagaacgataaaagaaagaacgagactaccgatcaggcgcccgattcaggcgtggaaaaatcgaacgctgacatcagcatgcttgtatacgtgcaaaaccactttatgctatttttttctcttaaattatttattcaaatcatgattcgattgcaccattaaattcgttgcaattaaatatttaaaacaagatcacacatggatatattccgataaatttttttagcttattattgaattatttttaaatgttgcacgttgttccaccaaatatatcggaattgtttcactaagtagatcgaaaatgtttaaatgatttaaatcggacgctgtttcgccttatataaaaacaatgtttcagcaaatagtgaaagaatgttacaattcactgcaacattagatctatacatagtgaaacattgtgagtatactaggtgaaacattttttttggaacaaaaataaaacgaattcccttaatagagggtttccaaaatatgtgggtgatttgttacaaaagaatgttttaattcattgcaacattagatctatacatagtgaaacatcgtgagtacactaggtgaaatatttttggtggaacaaaaaataaaacgaattcccttaatagtgggtttccaaaatatgtgggtgatttgttgcaaaagaatgtttcaattcattgcaacataagatctatacatagtgaaacattgtgattatactaggtgaaatatttttggtggaacaaaaaaaataaaacgaattacccttaatagagggtttctaaaaatatatgggtgatttgttgcaacagaatatgtggtagaggccacgtggcaggaggggatagggacacgtggtgggtccaggggatcacgtgcgcgtggggggtgcccgatcctgctccacccccgccggtggcgtccgggtttgagcattttataaaagaaaacactaagaattttatataggtaggtaggtagcgaagatattcctcaactactttttttataaatcgatataactctaaccattattaatatctattttttcaattaaaattttaattatacaattaatcctactttgatatccttgctgatcaaacacaaacatatatatacatgaaacaaagcgtaaaaccttaatatatatagattagcacaacactaatatctcatctatgcacataagcagcccatccaagttcatgatgaacacaactatcgcatacttctggttagcatcgaagctttgaacgaagcatgttttaatttgtcaggcatgtcggacgaaacggattgagtacaaaatcaactctcgcggatgcacgtgctttggaaacaacggctgtggatgcacacgttttctgtaacgatcacgagcgacgatgtagcataccgaagcggagggaaaacagatcacacaggacaccacgatgacgtgtacagacaggaatcagtcccggatacaaacgatgtactgaaattccgacaaaaatacctttaatttttataatatagtaaagataaattgaaaattctagagttcataccacaatattcaacgcataccctgtttgtttcccctactatgagaggatgaaattttagattatcgtggcacgcttttcaaactactaaacgatgtgttccatgcgaaaactttctatatgaaagttattctaaaatatcagattaatcaatttttgaagtttgtaataattaaaactttaattaatcacatatttttaccacctcgttttatgtgaaacacttaatctttatcttcatcttcaggagattcaaacactagaatggaagacgcataatagttcaattcgccgttttggtggtgggatagggatgttgggtatagaagtatagaaaatcagctggtcctggacaaggtttattatggacttttggtttagaccttaaatatgaatttatcgtactcttttttaaaaaaaaaattcttcaccatctgccactacaatttaagaactacatctatgattttttttagaaattttaaatttggttaaaattcctcaaaccctaaccgccgataaccgatctcagctcgtatcccacggtaataagagccccgtaaccacgtgatttcgcaaaccctggtcccggcatgcagaacggctaatgattaatgaactgacgcgtagtagaaataaacaatctgtgtcagcgttcgctacaaactacggagtactacatttgtaatttggattattgcacactcactggcaccttgcgctgactgggcataacctgagaatagagaagagggtttttgcacctgggagcagttaacggattgctgggttaggtttagactttagatctggactaacctctcacacgccgctgaagcccacgttgctcacagttccgaccttagcgtatgacgccggcgaggcggcgactgttcatcgatgtcgtagatgcagagatccccgtcgttttccctgaaattcttcatgaactagacgcggttccgtttcaggttgcacgcgcaggcgtagcacgaggtcgcggcgatcccatcggacaagaggaaaacttactccgatgtcgggcacgcgcgccaagcccggcagctcgtcggagaggtcatcctgtacacggagactgcgctgatcttcctgtcagcgaagtccaggaaaccgagaaggacctggaacagctcaccgtcagactgcagcagccagacgttgccggtgtccactgtccacgccttgccggtgtactggcgtcgaacttggcgaccggatcggagaggacggtcgggaggagaggtcaagtcaaagtggacggtgcacatctcatccgcgttccattcgcataagatgaatcgcagcgtccctcccacggcggcgatggccgggatcgtgttcttggtgaggggtgtggaagtaatgcggaactcctccaggcgtcgccgttgacgaggcataagcacatctcggggtcgtgggtgtcgacgagtatgacatctgcattggcattggctggactgcccgggcacggacgccggcgacctgacgggatccgcgactcgtagctggactccgtcttaccggcacggggcggactcgtgcaagtctaacgcccaatggagaagttgacggtggcgtggccacgtggggaggttggtcatggttgatggtcccacacggaaaattcggcctaactacctggaaggccaccactgcaagtggcccacaaagaccaacggagattggatagctacaaataaataagtccactttgacaccctcgtaccatctgattcgtatgcctcaaccattagatattttgtggttttcactgacgtggcacgttgacatagtccaccctaccgagacatcatgtgggacccatgtatcagtgtccagcttcctctatctctttcttttcttatcactctcttataacaggtcatcctttatatgaagtgtgatgaagtcatccttttataataggtctatgacggttgtaggtcagtggttaagttggtaaatccatgtaatagttattggggaccaataaggaagcgccatgtggaagctagcggttagaggtgccgaggttggtttggccgaaccacctctggccaccgactttctttagtctctgacaagtgggtcctatggtggttgaggatgctttggccccactttagatcgcttttgactgtcatgtgggccttccaatccttgtactcgcacttgattggccggaggttcattttgtctcatggcgggtgaattctcttcttaaatgatctgtaaacatatttctaccaaatctagtgaaaatagttaataataaacccgccacattctgcccctatggcaaaattggttatatagcatcaaaagttcacatttttggttttatagcaccgaaagataccggttcactttaatagcattcaaagttcatgtaaaagtagaatgcatggcaatgaggggatagaaacgtcatatcgtgtgtgtggctgggtaaatagcgatcaacgcggacggaaaacgatcgagaattgacggaagtgttaaaaataggagtggggtgaactttgggtgttactaaagtgaacctgtatctttggatgctataaaactaaaaacgtgaactctcaatgctatataaccaattttgccaaatggggccagattctgttacggcggcagcgtcgagccgccgaggtgttatcgtgtccgcgtccaagcgacggcgctccgctgcgtctgcgtctcgccgcccacggcagcgacaaccataatgcggtcgctggctgctgatgattcatgcgtgatcgatcaactcagagagagtcagttaattccttctggaataagtccattttgcctccctcatctcttgcgcttggttgaatcgcatccctcaaccgcaaaaccgggtataacatatcccccaactcccaaaaccgttgtaaattgactccccggacggtttcgaaggcggttttgtcccacgtggcatctttgaccccgttgaatggctgagtcatcaggtgggacccacatgtcagccagccggctgctggtactgcgtgccgacagggtggccttttcctcctcgtcatcgtcgttctcgcccgacgacgaactcgagctggcggcggcgggctggcggccacgttccgcatcccgccgcagctagagtgcacgcaacaggctgggagggggctagcggcggcgttctgcatctagtcctcttcgtcgctgtcctttcccgcctccccaatcaacgccacctggtccgcacggtggcgagcaacgatgacggcaggaaccccatgggtgtcaacacgaggtcctcgatggtctagcgatcgtcgtggaggcagtgtgcggaggcgatgatgtacgtgccggagatggagaactgtgccaccttgacgctgagcggcctggcgacgtcgacggtccacggcgtggggaagtcgaagagcgcaacatccaggaggatcctttcccttctcccctctctctcctaggatgcgggcggcaggcagtgagcatcggctgccggcgggagaaggcggcaccgatggcgacaccaccaccacctcgcggcgagcgggacggcatcggctgtcggcgggagaaggcggcaccggcggcgacaccaccaccacctcgcgacgagcgggacggcatcggctgccggcgggagaaggcggcaccgccaccacctcgcggcgaacaagacagcggcggcgttcggagagtacaagatctcccaggtccagccgaccgcgaccaccctgtgcgctcctcccaccgcccggccaaccgtggccacccggcgagctcctccccggtgcccagccggctgaggcatcccagcgagctccatccgcgcgtccaggcggccgtggcctcccggcgagctctatccacgcgtccgagcggccacgacctcccggcgagctcctcccctgcgctcggctggccgcgactacccagcaagctcttcccccgcgtccagccggccgcaacatcccggcgagcttctcccctacgcccagccggtcgcggcctcccagcgaggtcctcccccacgcccggcaagccggggcctcccggcgagctcctcccccgccgtgccgctcgagccaatggaaggcggctgtgagagatgagaagatgaaagagagaggggaggggtgataggtgggtcccacctaattttttacagtgaatgccacctagatgccacgtggatgccacataagctaaaactggactcaatactgccttggaagtcgatttgcaccggtttttggagatgagggagtcgttatacctggttgtggttgagggatgttattcgacaaagggtaagagatgagggaggtaaaatggacttattccattccttcttccaccgccataagtgggccacaaaagaccaatggctcataggcagacaattttcgtctccgagtaaatcatgggctttatatgcggccgaatttcaaaccaccggtcaatgggggtatctagcctgctacatcaattgaacgtaggtcaaaactgaacgtgtccacaagaaactgaattccgcttccattttagtatagctggacaaattccagtatttttctcagctaagatgaatcagataaacatttaggagtactaagtactgcgagtcacacattacaacatacaaaagaaagctggtaataaacgagggttacagtcctccaaagaacagattctaggaatacaacagtagcaatatctatagcaatatagaaaatgcacagatttgaaattgtataataacaacagtgttgatacaccttatcaagcaacaatgaccacaggctccaagcgttcggctctgcagcttgctttgcggccgcacatatcgccgcatcaaaagcctgctgctgcctcaatggcacatcagatacagggagaacatccataccagcccaagttgctgaaagcctgaagctgaaagcaacttcattcatcttcacgttttgttcgcagcgtccattaaaagtttaaaaccatcatttgtttccagctaactgtttatcactcgtctagtaagattaaggccttcagttctgggtcgtctgctgcggaggagggacttgagcctggtgcagcgttgctggtgcaggttgttgtgatgagctagcttgcgactgtgctggtgttgccaacatcggctgataaggcggatactgcggtggcggtgggtatggcatgcgaggtgggggcatgtaaccgccatacggtgggtagtagggtgggtactgaccatggtaatattgtggtggcatagggtaactctgtcctgagctgcttgatgcctgagcttgggctgcctgctgtggaccgggtttgccatcaccctcctgtgacttgaccaaggcacccatcctctggggatccattgaagggtacagtgtccgctctgctcctggcggtgctggaatgttgaagtagtatgatcccgatggtgcttgctgttgtccctccattccaggtggttgaggctggtcaccactctgctgctgagatataacagccctggggagcattcctccatgtgcaacatgcccttgccttccagcttcatcgtcttctggctttggtgcttgaggcttaccccacatgagcttcaggcgtatacccttgatgactaacttgttggcaagctcctctgcagctttctcagcaccttctcttgtagtgtacgtcacaaatgcacaggcacgttgcagaaccatccttatggactcaatttcaccatgtgcgtaaaattgatccctcaaatcctgctcggtgattcgattattaaggccaccaatgtaaagtgtccttatactctcatcgtctggaggtgtcagggatggcatctcaccggccttacccaaaagtttcaaagcaactggatcattaactctgtaatgagcaagaagagaatgcgtcagagaatgtgaagtaatatataaatagaactaagtgcaatatgaaccaaaagagtacagtgaagaaaaaaaacaagtcggttcatctcacggacatgattaaaccatcagtaggtgtgcatcaacaagatctcaggtgtgctaccacaccatattgtactaaacaatgtaaagtccaatttgattgaaatataccaagatttcttttacttcatcattcatccatccatagacactgatgatggaattcatatccagagttacaagtactatgcatgcagatgctggtttgcatcctgagacactacacatggatttagttttgatgatagtcttaatattaaaattagttagaaatagcaggtctaacagatataaaaaaggatcaataggcatctttggagtataatgatcattaattgttgcctcttaatgagaaataaaaatatgctaatatccatagagaaccaaaacaagcacacagttcaaaaaattgtatgcacaatcagcacaaacatacccatagtaacgatctttaatgttctgctgagataactctccagtttcaggcatctcatgtcgataagggcattcagcacctcttgtacattcaccacgcacatagaaactgcagacatgagctcgattcctcttgtaatatggtgccgtcctctgaagcttcagaatggtgtcattgggacgtgccttcccatgggaagaatcataatctattccagccctggcctacattttgataaagaaagcctaccataagaacaaataatccatacatttagaggcaggaagaataattagatcatgattaacataggcagaaagcatgtgcaggcactctgccggaccaaactacttaaaaaagggtacatcgtttgttatttgagatcaacacacttaaagtgcattcattttatattccttacaacattaggtttctggtctaagaaaacccattaatttccttaatgtgttatgctactagaatagactagacaataaaaatggaaggaacactgtggacatactagttgcagggaagaaaaatgaaaatagcagtgatatggacataaaccattttagatgagtattgtgaaagttgatacaaataataagttgtgaaaaaggagacataccttgcgatcatgctcttctgcaaagtactcacggttcacatcactccttgggattgcatcatttgaattaatagcgagtgctgtatccctaacctggaccggtagaccatattcaagatctagcaggcagacctggcagacatttttcagtttgcaacatgtctggcagatctctgtcttcttgtatcttgcatcccggccaggtcgccaacggaagacagtaaacggacgtgcacatattttgcactctttatcatattctgctctcaactgccaagacaaacaagaaagacagtaaatcttgtgtccatatcaagatcataagcaaactaaatgtgccgacaatgataaatttgattagtaataaatgtttggatgtggagacaatctcatccacatctaattgcttagtattggacccctacacaatgcctggtcttctgcttgacaatttgttctcgttttcttggctaggttatcctccacaaataaaattctataatcatactactgcaatttgcgaaacaaacaccatttcggtacatgaaaccaacaaaatccaccctagagcagcaatcttttcggcctaactcgtcgctaaatcagaacaactacaacaacacacgtaccgcaatacatcccacagaaaccgacgcctaacttttgacccccgatctaccccaataacaacagcaatcgcaaaccaggcaggctgaaatcaccgcgcccgcagccaccacatgaaccaccaagagcgcgaatcaatcagatgcggttagggtttgtgggggggcaagagacacggtaccatgcggacgtaggggttgtcgccgaggcaggactcgcagatgatggggaagtcggaccgctcccacccgtccgcctgcgcgtctcgcagcagccggtgagccatctccgccgccgccgcctccgcctccgccgccgccgagaaagacgagaggaaagagagagagagacgaccgagacgaggcgagctatctgatttggctttcctccctctttaaatgggccttattgggccgtactaccttgcgtgagcaaaacgtgggctgggctggtatgggccgggtcagtgggccggaccagatcagcacagtggatactacagaaattttgttgcagcttgtggttgtcggtggttagctggttctctttcgtgcagaggaaacagttagaaacttaaaattattctgcaactttgtttttaagaaatttgcttaatttcgtattccctccgtccctaaatatttagcgccgttgatttttttaaacatgtttaaccgttcgtcttatttaaaaaaattaagtaattattaattattttcctatcatttgattcattgttaaatatacttttacgtatacatatagttttacatatttcataaaagttttttaaataagacaaacgattaaacatgtttaaaaaagtcaacgacaaatatatagggagggtgggagtacatcttgttgagtagaattgtcctgtatgtttgacactgaatatcctcttgaagtggcggttgtatattttttttctttcgccgggatggcgaagaatgctgaccgatgtatattaaggaaaaggggaaaattgtacaaatgcagtgcgttagagcaccgcctttacaacaaaaagcaaattacaaagtctgtaatctctctaaagctggcactgcagcaacattcaacgaggtaactagccctgctgatttccaagtaacccattcatcacacatggtcgcacacagctgcatgaccgatgaggccgttccctcgaaaacccgtgcgttgcgctctttccaaatcaaccatataatgaggatgaccccggcgtcgaacgtcttgcgatcgatcttcgcaacagtttgccgggtagcgagccaccaactggcaaagtccgaggacggcggcgagcaggagaggctcaaacgagcctgaacctgcacccaaacttgctgcgagaaggtacaggcttggaagatgtggcggctgtatatttgacgctatgcgttactggctctggtactcttgattgttacttgcatatttacattaatttttttttgttgctttgagtaagattggtgatcacaattgaaattcaactgggtcgtcaaatgtttataacgggaggatttacaattggtgatcagatcacaatcacagaagataactgaatttttttaatcacttgctatatttggacagctcctcctccccgttttcccgcccacgcgaacgaatcaacgaaccatcacccgggtgcagcatctcaccaccgcacctctcgctgcacaacgcgcagtacccgccgccgccgccgccgtcgccgtccgcgagcgcggtgcagctctcgacgaagggcgtggtcgccgaggtagtggtagcgcagctcggcgatcgaagaaccggcgcggcggcccaggaagttgacatggaaccaggcctcgcccctgtacgccgcggcggcggccaggagcggctcgacggagtcgacgtcgatctcgtcgccttctcctcccgcgctgcatgccggagtcttagttgcggacggcgtggtggaaggtgagcgccaccttggcgaagggcagcgcgagatgcatgagaagggtgaaagactgaagggaggagaaggacgacgacgacgaagaacgagagcacaccgacacctagacgagcgccaatactgaccccatcagtgcctaattgctctgcaaatgccggggtacatgtttttttttaattacagtatataatttaatgtttcgcttgttactcaaccgtcaatatttagacggtgttcttttagagggttggaactctcctctccattgtaatatttagacggtgttcttttggagggttgtaaccctcctcttcgcatgaaaaacggagcgatagattaatacacgattaattaagtgttaactataaaaaaaatgtaaaatagatcaatatgatttttaaagcaactttcctatataaactttttacaagatatgtaccgttttagcggtttgaaaagcgtacacacggaaaattaaaaatcagtttgaaaagtacacacgaaaaattaaaaatcagtcgatttgttgaccgcatgatttactttgagatacgtgcatctgccgttgagtgaaaaaatattcgctagaacaaggaatcgaacccatcagggatgccacaacatgcgccgtaccaactgagcaagcagcagacgacagctttcattctatacttaacttttttaaaactttcactgcagttacattacactcacacgattaaaacgtaagtgtatagatggccataaggcccggggcccgacggcccggcccaaggcacgacaaattggcccggcccaggcacggcacggcccgactggggtcgtgcccgtgccggcccggcccaacagccgggccgtgcttgggccgctccctcggcacggtgggccggcacggcccggcacgaaagagtcggcacggtgggccggcacggcccggcacggtccaacggcaggcacggcccgaccgaggcctgttatgccgggtgggtataaataccccaaaccgcatcaaaccgacaaaccctaaccctagccacatcagtctggagtctcgaccgatccgccgctcgcccgctccgcctccacctccaggctccgacccctcagccctccacgcctccatccctcttcgtcggcgtctccgatggatgcctcgccggatctagcaccgagggtcagcgggctcccgctggaggcttgagggtcgtctcttctctatccttttctttcatctctttggctgatctgtgaccgtgagctcttcgtctccgcctctccggtcaccggatcgacggtcgcattgtcgatttcctctccattctgtacttttttttgcaaccctcatcgtttctcttcgtcagatactcagatccactcatccaccccccaaatctagtctctcctcttgtcttctcgtagatctgtggatctctatcatcaacggcaactccggtgctccggatgcgcaggtacaagctttttttttagtttattttctctattcgatcagatccgtaactactctctgctctcgtcgttgtttcatttgttcttgcaggtcgctgagcggcaggcggcagccaccgttgaggaaccggagtgcctgcgatggatggtgatccaacctcatgcaactacgaggcgagggtgatggggacgcagggtgatgacgaagatgacttggaggaggaacgcatcgaggtgtttggcaacactgcttcacctctgagagatctgtcgcagccggagccacacgatgatggtaccggtgccgatggcaacggtgctccgtctggctcaagtgctagcaacaagaggtccaggtctgaggtatgggacgactttgaagaactctttgaagagcgcaatggcgctcaggttcgcgtttctgctaaatgcaattactgtcataaaacattgtctgctcgttcaactggtggtactggacatttgcttaggcatattaaatcgtgcaaacctagaaatgttggtgctttgtctcagtccatgcttaggtttaatgctgatggttctgttagtcaatgggaatataaaccggatgtggctagaactgagttggttaggttgattgctagagaggatcttccacttacttttggtcaatctgctgcttttgaggagtatattcagaatgctcacaaccctagatttagtgttgtctctaggcaaactatcagtagggacgtttttaaggtcttcgacaagagacgtgctatgcttattgatactttgaagtctgttagctctgttgctttgacatctgatatatggtctggtaatgctaaggaggattatttgagtgttgttgcccattttgttaattctaattgtcaattagagaagaggattttgggactggtgctaattgatgtgtcacacaatgctgaaaatatttctgaacgtgtgctttctgttgttcaagaatatggtttgactaataagatcttctctattaccctggacaatgcctctgctaattctaaagcaatggatagtcttaaacctgctctgtctggttatattggtgatttatatttgcatcagcgttgtgcatgtcatatcatcaatttaattgttaaggctggtctagaaatcttcaaacccatgcttcaagattttagaactgctatttcatttataaatgcatctaatcagcgcattgctttatacaaaaacttctgcattgctaaaggtattcgtcctcgtaaatttggtttggacatggatgttagatggaatgcaacttatctaatgcttaagcatctcttgccacatagggtcattttttcagtgtttattgcatctcaccatccaatggctgatggtcagccattactgactgatttacactggacaattgctgaaactgttcttttattccttgaacaattttatgattcaactgttattttgtctggtgtttattatccaacatctccattaattatgcatcacattcttgagattgctggacatctaaatacttatgagaatgattggaaccttagaaatgttgttgttcccatgaaaaataagttcttgtcatactggtctgagattccatttctgtattcatttgcttttatcttggatcctagggccaagatcaggggttttagcaatgttctccaaattatgggacaacttattagtggtgattactctgcatatttaaatgaggttagggctgcattgtctgacatgtatgctaagtatgaaagtaaatttggtgctgtgagattacaaagggcaaccccaagctcttcttctggtaagaaaaagacagcttgggggaaaatttttggtgctgctgcttgtggttccagtcttggtgctggacttggtgctggtaatgctggtgctagtgccagtccaggttctggacttggtgatgctggtgccagtgcaggatctggacttggtgctggtgcattttctaggagaacttctgctaccgctttgattcaggctgtttcttctactgctaacatgaatgcatctgagttgtttgcctatcttgacagtgacactgtcaaccaatacgatgatgacttcaatatccttaactggtggcatgagcacaaccacacctatcctattctttccatattagctagggatgttttgactgttcctgtttctactatatcatcggaatctgcttttagcttaactggcaggatcatcgaggagcgacgacggcgtctagctcctgacatggtgcaagctttggcactaatcaaagattgggagcaagcagatgcaaagatgcaacataccatggagaatttagagcttataaactcttttgacaatttgtttcttgatgaagtaaccactgccactgggactggatgattgtattggacttggactttattatgaacatttgattaatgctgtgggctgcactcttttttcctttctagggttttctcacgaggtgtgagtttttacctagaaaggtttttaacgaggcagccattgcactacacagctactttattcattgaaatacttgtgtcaagtttttgggtgaaagtttatgattttgggtaatttttgacttagtgaaacttttgaatcttagaactgtgatttctgtgaattgtccatgtcatctgtgatctaagtcaagttttttgggtgaaagtttgggtgaaaatttgtgattttgggtaatttgacttggtgaaatttttgaatctacaactgtgagtctgtgatttttgaaactcttctgtgaattgtccatgtcatctgtgatctaagtcaagttttttgggtgaaagtttgggtgaaaatttgtgattttgggtaatttgacttggtgaaatttttgaatctacaactgtgagtctgtgatttttgaaactcttctgtgaattgtccatgtcatctgtgatctaagtcaagttttttgggtgaaagtttgggtgaaaatttgtgattttgggtaatttgacttggtgaaatttttgaatctacaactgtgagtctgtgatttttgaaactcttctgtgaattgtccatgtgatatgtgatcttagtcaagtgatctatgaatttttgtcaatgtgatctgtgaatctttgatctgtgatctgtgaatttttgtaaaggtgatatgtgaatctagaactgtgaattcaactaaggcatgttcaaatttgaatttgtcaactaagttgtgtaagttgtgttatttgaatttgttaaccaaggcatgttcaaatttatatttgtcaactaagttgtgtaatttaaatttgttaactaaggcatgttcaaatttgaatttgtcaagtaagttgtgaaatttgaatttgttaactaaggcatgtttaaatttaaattttgcatgttcaatccattgatccattgaatttgtcaatccactgaattactggtccactgatccactggtcctaagccgtgcctgggctagcccaggcccaatgggctgatcgtgccttcgtgtcggcccggcacggcacggcccagtagcaatcgggccgtgcctgggcctgacgtgcggcccatgggcaggcacggcacggcacgaaattccaatcgggccgtgccggcccgatcgctctcgggccgtgcctatccgtgcctgggccgggccgtgccgggcgggccttatggccatctatacgtaagtgcactacagctacaatgtaaattttagtatacgcgggtgcaatttttgttttacatgtacggaatttttttactcatcgtttatgaaatgaaactatattcgagctcagtctaatttattaatttgcttggatggataccaagctctcactgtactgaatggcatagtgcatccaatccccatcacagcggtccagcttgcgccttgacctgtcgaagtaggtcatctcctcgagcatgtccaccactcgttccacaactctgcgttcgacgtcgtaccggtaaatcatggcgtaatccacgtagaaaaatatgcctccttggtaatcgtaggtaaactggaagaaggtgtcaaaggagtgcggtagcacgacggtgcattgcagcgaccaccgtggcctgctgccccctccgtcggcggcggaagctgtccagagctcaactctatcgtcggcgggagcatgcacatagcacagcttgccacccagctccgtcagttccccacaagcgatgtcagacatcttctgccgctccatgaacggtgggcacgggaaactggcgaactcctcgctgcacatgtcgaagcgtacaatccctggggtggtgcagctgccggtggacggcgacgttttggtcttgacgaggtagggtgggtcggcgagcggcctccacgccggcgagccgagggacaaaacctcgcatccgacgctgtagtccgtgtaggtcttgtcgcagtggcggatgaagcagtggaccaccttcgtcttgccagtagattggtcggcgtagaagcctaccgcttgcactccgaagtagtccggcgcacaggccggtagctcggcaagctccttggtcgccgggttgcaaactaacatcttagtggagtacttgcgcatcgagcgcagcaacacgagcctatagttggccatatggcccgaggcccgatggcccggcccatggcacgggaatttggcccggcccaagcacggcatggcccggtagcaatcgggcccatgccggcccggcacgactattgggctgtgcctgggcctatggctgggcacggtgggccggcccggcacggcacggaccgaggtcggcacgatgggccggcccggcacggcacggcccaacggtcggcacgaccacggcccgtaccaacggtaggcacgagcacggcccagcccaacagacagccaggccgcgccgcgtgcgcccgcatatataagccagcgagcgccgcccctcccctccccagtcccctctcgcctctcgctctccgcctctccgcctctccgcctaaccctaaccctagccgccaccgctcaaccgcctccgccgatccgcctccgacgctccaccgcccaccagatctcctcctccaccgtccgccgctcactcactcagggcctcaggcgcgcaccggtgagactcaccgagtcgcctccctttcactcttacagatccagccttcctcttcgtctccgatcgatgcctcgcctgactcgcatgaggggcgcatgagatgggggccaccggccacgcatggtcgcctgagtcattgtccttccactcttccagatccagccttcctcttcgtctctttcccttttgttcttcttcgccagatcccttggtcttctcgtagatctctgagcctatcgtcttcaacggcaactccggtgctccggctgtgcaggtacaagcatggaaccatcgtttttcttttttttttctccatttccgaccctaaccttgagtgttgttggctgcttgcaggtcgcaagcccgttgcttagcggcagccgccgttgagggaccagagtgcctgcgatggacgacgatcctacctctgtcaactacgagttgaggactatggggatgcgcggtgatgacgatgatgatgtggaggaggatcgtgtggaggtgttcggcaatacctccgacatcccgatccatgtgaatgtcgatgacgacgacccgccggtcgacgacagtggcaatgggacgccgactggctctagtgcgacttgtaccaacaagaagaccaaaacctccaaggtatgggatgactttgaggaactttatgaaacgaccaatggtaatagggttcgagtctctgctaaatgcaattactgtcataaaactttgagtgctcgttcttctgctggcactggacatttgctt

SEQ ID NO: 60060 - DNA, 10451 bp, Oryza sativa
aatcggattctcgcctggctctcggagtcggagccgtacgtccgttaatcttgcgtgtcgagtataaattgcgcccaaatgaaggcttcgctgagagaggcccaagccagcattggcacttcggcatcagatcacttgggcataatggcccataggccatagctaggggtgaaaacggtacggaaatcatctttatcgttttcgttttggaatcggaaactccggatacgaaaacggaatcgaatattatcaaaaccgaaaacggagcgaaaacgaaccggcgtgaatacagtaacgaaaatttatcggaataaaaaaaccctcaaactgataaatccgattctcaagtctcaacggtcaacaattcatcataaacacaatcatataagtccaattgttaagtatcaatactacatcacaaaacacaatctatggaataaattagtaatgctgttgataaatcccaatgtagaaaaaaatattcttatataattttagatttgcataacaattttttttaaaaaaataaccgctaaacaccatggtattcactattcagtgcttaaaaaagtaatccagggtattttgtgatttctggaaattctgagaaaaattctaaaaattcctagaaaatttccggaaagtttccgaccgattccgagttccgacgaaaactgcccttatcattttcgattccgtttccgaggaaatatttctgaatccgtttccgtttccgaaaaatttcgaaaaaattccgaccgacagattccgttttcgaaaataggttcggaatgtttccgtactgttttcacccctagccatagctaattaacaacccggaaaccaaaatgtttttgatagtttccctttctgaacctgaatcaaccaaaaaaaatgaagacatccagttctctgtcattcgatctgaatcagcgaataactctgaagagattaatgaagaagtgattgtcagaggttctgctcctgtagttctgccttcctctaggcggcatgaacattggggtacctcaaccagagagcagctgaatttcgcaaaggaacaaaaaaaaaagacaagttaattacagatactacaactcacaagccattcaatattcagagatcagttgaaaaaaaatctggggtcaccgttttgagaaagaagagaatgaacagcaaaataaaaggggtgactcatctagaaaccaggacaatgagcataaactggtgtcatgatttaacggtaagtcagcaacagtgttgtctattgtataaatgtatgatacaactgtacaacagaacctttttttacagtgaatatacacaatgcatgtaaggttctctgaaagtctaaaacccattttcttggacatgaaagagctgactgagatgatcatggttttaatccatcaacactactaacaagacaaaataacaaaaggagcatgaatatgtatgcaactagcaagtcattgttctgaatcactgaactagcttcaggattgtctaatctatctattatcttattaaagtaataaaaaaagaagccatcacgtttggtctctcacggtctagaaattctcacattaatcggagaaaaataaaaagtagaatccatataataatacaatttaaaaatagctgaaattcggaattagaaataaggaatattgaaagagtagactagagattggcatgtagagtcctattatatttttttgttgtttcgctgattcctgattgtaactgcaccaagtgttatgttagtcgaactgttatcaatactaccgagacggtcgatttacattggttttaaaagtttgcccgattttattattaagggatgcaaatcaaaacacgttctatagttgaggggtgcaaaatagacattcttactcatttacattggttttaaaagttaggggcgcttggctattggtgcttcagtcggcgagcggcggaggtggcgcagggggctcttgatcgtggagttagatatgggcaagtatggcccgcgtgggggtgtgtgtggctatataagcttgtgttctggcccatctcgtagcagcccaaacgtgttcaaccgacgcagcaagtttcaggatactcgacacgcaagattaacggacgtacggctccgactccgagagccaggcgagaatccgatttgattgcagaactgatgtcagattccgaatcaaaaaacaaagaagtaaaaaaagattcggacaagcatctttccccataaaagtctttcttgttttagttacaggggattcgcttgctatcgatatggctcgtgcgagcgcgggaaaacgtgatatgatgaatcagccgggacatggtggtgatgtgcccgttgccaagcggcggcggtgcgtcgaacccgccggcgccgccgcggctggcatcccggaagacattgtggaggaaatcctcctccgcctccctgtcaagtccatcctgcggttcaggtccgtgtgcaagtcgtggcgcgccgtggtcgccgacccgcgcttcgtgcgcctccagctggaccactccaccacggcggcgcgccatcgcccaccgtccatgctcatcctggcagactggtgtgtgccagagcaacggaggggaacgatcgacttctttagctatccgggccatggcgtcgccgcggacttcgcgcttgggatgacatggtcctcgcccgtcgccaccgctgccgaggtatgatgtcgccgactgggacgccgtcgacgacggcgacgacgacgataacttggacgacgccgtcgacgacggggacgccgcggctgacggggacgacgccgtcgatgggaacgccgacgacaacggggacatcaacgatggtgccatcgggttgggcggggctctgcactacaacgggctcgtgttgctgagctcgatggagaactcctctataatgttagtttgcaacccggcaaccaaggagatcgccgagctgccggcctgtacgccggactacttcagggtccaaagagtatgcttctacgccgaccaacctacaggcaagacgaaggtggttcactacttcatccgccactgcaacgagaccctcacggactacagtcggatgcgaggttttgtccctcggctcgccggcgtggaggccgctcgccgaccctccctacctcgccctgaacaaagcgtcaccgtgcatcctcggtggcatctactggatcgtggccctaccgtcgccgcccaccggcagctgcaccacccctggaatgctacgcttcgacgtgtgcagcgaggagtttaccagtttcctgagcccaccgttcatggggcggcaggttatacgtgacgttagtggggccctgacggagcttgccggaaagctgtgctacatgcacgctcccaccgacggtaaagttgagctctggacaacttccgccgccgccgacgacgacgaaggcggcggcgggccgcggtggtcgctgcattgcaccgtcgtgctaccgcacccctttcaaaccatcttcccgtttacccacgattaccaaggaagcgtatttttcaacgtggattgcgccgtgatttaccggtacgatgtggaacgcggagttgtggaacgcgtggtggacatgctcgaggagatgacctacttcaactgttcaacgcacaagttgtaccgccgtccaggggactggaagctccgtaccattcagtacagtgagagcctggtatccgtccaagcaaattaattagattgagtttggctatagtttcatttcagattacacacatatatattaacccaattttatccgatattttgtaagactaacaaatttttcggtgcattgcaacatgtaatggaaataaggacaaccaacgattgggttcaacttttgtaattaattactcctagtcctgtaagaaaatatattcttcactcaaagcaagtcgaatttcaatcaatttcaatcagggggcgcctacggtgtctacaaccacaccaccgatgccgataaaaaaggtagagaaactgaataccagaaatagcgtgtccttcaactcttaaaatcgatgcaaaattaaccccaagaaggttagaatagcggtttcggcttgatgtgacgtctacctgtctagtttgactggttcctcgttccacgtgacattaattgatgtggcacctataaaaaaacagtgggatccacgtgtcaattagagcaggcacaatagcaggctataagccagctataaacttattttaaagatataaaggaagagagagaagagcagcgggctacagatctgtagctagctgtagcacggactccaagatgtaatgtgtgtatgacaggtggaaccgggcattaatagtatagcaagcaactaattagctattacattggctatagataatttggagctagtagtggactatactactagcaactatgtactattaaacttgctcttagtatctgattagaaataaaaatatgcaataggtcccaccttccttttcttttatttccttctcttttctttcttttttcttctttctcgctgcttcttcttgttctcgagatggggtcgccggggtagatgctaacgcattggagctcgctcccgcgataggctagctagcctagcactacggtgcatggcgctgtatgctgtttcttccattaaaatggtagggagagaaacatggagtagtattttcacttcactttttaagaccattgatattaactaattaagcttcttgttgatatttcacgttgaaaaattgagctttcaagcctgatctgctacccgccgagaaccatagaagttgatgcgctgtaattctgcggatcccaatccaccgtcgtcaggttgtacaccgccgagagcgacgaacacctcttccatggaaggccactcccatggatcccgcgccacccactgaacggccagagcatgggactaatcgtcggtgacaaacgccgtcgtggcgctatcttcccggacaagagctcggacaggatgacaccgaagctgacgacgtcgagcttgagactgattaactgggctaatatttcgtatatccaaattattccatacaaaattcaaaagtctactgtttaactgggctaatatttccccagtcggccgtctctctaattaaccatttttaaccttgaggcaaaaccagcataattctaattttattggaatttattctggatcaaacctctatctacacctatctccaaaaatctatacttcctctccatccaaaaatattcaatcatttattctttgttcatactcctattttgatcaagtcgccagtctaattgtcgtggcttgatttcctccccggcacaagaatcatagtatcacaaatgtttgagtgattgctcttgtgctaagaaacttattcccaattcctttcatcagaaaatccaatttcctttagtctcaaatattacatcaaggatccctaccacatgttagggagggggggggggggctaaaatcctatttattctcttccagctatttttaccaccttcccaaaattcatccaaaattagagaccacgccatttgtatttccttctcttgcctaattgagagtacttcattttcaattttcaaattcttaaagaaaattgttcgtgacgagttttacatttggttcttattgaattctattaaaattggagcattttgcatccttttcaaatttatatttcaaaacgcagttgtgagcttggggtctgtccgcagcccaacatgactgtaaccttactctatgataaatagactactgttgttgtgatattctgtcttcctgtgataccagcactgtttcctgggactggtatcagttaacaggttaatttggagcgtctcgggctagtttcgcccgggactagttcggggcgtgacaaaagatggtatcagagcacgggcttggccttagggcgaaacccaacgttaggatgaccctaaggatactaagttataaaatctacttgcgaaaagctaaggcttcttttgctttccttctttcagtaatttattgttaaaatagttattgatatgtttctctctctttcaaaattgtaggtggcagtgaacgccagttacagtattcccacggctttggtgagggtcaccatgtcgatcagctccgtgaccttgcccgtttccttggcttctcgtgtcccgagtacgcggggtactctgtggaccgtgttcctccttgctgtaagctgtttgtgtacctttaccctcgtggaggtacatagggggctggccttcacccacaccacttcaatgtggccaggcccactctccagatcacgtactaggaccactcttagactgcgctctgtgtttggcccatgactacagccaccgcctctcagggtccgccttccggatggtcccttccttccctttggccacacagacactaagtacccttgtccctactacgagtcgcaccccgtgctgacccgcatgattgagctttctgaggctcaagccactcagcacgacctgctccttgaggcctaccgctccctggctcgccgctacgccgctttggaggctcgccttgttgaggagggtgtctcctccgtggacactatctcttgggattccgatcgtctctgccatgccagccacctgtccttccacagttcccgtggttctactcgcactcccagcggcccgcgctcccccagcttgcgtgtgccatactcgccagtgtagtctccctacccacacccagtcagtcccttttacaccgctggccacaccccagttgcttcctctcgccgtggtcctcgctttatccgcaccgcgtggaagtgcgttgttggtccaaagaagcccgctcgaacacacaaaatggcgtcgcagggccttttgatgcccacctcaatcgccagcaatgcacttatattgcgcactgacctcccgtagaataagaacagcctccagtcggttgggcagataatcccataaggatttgctatcaatactatagagacggttgatttacattggttttaaaagtttacccgattttgttattgagggatgcaaatcaaaacacgttccatcgttgaggggtgcaaaatagacgttcttactcatttacattggttttaaaagttaggggcgcttggctattggtgctccagtcggcgagcggcggaggcggcgcagggggctcttgatttctaggctcaccgacgaggggagagcggagggaggagaggagctcgtcgcgatggttacggctcggggctctcggtgccaaggcggccgcaatttgatggatttgtccccttcgttgacaggtgggcctcagggcccacatggccgatgacgtcatgctcgcctcgccggaagcaacgagagctagctgctgccggccacacccggaccatggcgcgcgcccagccacggcgaccaggccagcgtcgtgttcgacgactacgtcagcagagggatgccaaatgccatgctcgattgtgttgcgtgcttccctgtgacatcaaaagcaacaaggtcagcaagcgaaagactcccgagcatttcaacgaacacctcatgcgcgagtagaacggagcggcagaagcggcgaactcgtcctgtcgcggcgacggtgaacggcagtagtagaggccccaacagcggcagcggccacagatcgacgcccacatgcgttctgcgacgtgccgacctcgcaaggctgcggcgccgctcggggttcggtgtgtccaattcggaacccggaacccaccgtgacggcgaaccacccgacggtgaacgacggaagtgttactgcatcaatacagagcactacccgtaactctagtatcattgggcctagaagatccaaacgagaagtccacaccaacccaaagtatatgggctgtgattgggttactggttgaggaagtctataaatactagaaggatcttctagaggcgtgcgttggaattgaatcaaaacttctatctgaagaaatcattcctcctcctaactctgcttcctttttcctctgctctgaaatgctctgttctgttctgttcttccttctcatccccaatttcatctgtgattcgatctagggttcgtaacatcttggtatcagagcacgatcctggagcggccgacattcaagacgcgtttgcaaggtcaagtggacgccatggagaagcagcatgaaggcttcgggaagatgctgtccagtattcaggaggcgatcggcgccatgtcggtgaagcaaggcgaggtgcaggagacgatgaacaaaatggagaaatccatttcaagttggcgacctcaggttgatgctgcggtgcagagcttgcagcgcgacatggagttgctgagaaatcaagtcggtgcggtggagcgacatcaagcggaagctgacaaatcgtcgaacacctcgcaggcgttggaggagcgggaggaaattgctcgtcgcacatctcagttgccgacgtcgccaaccacgtctctgccagtatcgcaggcgttggaggagcgggaggaaattgctcgtcgcgcacctctgttgccgacgccgccaaccgcgtctatgccagcctcgactggcgaaattggtctggatggccaccgcatttcaactcagttccgggggagggcatcgggggtagtcactactctcgtcccacctccgggcaagggtacgcactctctaccattttctcctcgtgttcatccaaatttttcggagtttgttggtcgcgaggagagtgggggatcagtggggcgtgggtacaatcacagattgccgaaattggattttccccaatttgatggcagtgatcctcagaattggcgtttaagatgtgaacattattttggggtttatggcactcatccagatttatgggttagagtagctaccatttatttcattggtcgagctgcatcttggttacgttcttcgcgagctcatttgctttgtgggaattggggagttttttgtgatacggtggataggaagtttgataggaatagacaccttcagcttgttcgtcagattgatcaactcaagcagtcagggtcggtgaatgagtattatgagcgttttgatgatttgtggagtcagttgttagtttatgatccaaccttgagcactgtgagttgtgtccatagattcacggagggattacgcagtgatattaaaaatgcagtgttaatgcattttccccaagatttggagactgctttggctcttgctatcttacaggaggaattgggagaggctggtggatctttggtgtccaaggatgggaagaaattgggtgatcacgctgctcgaattaaaagtgcttaccctttacctttaccaccacccaaatttgtgcatgctggcaagggagatgataaaagaacagctgaagttcctaaagtggccaattcttctgataaattggttgctctcaaggcctatcgacgagctcaaggtctttgctatgtttgtgctgaaaaatggtctcctactcacaagtgttcaggatcagtacagttacatgctgttcaagaactcttcagtgttttggcagctgatgtttctgagggtgaacaggatgctgattctatctctagtttgatggctatttctttacaggccattcaaggcacggtttctgcacatactttgcgattacaagggtccattcaaggctttgatgtgttaattttggtggattcaggcagctcttgcagttttctcagttcagtggttttacctcatctcactggtgtgaaatctttacttactccagttcaagtaaaggtagccaatggtgctgttctttcttgtacctctgagttgccggctgcaaaatgggaggttcaagggcatcagttctctactgatttcaaactgcttcctttggacaattatgatatgatcttgggtatggactggttagagaaatatagtccaatggatatcaattggcaggccaaaacaattcagtttggtcttcttgataagtcagtggaacttaaaggagtggtaccggaattggataaatgtgatctggtctctattcatcagttacagctgttgcacaatcaaggagctgtggagtccttggttcagctcactgccagtgacggctctagttcttctcaaaatgttccaagttcaattcagtccattttggatgaatttgctgacatttttaatgaaccagacgggttgccaccttctcgatcttatgatcacactattcctagctggttgaggtcgcgaaggttgacgctgttccacgaccacccggtcctgggggccgggaggtaccgcccgttcgcggcgctgtggagcatgaggatgtcgccgccgtcgaggtggagtatgtgcaccgtccacgccgcgcggtcctggtgcaggtagacgccgctcccgtcct

SEQ ID NO: 60061 - DNA, 1853 bp, Oryza sativa
gcccgccgccagccgccaggcgtcctccagagcatctaggccgctattggcgttcagcttcggcggcgcacggacgcagaatccttcctcctgctcggaggaaggccatggcgacgggcggtggtggtggatgctggcgctggcggtgggcgcgagctcgacgcgcctcctcggcgtcaagcggggccttcatgcaacgacggagacccattggttggttgttggtgttgctggcgcgggacgtgttctggcccatctcgtagcagcccaaacgtgttcaaccaacgcagcaagtttcaggatactcgacagggcacgcaagattaacggacgtacggctccgactccgagaggcgagattccgatttgattgcagaactgatgtcagattccgaatcaaaaaacaaaaagtaaaaacgattcggacaatgcaagcatcctcttcctataaaagtctttcttgttttagttacagggaattcgcttagtatcgatatggcttgtgcgagcgcgggaaaacgtgatatgatgaatcagccgggacatggtggtgatctgcccgtggccaagcggcggcggtgcgtcgaacccaccggcgccgccgcagcctgcatcccggaagacgtcatcgagcaaatcctcctccgtctccccgtcaagtccatcctgcggttcaggtccgtgtgcaagtcgtggcgctccatggtcgccgagccgcacttcgttcgcctccagctgcaccactccaccacggcggcgcgccgcgtactgtcaggctggcgtatcctacaggaacggatgggatcgatatgcttctttcgctacccggggcatggcgccctcgcggacctcgcgtatgagatgacatgctcctcggccgtcgccaccgccgacgaggatgataccgccgactgggacgccgtcgacgatggggatgccgtggatgacggggacgacgccgcggactgggacaccgacgatgacggggacgacgctacggactgggacaccgacgatgacggggacgacgctactacggattgggacaccgacgatgacggggacggcgccgaccggtacatcaacaatggcgccatcaggtttggcctccctctgcactgcaacgggctcgtgttgctgagcacgatggagaactcctctatgatgttagtttgcaacccggcaacgagggagttcgccgagctaccggcctgtacgccggactacttgaggatccaaagagtaggcttctacgccgaccagcctacaggcaagacgaaggtggttcgctacttcatccgccactgcaacgaaacctacacggactacagcgtcggatgcgaggttttgtccctcggctcgccggcgtggaggccgctcgccgaccctccctacctcgtcctgaacaaaacgtcaccgtgcatcctcggtggcatctactggatcgccatcctaccgtcgccgcccaccggcagctgcaccacccccggaaaaatgctacgcttcgacgtgtgcagcgaggagtttaccagtttcccgagcccaccgttcatggagcggcaggagatatgtgacgttaatgggaccctgacggagctggccggaaagctgtgctatatgcacactcccgccgacggtaaagttgagctctggacagcttccgccgccgacgaagggccgcgatggtcgctgcattgcaccgtcgtgctatcgtacccctttcaaaccatctacccatttgaccacgattaccaaggaagcatatttttcaacgtggattgtgccttgatttaccggtacgatgtggaacgcggagttgcggaacgcgtggtggacatgatcgacgacatgac

SEQ ID NO: 60062 - DNA, 1166 bp, Oryza sativa
ctggtcctggacagggatttaatgcacattcagcttagaaattctggtttgagaatttcggggcgtgacaagttggtatcagagccgaccttgaccgtaggacaagccaactggaaaccctaagagccctctgaacccctttttcatctgcatatgccctttttgcacctggaattgtttcgggaaaatttggagttttgcctctttggtttgcgggaaaaatcttgtcgttctttcgggtcggatttttttttttttaaaaaaaaaaaaattattagctcagcctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccacccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcagatggagataaggaatggttcacgcgactcgaacaacgccagtggcagcgaagagccgatcaatggagcacgtgccaacggtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcggcaagcacagcagcaacaacagaacctgcagtttggtcctccacctcctcagtccaaactgttagaatt

SEQ ID NO: 60063 - DNA, 826 bp, Oryza sativa
aaactagacaacatcatgaagccgaaaccgctattcaaaccgtcttgggactaattttatattggttttaggagttgaacaatacattatatctagtatcggttcggggataatttcaaacggaacaaggtcaccggaggtccctcaacttaacagcgagattttttgagatcctttaactacaaaatcagaaatgtgtacccctaaactctctcaaaccgttcaccggaggtccctcggcagtatttttgtccggttttactgacgtggcatcctagtcagcaaaattttttaaaaagttacatggggcccacatgtcagctacacatcttttttttttccttctcttttcttctccttctcttctctcttctctcttcagcaagcgcgacagccacaggcgaagcggcgtgacagggttctcctccgtggtggcgacggcaagttcccggacccggagccagcaggttgccgacgccgacgcggcaagcggcgggcgagcgcggcagcgggcggcggcgcgcggccgaagcaggcagaggggcggcgttggccgctgtaggcggcggaaagcggcgatctgggcctgggggcacgaggagaaggaagcgcgagcaccggggcccgaggcgcgtggggagctggtcgcgcagcacggcgacatcgtcggggccgaagaggaacctgcggtgcacgagctcgtcgcctgacgaagcttgtcgctggcctcgtcggacgccggctcgtactcagggtggtcgtacccggacgctgcgggtggcgcgcgtagaggggctccctcgctcacaccgaccggacgctccgc

SEQ ID NO: 60064 - DNA, 1476 bp, Oryza sativa
ggtacggcccaggcacggccgggcctgggccgaggtcagttgggccggcacggcttgacgaacaagccgtgccgtgccgtaccagcccacgggctacaaccacggcctaggcacggcccaagtagcctcgggccgtgccgggctggcccgacggcccggctagcccattgtgcccgtgccggcctaggcacgccctggcaaaaaaaccccttcaaaggttcaattcaacacaacaaattgacataacacatcaaattcatgaaattcacatgtaattcatcaaataagtcaaagaatcacaaacaattcatcaagtcaccagttcatcaaatcatgcatacatcacgtcacagatttacaagcacagatttacaaacaaatgaacaattcttcaagtcaccaattcatcaagtgtaacgctccgcttttcgtgaggcgttaaaaactaattcggcaaaaatcctaattgcgaaaatttcgttctttgagtgttgagtctaagttgtgccaaggatctcaatttaatcccgttattccctctcatcgaaatcaaaaatcctcaacctcgaaattcctcttccgactcaagtctccaaatcaaactctgaaattctatccctctctttgaatcatcaccaaatacttccccagatccaaaatatccaaaaccccatcttgaatcctccgtctactccttcctctcatcgagatcccaatttcaaaatctaagtcaaattccaagttcaaattctcttcgaatcaatctcctccgaaaaagtctattttgcctccttctaaatttggatgggcctgatccccctcccctcggcccatctcctctctcagccgttcctcctctcccctctctccgcacgtgcgttgcgcgtgcgccgcgctcgagagaagagagcgcccactctcttctcacccacgctctctctctctccgtttctctctctctcccgtaaaagcttcccccaccggcgtcgatttcccgccgccgccgttcgaaatccgaccgcgccctcgcatccacgcgcgcgctcgtgcgtggccgaccgcccggtcgccgccgcgtcggccctgccgcgcctacgcctcccggccccgcctgcccgccgcccaaaacggaagggaagagttcccctttccaccgccctcttcgcctttttccccctcgggctcaaccgctcgctctctcgccctcgtccgcttgcgctcggaggcagagccgctgacggcagccgccagctcgccgcccccaccttgacccagcgccagctcgccccgagccagccggcgctgctcctcccgctcccgcggttcaaattccgccgcacgatccaccgccttcgccgcccaacacatccacgccgtcgccggcctccgtctcgccccctctccctttcctttatcccgaaacagcaagaacagagctcccttttcccccacctttttccttttgcccgacaccgc

SEQ ID NO: 60065 - DNA, 3159 bp, Oryza sativa
tattccggtgtgccccctccctctcgaatcgtcgcgacaagctccggtgaactcggccgccgtccgccgtccatctcggcctccccttcttcctcctcccgccggcccgcgtggctaccacgtaggcgccacgtcggagtcacctcggccgcgaccgggtcagcacgaccagcctgccgcctccccctccctcaaccggtgcgcgcggtccacggagagccctatggctgcgcgtgggcccgccgcatctcggtccatccggcgcaccgcccgtgcgccatcttcaccaaaccctagcgccgcccccgcgtgaacccattcctccatgaacccagccgccgacaggtgggcccgtcccgggacccgcatggtggaccgcggtccacccggtcggtctcctccccctcccacgccccattgggccgccctcctcgcggccgtgccggcccattaggctcgcccgagctgcacaagtccctcgggccgcgccaatgccacccgagacaagtctgattgacatccctccatccttttctttttccagggatttaataaatcctttttcccttgtcccataaatcaattccttattccaaaattccataaaccatttcctttggtcccgcatgacagtgactgttaataatattcttgggaatattatttctacaaaccccataaaccatttctcgtattccagaaaattccgataaatcatttccttgaccagaaaatccaaattaaacttccaaaattcatatcttcccaaccgctcttccgtttgactccgttcaacttccagtaattccgtaaaatcgagatctatttaatggcactaataattagtctaaataggatctttcttttggtcttttgtttaggttttcaattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcatgccaaatcgacggacctacccagtagtcgcactaatttccgtaggtcatactaccctgattccttgtcgctccacccttgtggtacctcggtattcgtgctctctgagcgcgtatacaaatatcccacatacaccgttgcttgtcgaaaacttgggaaatgggtttgtgaagccttcaaaacccgacatgtggtgtcggtgtgtttgaaaataaaatgaattgtgaaaactcgcgatgcgggggttgtgcctatgtggtactgtcccgtattcgcatataaggaccgattcctgtgggaaactcatcgaacataatcaaagtgcaaccacaaggtggaatgggacaccctggttaagtaactagacggttcagggaaacctcgcatgccaatagttgggaacgccggggcggggtcggacaaaccgggttcctggtaaggcaaggacgagaagcttgctcacttaccgatcaaggtggttggaatttgatttgtgcacgcctaaaatggcctatgtttatgtgaggatttgatccttccatgtggcatgaggtaaccctgggtcggctggggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattactaaatgagttgttgaaaaacatctcttaaagtcgaatcgagacgcaagcctcttttcggcccaaacatagaaagaaataaatcacttagtgatttcaaaatgatttcaaacaaaagatttgcaaaacaaccttgcctctcttccaagctagcattaaacacctaaattcccgtgacttgctgagtacgaaagtactcacccttgctctatataaatatatataaatagttcctccgccctgaagagaagataaagtgaagtgaagattagggtttcgtcctggttcccagccgtcgcctgtggtgttgggtgttagaccgttggtttccgctgctgctgctgctgttggtgtttcctcgtccgcgtcgtcggttgtattctcgggctgtctgagctgcaacctaagttaaggtaaataagtcctctatttattttaaggattgctatgattcatatttgtcaccgtgggtaccagcactatgtcctgggactggtaccgagatcgcggtttcgtaggaagcggttcgcgccgttttccctacgacacgctcctgtcaggtgccgttgtacggcggtatcagattggggtatgacatcaagtcacagtctcacagatttacaatcagttcaaatcaattcatcaaatgcatacatcaagtcatctactattttccatcaagtccatcttagaattacaaacctcagaaagttagaatataaaaggggtttatataagctgtgattgtgcaatggctgcctcattaaaaacctttctaggtaaaaactcacacctcgtgagaaaaccctagaaaggaaaagagtacagcccatagctaaaatgttcatatcaattacaatcatccagttcaagggtttacatcaatttcatcatcaagatacatattctcataagcattttgaagctccacattctcagtagtatgctggcgttttgcatctgctagctcccagtccttgatcacggccagaatttcccccagcgtagggtttagacgcagcggacggtcctcgatgatcatgccagttaagctaaaagt

SEQ ID NO: 60066 - DNA, 4351 bp, Oryza sativa
tgctcggatagcaaaatcttgctcagatcctcaagacataattcatttatgggatgccataaccataggcagttttgccagatgcagtcaaatagctccattgttaagatcgtaaaacaaactttcattgttgtgttgtgtacatacatgttgaataagtaacaatgaagctacctacaaagagcaggctaagattgatgtgtctctgctaactggagttcttacaggttgttccatctttcttggaaaattacggagaacaaatatcaccattgtctgcttagtgttctgacaggttgttccatcttgcaaactgaagttctgacattgtctgcttagtgttagtgcctatatgttatctttagatcgcccgtcttttaagtcccgtaggtactgaacacgatgatcatcaattcctttgatgagaaaccatttaatcatggtagtgcaggttaccttgtctggtttgcatcgttgtaatttcattatatcaagaacatcccacatctccgccaagcaccccaccctcccaaacgcgtccaccaaacagttgaagaacacaatatccaacgttatgtcagaattctcaacgattctcaacactgtctttattttcttaacatccccagcccttccatatgctcgaaccaacgagcagagtgtaacacagttgggctttatacgctcagatttcatcaatctaaaaatatattccatctgttcaaggtccccagcccttccaaatgcatcaataactacattgtatgtgactattgtccaagaatagtaatacttctgcatgtattccatcacagctcccatcttctcatacattttagctttaccataggaatcaagtaaaatattgtaagtcttaatgtttggggagataccggaggcctggaacttctcataacagctttccatagtttcaatttgaccactgccaccgaaagctctgagagtagaattcattgtccatacatcaggcttgcaattttcagtcagcatctccagaagagttgattccatctcagcaaaccttaatcataaagcatcattagttcaatgaaatcgcatcaggagtaactacagatttggaaagaatcagaaatgcatttcaattacggtaatattcaaattctggctgttcttgaaattaagattctctgaagttctccgcataaagttaatcgcattttcaatagttatttgtatcaaatatgagaaaggcatgttcatattttaaagcatgaattttactatcaattaccttcctgctttcccataggcatcaattaatgtgttataagtcacgacattgggacggatacccgcccgcgccatatcttccatcaaatacttgacccgctcaaaatcataggcgtgcaagcatgacttgatgagaatggagtaggtctgcacatcaggtcggcaaccaggggtggccttcatctgctcgagcaaggagaaggccctgtcgaagcggccactcctgctgtacgcggagacgagggccgtgtaggactcgaggttgggagcgcagccttcgtccaccatggcctggaacagctcgtgcgccctctccggctgcttgcacttgcccagcatggtgatcagcttgacgtatatcccgacgtacggcctgtaccacacctggtcgcgcattagatcgaacacctggtcggcaatggacacggcgaggttagcgggagacacgggtataggctatgatgggatggaggcagtggtgagggtgaggaccttgagggcggagtcccagcggagggcggtgatgcgctcgtggagggcctcgagcacggtgcgggggagcaggcggcgggtgcccttgccgggcttgcgcttgtcgaggacggccttggtggcctcgcggcggaggatgacggagagcgccttccgggacgcgatcttacggttcacttcctcctttcgccgccgctccgcctcggcctcgacctcgccgccatcctcctcgcctcgccgcctcctcctctcccccgcggcgccagccaaggaggaggaggatcccctggtgcgagccggctcgcgccccgcggcggctggcggtgggagcagcgcgtcgtggcaccggcgcgcggcggtggaggccgcgatggtggtggaggaggaggaggaggagagcgccgggaatggggaggccaccggcgcggcggccattgcggcgcggctcggagtagccggaggcgagggcgagctcgcctcgctgcagttttgcgccggagagcggcgcgatttttcgtccgcgcggggaagaagaggatgaggctgtgcttagtgacgtggcaacgagagtagtcaagcgtaacaggacagggaggggcaccaagtgaccgttggatgagatagcgacgctccagatctctcctcttatggaagacaggcaaccagccagatttaacaccacaggtttagcagatttcacggacaattttgggtagatttggatttgatttatactaagggcccatttgaattgtaggattgaaaaaacggaggaataggaaaaacacgagattttggtaggattgcaagtgtaaaacagaggattacaaaacataggaaaaatataggaatgaccgtttgattagaccgcaggaaaaatgcaggaatcacatgagagatagactcaaggaaagttttccgaggttagagtggatgttaactttcctacgtttttgctctagaattgtaggaataggaaagtttcctacgtttttccttttctcgttcctacgaatcaaagacatgaatagtgtaggatttcaattcctttgtttttcctccatttttcctccaattcaaaggaggcctaactctttgtttttcgtcgagaagtaagagcccctttgaatcaaaggaattatgaaagaatttcatagaattgaaatcctacaggaaatttttctatgtaaccctttgatttaaaggattgaagttttccaaatcctacaaaattccgatggaatggcttgttgcatattgcatataggttttgaaggaaacttagcaagaggtccaacctcttggtaaaaatcctttgagtctatctctctcatccgattcctgtgttttcctgtggtccaatcaaacgatcattcctgtgtttttcctatgttttgcaattctctgttttacaaacacattcctgtcagaatcctatgtttttcctattcctcctttttcattcctacgattcaaagtagccctaaaattatactagtagttaacactctttgttttttgtcaagaagtaaaattatactagtagttaataacattattgatccatatttttcagacacaaaatactcttattcttctcagtcctctcttctcccctcttctcaaacacacttttaacacaattaaacagcgtacaacctttttttctctcccagcagttagcatgaaaaactataatccagatgatagaacttaaccgtaattaagtaataaaatagatttaggatttactacacttattatctcaactctcaagttgtcaaaagaacagtgcaattatcacgcatcagctcgaaattttcagcatctttggcgctcagttgggtagaacactagaaccaacaaccgaagatatagattacttctgcattattgcccagagagagtattggtccatacagtctatgatttactagctaactattcacaaggcaaggatcacgctgcacgcttgagcctttgactaaacatgcacttgaacaggcagatacattccctgaacacgcacatcagaatcgccaccgagatgggtggcctatcacatacagaaacaccacttttattccctctctacatgaacgagtcgaggtatccaaaggagtggaccattctgtagtgcagcaagctggcgtacacacggtcgcacactccgacgaacagtgactcgtcgtctgggctaagcgagatgccggagatctcgccgaagaaatctatctcctgcctcttcttgtagtccgcagcggcgctgtagacgtgcacgaagtcagcgggctccgagaagagcatgaactggccatccgaggagtagcggatgcaacggatagcgccaatgttgcccctaagtactgagagggaggttgacaggtttcgtacgtcccagacgcggcaggtcttgtcttggttaccggttgcgaaggtgcggccacagggtgccatgccgaagcaaacgaatagtccagatggccaactagggtagaggttacctgaagagaaggattcagcgttcaatgtcactatccagataaacaccagaacggaacaattctcaaataaagaaaatcaatct

SEQ ID NO: 60067 - DNA, 6770 bp, Oryza sativa
tacactacaaaacatctcaattacttctttaatttgaagacttcatcttgttaattggtcacatcacatcaaaagcttcgcccagctgcatgcgggagttagtgagtgctgatcgatgctcccagctagagccatgcatatgcattcagctacacatatgcatgcggacttagtgagttgctagctactgatatactcctgcatctgttaattatttatcgagagagagattgaggggggagggggggggggcggtttcgatcagaggatgaggggtggcaggctgcggatacatgtgagatacgtccggataggtatcccgtacgtatccctcttttttctctttttcagataattaaaataaacaccgatactcttccgatacggtgggatgcggacctgatacgggggagccctaaatcgcgtaggaacaaaaccgcatctctctccccctccacccgcgccgcccctcgctctcacaactcacactgcccctctctcctcactaccccaatccccatcgcagcgccgccgcctacaccgtcgctgcgttgccttgccgccgtctctgatccgtcctccgctgtccgcttcgaccggcgcccagtgccgttgtcttccttcgatcccagcctccgatgacattgaggacttgaggtaaatgaaaatcccctccaagtttgatctgcatcgtgcatagtgttccagttccctttttcttagtacaattgctgtcgtctttgatagattcaatggattttgatgcatcgagactgctagaactgtcacttgatgagcctgaccctgagagactgctagatcttggtgcattggacatataaggtgatgggccttcatccacttcggttccaatggatgaaatcaacaatcaatttatctagtcttgctatctagttattgagttgaatttgaagtcatggacaagttaattctaattagtttagcactgtggttatgttctactattggtttatctactatgtgaaaaatgttgtctaccatctatttgaagaactatgttattttcatgatttcatctactgtgtagtcttgcacttatttatgcatgcctcttcagtgaatggtgagatgctgtgaatatgtcgtactgagatatatatcatatatatgatgatcggtgcattggtggtttgatgctgttgtgctgcctaatttttcagtccatattccacacttaatttattttgtatttttaattatatatatatatatacacgcgtatccccgtatccatgttttttagaagacggtgtatcccggtatcgccgtatcgcgtatccgtatcagcctatcagggtaacgtaggtgtcaggccctccccggcaccccccgtggcttcgccactgaggccagacgatgtgagactgagcacatgttagccatttacctttccatttcttgaatcaacaagaagagcatcccgatcatctccaactactgccagaagtttcctatcagggctcacagatgtgtgctgcataggagtagtaaggaagtcaaacaaggatggctggacataaaagcgttgtgtggatattgaagagagatgacttacatttactggccagttataactgaagtggttcaagagctgaaatgtttccatgtcaaattcacgaacaccacaatcattgttggacacggtaacacgcaagcttccactacatggacaattttagggctttagatttctgtaatgataggtacatcttcagccaaagatttaagctggtatatttttaccttgcagatctgtgtatatctatcgcatttgtgatagcattgtcgcttaaagttgtccttgtgcagaacttaacatcacggtctcccacaacctgtacaaagataaaaaatattgagcacgtaaacctgatatttaaggtttgccttttctatttaaaaaaacaatattcatggttgcctcttttattaagaaaaggtaaaggatccccaaacctgtagcaagactggcaaatactgagcatgtaagcctgatgatactcatggcttgcttttttttcattaaagcaggtacttattataaagcaaaagtaggggaaacagcaccttaccttgcaaattagttctccctgaaaaccaccagcaaccaataaaccctcattcactgaaagtgtgctaacttgaaccccgctaaacccttccagtaaactgccagggtgtttctgtgtgacaacattaatttcagaataattttacataaaaaaacaagagtaattgaacttgggagaaacatcactaataaaaaaaagatctttagttcaaataaacacaagcaggaaatgaaaaagaagaaaacctgcgcaggagcaacatgcccggagaaatcaagaacctctgatagattgtgagacaatgatgaccagtggcctactgtggaatttgacatgaagtagacatcatgcttcgacgttgcccataacaaattcctaagctacagaagcagttcgtcagtactgagcagccttgggactcatatgacaagacaaattcagatagctgctataaagaagaatggacctcataataatgaagacatcaaggcaaaagtgtttaagtttgcatcattgattatatccagtcatagttcaaaattcgcttgtatgaagaactttaaacttaatttttcactggcaagattgtgtaagccatgatttcatgtgtttaacagttccatgaaaacatccaagtatttagccactacagcattccctttgaaatatcccaaaacctttttaccaacataactgaaccagaatcctgcaaaacaattgaactaattctatgctctggaacagtagttttcttgtttagaggccaatttcacaatttgttaaaggttccctttccctaatgatcatacaacattttttatctttgtagttcttattgacatggccacatacgtaagacaagtaaatgaggtgtaacaactccgatgatacacaactaatgctaacagctaagaaaaatagcttatcccgcattaatctagtggaggattgataaaaaggagtatttgtcagctaagaaagaatgcaactcacctgaaagtggaggattgatggcttcactaatctagtgttgtagtgaaattcataatacttgctgatcttatccacttgcttgcatatctgaaaaatgtaagatgcattttttttcaggaatttggaacatccatagagcaaaaaaaacaaacattgatagataaaatttcatgataatagagaccttatccatgagctctcctgattgagggaagttttcgtagtttttgtactgtaccaacctagcttttctgtaatcgctcctggttatttgtaacctctcccatggtataccttgtatatcctttcctgctcttgcttcagctgctgatgtatcagttatcctagtgagctgcacagaaaaaaaaacactttgtttcaacctatttttatttcatatgcacaagaccatttaatgaacaatcacatctgaataatcctaaagattgaagcaaactcatcatgcttctgttcggatttcacagtacagaaaagaccaaaggaaaacacaagaagtttgaacaaaacagataatctttatccttgacaagctgttgcatccgattctccagcatcctgtgatctggcaattagataggcatgttgacccacatgggcactatcagttatcacatatgccaaaagacgggcccagctgagtcggcaattaattgaataggtgaactgatctaactttgatcaacaagaacaagacatgagtcctatttcctggtagaaaaccatatttgatactcattggtcttagccaattcaaaaggcactgaaaaacaatgcatccacaacgccgggccaagatgggcatagaaaaactatgcactataccccttttatgaaaacgacctaacagagagaatggtatgccatgccattattggctgaagataagcacaacctaggtagcaatctagagctgcatgattgggcagaaaaaatctactccacaaacaccgttgacatgaagtctctagttaacgaaaagaattcagcaaccaaggactaaatgggaaaaattgtccaaatgcagatctgccctattaatcaactaaaattaattacacatacacttgtttagagtacatcactgcactaaggctccccgtgcaatcgatgtgtttttgactaagtaaattccccacttatcatatataataactgtttatagatgccaacttagccttttctactttgtcataacaaaacaatcaactgcttaattttttaacttatttcctatgtgtccttttccacacgatgcatcctagcagcagcactgcaaaacattagaaaactaaccctgtatacctatgatagcgatcagcagggacctgattcggagcagaaggctatcctgtgtccatgaacaaccctagatactaagctccgacgcttatcgcgacatgctacccaccaaacgtaacccaatctcgaaggttaaaaaaaatgaaaaaaaaaagaaggaatggaaccctcagacaaatcaaacgagaaccaagccagaacagtgacacggcggcggctcagattcgcggcacgaaaaccaccaaggcagccaccaccagcagcaaggaaggcgttaccgaccagcgcgtactcgtcgtcgccgtcgccgccgtccctcctgtcgccgtcgcgcgcctgcgactcctcgccgcccacctccacgtccatatcgccgtcttccgaagccgccccgtcagggtcatcctccgccatgtaccccgccaccgccgctccgtcccgcacggccgccgccatcgccgcctcgccccccctgcacacacgcaaaccaaaaccaaaccaaacccaactcagatcacacaaacacaaacacaacaaaccacaaccagccatcagaacccgggattactagacctctcggctgaagcagataagaagcctcaagaggtagggttccgcgagctctgctccgccccccgcgtgtcggcggctgctgctgctgccgctgccgctgccgccgctacggatcggaagaggaggagagcgaaacgtgtggatgggaggggaggcgcacgggcggcgcgttcgcctttgcttgcctttttgcgccgtgcggcgatggcgaggcgcgtaggagaaggaaggcaaagctcgatccggaaaggataataggaaggtgaggagaggaaggaggatgggatgacagtgacggtggtgcggaatgggtgattaggatgtgttcggcactctgatttcccaactctcctctttcattttgacgtgtatgttttttaaacagctaaacgatgttttttttcactaaatatttctatatgaaagttgctttaaaaaatagctaatactgattactctcttcgtcctaataaaactcaacctagaacttggatgaaattcgtgcatactagaacttgtccctagaacttggatgaaacataatctaataaaataaatctggatagagaaaattcgtgctaatagaccgtttcacttttcgtgtatactgatcatgttgggaaccggctgaaacgaaagtactccctccgtttcaaaatatttgataccgttgactttttagtacatgtttgaccattcgtcttattaaaaaatttaagtaattatttattcttttcatattatttgattcattgttaaatatactttcaagtacacatatagttttacatatttcacaattttttttaataagacgaacggtcaaatatatgctaaaaagtcaactgcgttaaacattttgaaatagaggggtagtacagtacattagataggggccaaggtaagccaccgcgtgagatgtgatggggtgaggaaggggattaggacgaaggagatggatggctgggatatatataacctgggtagtctctagaagaagtggatttttgctacgtgcacagcggttaggtttctgtgtatcggtcttatatcaaaaattacgaaaaaaaaattataaaaaataagtcacgcataaaatatttttcatattttatcatctaatatttttttattactgaaagcgcatccatctatccattcccctcatctacattacgatcatacgcgtaatgctcctttctaaagaaacagaagaaccgttttcccaataagcaacgtgccctaaagctatagattgctacctaggttgctcttttaaaattaaaaatattcatattttatcatctaataaacaaacaaaatactaatcatataaaaattttaaataaggtggacggtcaagcgtttgacaaagaaacctacttgatggaatgagtaattttcttagctgagaatatctaacgttgttttattgttcacttgatggttttattgttcttgaggtatttttatatggaatggatttgatcattatctataataaattttgagtcgtgggtttaacatcttatatataatttcaaatagtcctttggcgactgtaacagataccatatacacaaaaaaaacgtagcaaacaactaaagaagcttgtcatttcactatgtcggtgacatgggaccgggagtatcatgactcgaggcttgaggcagacacaatcgcccacgtggcctggcaccctcgggggacgtcgggcccgagggtgatgtgtgcgcccacctcttggtcttcccgagggggggggggggg

SEQ ID NO: 60068 - DNA, 4024 bp, Oryza sativa
ggagccgaatccacgccgtcgagctcgtactccaccgccccctcctcgccaaagtcctaagcagggggaggcgctcgaaagggtcgaaagatccgcggtttcaccgatcgcgggcgatggaggagaacggcgagatggggagcgtcgcctcctcgtctacggcgacggcagcacgccccagggtgcgctccaagctgcgggcgcgctcttacgccacccacctgtcgtccctgacccggaatctccagcccaacgatggctggacgacgtggccaaattggtcatgacggcgcggcagcgcctagatgttggtgggcggtcctccgccaccaagacctctggtgctgctaccactggctccgcgtcgtcaagacgaagggcacgacgagcggcggccgctgttcgccgttcggtagccactccctcatcgactccttcgacccgagaagatctgcgtagggagcaggacgcccgcgccagcctcgagcgccggcgtaatgaccgaagtgctgcccacgcgatggaaggcgcttcctcgtccagagtgtcacctcgacacggacgcgggaatcagccctccgtgcccccggttggtggtgttggctgtagagccttcgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaagcacggggttggctaatgaacttgccacccgcgtctgtccactcctgggaggatttgtgccagcagttcaccatgaacttccaaggcacgtatccgcgccccggtgaggaagcggacttgcacgctgtacagcgaagggacgatgagtcgcttcgatcgtacattcagcggttttgtcaagtccgcaataccataccatgcatccctgcacacgcagtaatctacgcgttcagggggggtgtgcggcacaaccgcatgctcgaaaagatcgcctcaaaagagccccagaccaccgcagagctttttcagctcgcggaccgagtggctcgcaaggaggaggcctggacttggaacccctccggttccggagtggcagcctcggccgcccccggatccgccgctcagccaggacggcgtgacaggaggaggaagaagaggtcagtccgttccgacgacgagggtcatgtcctcgccgtcgagggcacttcacgggccacccgaaaggggaggcctgcgagcgacaaaaagaaggaggccagcgtccccagcagggagcgccctaccggcaagtggtgcaccgtccacaatacctccctccatgaccttgcggactgtcgcgcagtcaaaagcttggctgagcgaacaaggaagtgggaggaggagaggaggcaggagcgccgggaaggcaagtccccggcggttccttccggccgtcggcgaagtgaggccaagcagaaggcccccgccgaggacatcgatgatgacgatgatgacctaggtttccaagaacctggggccaccattgccactgtcgatgggggagcgtgtgctcacgtctctcgccggagcctcaaggccatgaagcgagagcttctggccgcggcccctactcatgaggcgacgcgccgggcgcggtggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgacgccggggcacacttggccgctaggtcatatcgacctcccggtcacctttggtggacccaccaatttccgcacggagcgggtaaacttcgatgtggcggacctcagtctgccctacaacgcggtcctggggaggcccgcgttggtgaagttcatggcggctgtccactacgcctacctccagatgaagatgccgggccccggtggccccatctctgtccatggcgacctgaaagtcgcgcttgcttgcatggagcagcgcgcggaccacctcgctgctgcgtctaagcccgagggtggtgacgagaggcttggcacctccgcccccactgccccgaggcagcggattgtcacatgcgccgaggtccccgtcaaggaggtcacactgggcgacggcccgtccaagaccacgcgaatcggtggtcttttggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccaccgggagtggctggcgaacccggtggtcgttcccaaggcgaacggcaagcttcggatgtgcatcgactacaccgaccttaacaaggcatgtcctaaggatccttatcccttgcctcgcatagatcagattgtcgactccacagcggggtgcgaccttttgtgttttctagatgcatattctggttaccatcagattcgcatggctagggaagatgaggaaaaaactgcgttcattactcccataggaacttattgttatacgacaatgccctttgggttaaagaatgcaggtcctacttttcaacgtactactcgaatttctttgggtagccaattaggacgtaatgttgaggcttatgtcgatgacttggttgtaaaaacgcgcaaccaggaaacgttgctttcagatttagcggaaacttttgagagcctctgctccgcccgtataaaattgaaccccgataagtgtgtgtttggtgtacctgcgggcaagcttctcgggttcttggtctctgcccgaggcatcgaggccaaccccgagaagatacgagctatagagcgaatgcgcccccccagtaaacttagggatgtacaatgtgtcaccggttgcatggccgccctaagtcggttcatatcgaagctgggagagaaggcgttacccttatttaagctcctcaagcgctccgggccgtttacttggacggaggaagctgaacgcgccctcactcagttgaaagcatatctcagctctcctccggttctagtcgccccggagccaaacgagcctctgctactctacctagcggcgacccccaagtagttagtgcagcgttggttgtggagcgcgatgagggcaatcctcactccacgcacccccaccctgtgctgacttggcccgggagcgagcagggaggagaggcccccgagccgaacggtggcctaaggcccctggcgaccggagtcggccctctccccgctcgtcagatggtgctgggcgcccccgaccctcaggaaggccccgaggccactgcgggaaggctgcacctatcgccctctgaccccgaggctaaccctgtaccgattcgacccgggagggagcagggagaagaggcccccgagccgaacggtggcctaaggcccctgacgaccagagttggccctttgcccgcttgtccgacgacgccaggagcccccgacacccaggacggccgcgaggccactgtgggaaggccgcccctgttgtcctccgaccccgaggtcatcagcacagaagacgagtgcgccccgaggggccacttggacgaggagcgccccgggtatatggcccatagcgagggggatcggccccaccgaaaggtgcagcggcctgtctactttgttagtgaggccctccgggacgccaagacccgataccctcaggctagaa

SEQ ID NO: 60069 - DNA, 2950 bp, Oryza sativa
gcagcggcaacagatgcaggggaccatcggcttctttcgctacccggggcatggcgccgccgcggagctcgcgcacgtgagggcatggtggtccccgacctcgcacgccgccgccgccgactgggacgacggcgccgactgggagctgcccctgcaatgcaacgggctcgtgctggtgttctccatggagaagagcctctcctcctctctgatgttcgtctgcaacccggcgaccaagaagctcgccgtggtgccgcccggtacgccggacgcgcacgggaaccaaagcgtgggcttcggcgccgacaaatctacgggcaagatcgacatgaaggtggttcgctgcttcgcccgctcagacgagagcgtcgggtgcgaggtcttctccctcggatcgccggcgtggaggccggtcgccgactcgccatgccccgtcagggccggcgccgcgtcgccgtgcatcctcggcgccatctactggatcaccaccgcagcgccaaccccagggatgctacgcttcgacgtgcgccgcgaggtgttcgacgatttcccgagcccgccgtgcgtgcatcacgacggcacttcgccggcgaccgcgaccctgacggagctgtccggcaacaagctgtgctacgcgcacgtcgtcgccggccataccgttgagctctggacgatggcggctgcttccgccgccgacgacgggccgcggtggtcgcggcattgcgccgtcgagctatggcgccccactcagctcgtcgtcccgtttgccgacgatcgccatggcggcatcttcttcaacttggatctcgccgtgattgacaggcatgacacccaacgccaagttgttgaacgtgtggtcgacatgaacaaggagatgacctacttccattcaagggacaagcagtactacataaatcgtggatttaggtggatgcaccatgtcattcagtacagggagagcctagtatccgtaaaagcgaattaattaagggattgtatcagccaaaggaaattaactagattgacttctgttacaattttatatccaggaaagttactgagagtggatgttcacccctttcatgcatttgagtgggaatgggttctaatacctcgcaggatgtctcgtttacctttcttcaatcaaaattcaatacaaatgagattgtgaaaaattctagaaaacttttgacaaggtagagtacaacgagatcaatgactccacctgtccaccagcaaatgttagaacgcacaacgtgagaatgcatcgccggccaagcggcagcgtgcccccgccggcgccgccgaggccgacatcgtggagcaaatatttgtttgcaatccgtgttgccggacacggcacgccggacttcttcagtgcccaaagcgtttcaacaaacggaggtctcaaagaatgtgatgacacaacagaagataaaccgaaatcagcagaacactgaattgccacaactgaatatcagagtcaggcatcataaatgacgtgttccattcttttcttttcgccaaaaaaaagccgaaatcagcagtacactgaattgccacaactgaatatcagagtcaggcatcatagatgacgtgttccattcttcgtttttttacaaacaatacaattttgtgcgatttgaacacatgtcccatcaaatatgtacaatatacccacaagatttataatatactaacactttgatcagccgaaatgaaccgaaaacagaattgtcagccgaaatcaaccaaactatattcgagcacagtctaatttattaatttgcttggatggataccaagctctcactgtactgaatggcgtggtgcatccaatccccatcacagcggtacagcttgcaccttgaactgtcgaagtaggtcatctcctcgagcatgtccaccactcgttccacaactctgcgttcgacgtcgtaccggtaaatcatggcgtaatccacgtagaaacatatgcctccttggtaatcgtaggtaaactggaagaaggtgtgaaaggagtgcggtagcacgacggtgcattgcagcgaccaccgtggcctgctgccgcctccgtcggcggcggaagctgtccagagctcaactctatcgtcggcgggagcatgcacatagcacagcttgccacccagctccgtcaggtccccacaagcgacgtcagacatcttctgccgctccatgaacggtgggcacgggaaactggcgaactcctcgctgcacacgtcgaagcgtacaatccctggggtggtgcagctgccggtggacggcgacggtagggcggcgatccagtagatgccgccgaggatgcacggcgacgttttggtcttgatgaggtagggtgggtcggcgaccggcctccacgccggcgagccgagggacaaaacctcgcatccgacgctgtagtccgtgtaggtcttgtcgcagtggcggatgaagcagtggaccaccttcgtcttgcccgtagattggtcggcgtagaagcttaccgcttgcaccccgaagtagtccagcgcacagtccggtagctcggcaagctccttggtcgccgggttgcaaactaacatctgagtggagtacttcatcgtcgagcgcagcaacacgagcccgttgcagtgcagatgcatgccccagccgatggcgccaacgtcgtcgtcccagtcgtcgtcgtcgtcccagtccgcggcggcgtccccgtcgtcgacggcgtcgtccaagttgtcggcggcggccccgtcatccgcggcatcggccccgtcgtcgacggcgtcccagtcggcggcagcgtacccgtctgcggcggcggcgacggtcgacttcgagttcgaggaccatgttatcctatgcgcgaagtccgcggcgacgccatggcccggatagctaaagaagtcgatcgttcccctccattgctctggcacacaccagtctgccagga

SEQ ID NO: 60070 - DNA, 1348 bp, Oryza sativa
aagttgtttaaggatcgtcgttctgttattattgatcgtctcaattctgctagctctattgctttgacatctgatatatggtctggtcatgctaaggaagattatttgagtgttgtagctcactttgttagttcttattggcaattagaaaagagggtcttgggtcttaggcttattgatgagtcacatactggtgctaatattgctgagcgtgtgattgctgttgctgaagaatatggtattactgataaggttttctctattacattagacaatgcttctgctaattctaaagctatggacacccttactcctgctctgtctggttatattggtgatttatttttgcatcaacgctgtgcatgtcatatcatcaatttgattgttaaggctggacttgacaagttcaagcccatgctaaatgacattagagctgccatttcattcttgaatgcatctaatcagcgcattgctacatataaaaatgtttgcattgctgcgggttatcgtcctcgtatgtttggtttggacatggatgttagatggaattcaacttatctaatgcttaagcatctcataccacatagggaaccattcacagtatttattagtacacaacatccttttgttaatgaccatccattactcacagacttacattgggcatgtgctgaatctgttttgtgtttccttgaacaattttatgattcaactgttgttttgtctggtgtttattatccaacatctccattaatcatgcatcacattttagagattgctggacatctaaacacatatggcaatgttcaaaaccttgcaaatgttgttggtcccatgaaaactaagtttatgaactactggtctaaaattccaattctttattcatttgcatttatcttggaccctagggccaagattagggggtttagtaaagtgcttcagattatggctcaactcattagtgatgattactctgcttatttaacaactgttagagcttcattgtctgatacttttgctaagtatgaaagaaagtttggttctgttagattgcatagttccactattccaggcccttccactggtaagaaaaggactgcatgggggaagatttttggttctgttgttgctgctgggcttggtgctggtaatgcaggtgccagtccaggtgctggtaatgctggtgccagtccaggtgctgggcttggtgctggtaatgctgatgccagtccaggtgctgggcttggtgctggttcattatccaggatgacatctgctactgctttgcttcaggcagcttcttcaactgctaatctcaatccttctgaactgtctgcatatcttgaca

SEQ ID NO: 60071 - DNA, 1752 bp, Oryza sativa
ctattggtttctttatgcctgacccgcagaactgtttattttttgatgcttgcgttgccctgtgccctactcgcttagtgttgtctgttcttgtgaaacgtgttttagtgggaagtctagtaaaaaaaacaggtttagtttttcattctgttaacatgtatttaatacatcctccgtttggattatataacacccccatcggtttgcttatgcggttgcttatcgaataaaaatttaaaagttacattatttttaaacttttttatttatacacgtgtttttgaaagatctacgaaaatactctctgtcccacttccccataagttgtttttttatgggattggatgcaatatacaccatcgttccaggtgccagaccttgcggtggcgcggttcatagtcacattactcgctggttgtacaattgaggaatatgattttaacaggagcaagaaatgaggaaggcaaaatagacttaatcctttctggactgatgtgtgggccttgtttttagctgggctttttctttagagtgggctgccagcatgcacatgggcctcaaacccacatatatcactttaaaatttgttttaaatttacatatacaaagtttatagatataaactttacacgtgcaaagtttaaatgcacatatatgtaaaatatatacgtacaaaattgctatgtatagttttttctgatgtaataaaattctatatatatatttttctcgagactaatttaacacaccgttgaatttgtttcaaatttatatgtgcaaaatttgtacataaaaagtttgtacgcatgtacttacaaaatttgtacacatataatatgtctatacatgaagttttatatattaattattttgcatataaagtgtatgtataaattttttgggctggaccatcacactattaggatgaaccactcaaggctcggtggagagatacggaatgggaaatgattgctatcggctaaagcggttgctctgcatggaaacgtggtcgtgcatggcgaccgaatcgcgatcgatcgccgattagacctaccctctaattcaacatgaaatttcatcgttaatgcaaagtgatgcaagcacaagcctcgacaatgatgcagacaaggtaaggcagctgcttgagtttgatcttctccggtttctccttgatcttgtccttctagtccacctccaagttcgtcagcagctccaaattctgaaaaatctgcaaaacaaacccccaaatcagaaacgtcatttgatggtccaaattgctattggatctgaaatatgtagtttttcagtgcttcattggctgtttcgatcgtgaattcgtgaggcctagaatttgtttggtcattcgtttgtgatgcaaaatttgtaaatagaattctcacaccatagcgcgttacacgttgttttcagtagggagtgtttaaatctagggggtaaagttttggcatatcacatcgggtattatatatgatgtcgtaaagggtgttccggcactaataacaaaactaattacagtatccgtcagtaaaccgcgagacgaatttattaagcctaattaatcttgcattagcacatgttattagtagcaccacattgtcaaatcatggagcaattatgtttaaaagattcgtctcgcaaagtagccgcaatctgtacaattaattgttttttagcctatatttaatagttttatgaggtgggtggttaaactctcaatgtaatatggagtaaaat

SEQ ID NO: 60072 - DNA, 12270 bp, Oryza sativa
cggttacatcacatattcacatgcattgtcatcctgaggctgtgaccatggtccatggcttacaagcaacgctactactaccttcccgaatgagtgactgcctccgcctagctgctagcgggtcacatgcatttcatccggcccaaatgagcgactggcccatcatctggcttgttgcagcgagagacgtaatggaatcattgcctaaaacagaaatgagtcaaaaacgcttttgtacatctgcctagcagctcagcttgaccatacttgccatggagcttcaaatggtagaatgggtcaaaaacactttcaaaaagatcaacggccggatgcccatgcatttaccaaccgggtccggctgctataacaagccgagctcgcacgagccaaggctgaccttcgagcttaacacaggctcaacctctgcgaggctccagctcgattcgtctgagctcgttaaaacatgaacagacaattaagtttatctagagcaaacaacgttgtctcaatattttcattctcataatcaacagtacaccgagacgacatgtttcaacgccaaaggaaaagaaacaacacattgtctcaatattttccttctcataatcaacaaggcacgcaagaacatacaccaagataactggactgctaattagttcagtacttcaaattattaccaagcttgtcttcctccgtattttaatgtatgacgccgttgacctttttgacaaacgtttgacatttcgtcttatttaaaaattttatgtaattataatttattttattgtgatttgatttatcatcaaatgttctttaagcatgacataagtatttttatatttgcataaaaattttgaataagacgagttgtcaaacgttgattaaaaagtcaacggcgtcatacattaaaatacacggatggaataatattttggccaacttacctaaggtttggctaacaaaattgaagatacactttagttagcataagccactattgccacatctttttatctcaatggcatgcgaagcctatatagtgaagaaagaatcttgtcttaagtatgactaatccacctaacttagttagatttgtctaacgcaagatatgtggcaaccttatgctccctccattccaaattaatctatatatttcatagctatatcaagaccaagacaaactaataactctctcatactatatttattctatcaacaaactcaatgcatgcatcatccccaatattttctagccaatagcaaatcaagatattgcatgtgggttataaatacttgtgtgcatgtgacggagcgtggggctcctcaccgggagaccgcgcaggcccccctttgccggttcggccgggggcgctaagtgaggttcttcgccctcgatctgaggaacgtcagcgagagaagaaatgcgcgagacacgggcgacgtagacaggttcgggccgctgagaagcgtaacaccctactcctgtgttctggtggatctgtgagtgaaggaatacagagagccggagagcgagagagagttcaggctctagccccgttcgtcccctctcttctcctcttttttttctctctcctttctttctaggcctgggcctcctttttctctggtcaggggtcaccacaagggcctctcgccacctaagaaaggaaacatgcttttacaatgagggctagtctacagccagaagtgacctctgacaagcagagcgcacgtttcctgctctgctcgcccctttttcggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggtgtgtgacaggccgcctgttgccacctaacccgcgatctgaccggtctgtgaccggtcacacaccgcgactggtcacggaccggataagcgtgcgctgcgctgcattaaatgcggcgtggcgcgctcgtccaacctgctataaatgcggttaggtgagcccggtgggctcacctaacccacagacgtggcgccaaaaccacaggggtcggggcgccccagccctcggggccgaaacgggagcggcccgacccctcggggagacagagggaggggtggccacgtcaccgtcgggcccgaccccccccccgagggggtcaggccacgtgggtgaccgcggctacccaagcctctagtcacgatacccccggccccatgtcaccgacagtagcccccggcgttacgccagggcgaccgcccccctcgagggaggcgctcgggcgtgatgccactccttaggcccggtgacaggtggggccggtccccacaggcgggcggaaacccaacggtcgcaaatcgcgcgcatcggcaagggaaaaaccgatcgacaataatgagcggcctcttcaagaccgctacattactcgagcagcgcgcgaatcgggacgagccggtttgtttcgcctggggacacgatgatggcgtttttcgcggttggcgagcgcagttaatgcgcgcacgatctgccccatctcaaacgccacggccgcacatctgccgcgtgcgccgcaaacgggcaagtggggttagtggaggcgtgggcgcgagaaacgagggggcgaggtagtgggcgcgggaagccaggagccgggcatagcgttggcaagggtacaaagacgccaaggaagggatttgtttccttcctctcaccactcttccccttgcctttgccacttgtgctctgactctccgtttcctgcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcacgctgggcgagggacgcccggcgccgcactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttgtcggggtgcgcccatctctccggctgttccggtggttcttcaccgtacagccggtgtcgccgccgacggtagtcggtggctgctacttccagccgcgggggcaggtgctgaaccgctacattccctgcgtccttcgcaaaaagtgggacgattggaagagcgattggttctacacccccctcgccgacgaagcgcgcctccgacttccgaaccagcctccggcgcaggcctccagctggcgggcggcggtagatctgggagacggctacgacgccgttcttgaccgcctggcgggtctgcgatcccaggggctcacgggggccatggtgttcggcgactaccttcgtcgccggatcgcgccgctccagcggcgcgcccggggcgcctgggagtacaccgggcccgaggacatcatgaggacccaccaggggcgcaaatgggactgggaccctgaggatttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggccccccgaggccacgatggcgcaggtgggagccgcaggggggaacaatctaccccgggagggggtcgtgcttctgggccccgcgacgggggcccggggggcagccaccctgccgacgcccgggggaagaggaagcaggagggtacccctcccccatctcctccccaagggggcggggcggtgcgtgccagcagcaggcgctcggagggtgccgcgccgacgccgcagcccgagggggagcgaaagaagaaacggctccgcaagatgggggggatcgtgccatgccgggggaacctcatctcgcccccgaggtggtcatttagccgacctccccgcaggttcgtccccatgcccaccgcggccgtattcatcctcccatctcccaaggcgagttttcactcacccgtttctttttgtcttctggtttttcttctgcctcagcgagatcccgtcgccccccccccccccccgccattccaagtccggccggtctgaggccgaggagacggcgaccgcggaggtccggaggcgggaagctgaccggcgagaagccgtggaccgcttccgggaagccgaggaggctgcccaggaggccgtccgggttcgccaggctgagtaggccgctcgggaggaggccagactccgccgggccggggagtccgtccgggaggcagaggcggcgcgcgcacgccaggcggcctgccaaacccctgacccgactccacccgaggcgacgacgacttccgaggccacccacgacgaagccgtgggcgcgccgctcaggcctgacccctcgggcgacgcttgggacgagccagcttcggggggcgcccccgagtccggcacgtcgatcggcgggccgagccgcgcgcgcccacaccgaggcgactctcccctctgtcttccgctgccccactgagtgcggagcccttcctgcaggccttggtcgccgcgaacagcacggtgctggacgggttaagtgcccagatggaggccctgcaggcggagcgggcggagctcgacccggcgtgggcgcgcgtcgaggaggggcggcgctcggtggaggccatggtggaggcgggccgcaaggcgcaccgccggcacacctcacagctcgaggcccgtcgtagggagctggcggagatcgccagggaggtggaggaggagcgggagactgccctcatcgccaccgccgtgctcgacgaggcgcgggacgacctccgcctccaatacgggagccgggcggcggagctagaggagaagctcgacgccgcccggggagtccttgacgccgccgctgcccgggaacggcgggtggcggagaacgaggcggcgtcccggcagcgcgaagaggcccttgaggctcgcgccacggcgctggaggagcgcgcccgcgccctggacgcgaaggagagagacctggcggaccgcgaggccgccgtcgccacccgggaggcaacactggcggcgcacgaggccgcctgcgccgaagaggagtccgcactccgcttccgcgaggacgcgctcaccgagtgggggcgagctctcgaggaggccgaggccgtggcgcagcggctggcggacagcctgttcctccgcgagcagtgcgggaggagcaggcgcgtcgcaatctggaaggcgtccgcgccgagagggcagcactggatcagcgggccgctgagctcgaggcgcgggcgaaggagctggacgtgagagcgcacagcggcggggcggccgcgggccacggcgacctagccgcccgcctcgcagccgccgaacacaccatcgccgagctgcagggcgcgctggactcgtccgccggggaggtcgaggccctccgtttggcgagcgaagtagggcccggcatgcttcgggacgccgtctcccgtctagaccgcgccgggcggcaggcgggcctctggggcgggcggcacgcgaagtacgccgccaaccaggggggcctcgcccagcgcctctcagagatgaccggggccctcgagcggctccccaaggagctcgaggagacgatcatgtcatcctcgagggacctcgcccggggggcggtggagctcgtactggcaagccaccaggccagggaccctgacttttccccgtgggcagcgctggaagagttccctccaggaaccgaggacggcgcgcgcgcgaaggtccgggacgccaccgaccatatcgtccacagcttcgagggtacggcccctcggctcgcgttcgcgctcgactccgacgaggagggcggtgacgacggtgcggacgacagcgacgacgaggccgacgtcccgggcgcgtcggagtgagcccccaggcccccgccaatcttaataacttttgcttcttcttccgaggctttcgggcccccttcttgtatagactgatttaatctgtaatcaagtaaagaggaaatttccacgtcagttctgtttgttgtgtgtatgagacgaggatggttcttgccgcggtccttctttgtcttggcttgaacaagggctcgtgcccaggtcccagcctcaaacggcgcgggtcggagccagtgcctggggagatcctcgtgtcgagactggccaggccgggagcgcggtgaccgagggttatggatgacccgattgtgggcctttgccgattcccccccggaggtcaccacgccccggggcacggctcggttctgggccccgtttggcgattttagccggcccgggccgccgagggcagggtcgagcacgagcgtgctaattcaagccaagattcttcaaaaggaaacgatggcacagacacagtcctcaagaagtcgaaaatgcttttattgaaattcggaagagaaaaaaggtaagtatatgcatgtggtagcccccggccaatcctgcacgcccagggggggtgcggggttggcccgagcccgagacatgacgcccgacccccactaggggtagaagcgacgaaggtgttcgatgttccacgggttaggcagctctgtgccgtcgcccgtggccagccgaacggagcccgcccgggggacgccgatcactcgatacggaccctcccacattggtgagagcttgctcagtccagcacgcgtttggacgcggggtaggacgaggtcgtcgacgcagagtgatcgggcccggacgtggcgctgatggtagcgccgcaggctctgctggtagcgcgcggctcggagggccgcgcgccgccttcgttcttctaaatagtcgaggttgtctcggcgaagctgatcttgatcagcctcgcaatacatggtgacccgaggggacctcagggtgagctcagatgggaggaccgcctccgcgccgtagatgaggaagaaaggcgtttccccggttgctcggcttggcatggttcggttcgcccagagcaccgctggcagctcctcgatccacgagtcgccgtgcttcttgaggatgttgaggagtcgcctaacaccaggaggcggcggatccccagtccagctgccactctgagtcccgcaagaagtccctcgtactccgccatattgttggtcgcccgaaagtcgaggcggaccaggtatctgaggacgtctccgctcggcgaggtcaacgtgacccccgcaccggcgccctgaagagacagggagccgtcgaactgcatcacccagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaaccactgtgacccgatgcgcctggaagtaatggcgcaacttcctcgaagccatcagaatagcgtaaagcatcttctgggcctgagggtatcgggtcttggcgtcccggagggcctcgctaacgaagtagacgggccgctgcacctttcggcggggccgatcctcttcgccaggggccgcatctccagggcgctcttcgtccgagaggccacgcggggcgcactcggcttctgtgccgacaacctcggggtcagagggcgacaggcgcggccttcccgcagtggccccggggccatcctgggggtcgggggcgcctggcaccgtcggacaagcaggcggagggccagctccggccgtcgggggcctcgggccgccgttcggctcgggggcctctcctccctgctctctcccgggtcgagtcgacacaggactgggatgtgcggggcgagggttgtcctcgtcgcgctccacgaccaacgccgcgctgaccacctgcggggttgccgccaggtagagtagcaacggctcatctggctccggggcgactaggactgggggagaactgaggtacgctttcaactgagtgaaggcccgctcagcctcctctgtccaggtaaacggcctggagcgtttgagaagcttaaataggggtagcgccttctctcccagcctcgatattaaccgacttagggcggccatgcagccggtgacgcactgcacatccctaagcttgctgggggggcgcatccgctctatagctcgtatcttctcggggttggcctcgatgcctcgggtagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaatttgagtagtacgttgaaaagtaggacctgcattctttaacccgaaaggcattgtcgtataacaataagttcctatggggataatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcactttctgtcggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccactgattcgtgtggtcttggacgggccgtcgcccagggcaacctccttgaccgggacctcatcgcacgtgaccatccgctgccttggggcggccgagacggaggtgctgagcctctcgtcgccacccgcgggcttggacgccgcggcaaggtggtccgcgcgctgctccatacaagcaagcgcgactttgaggtcgccatggacggtgagggggccaccggggcccgacatcttcatctggaggtaggcgtagtggaccgctgccgtgaacttcaccaacgcgggcttgcccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgtggccagaagctctcgcttcatggccttgaggctccggcgagaagcgtgagcgcacgctcccccatcgacggtggcgacggtggcctcaggctcctggaaccctaggtcatcgtcgccatcgtcgatgtcctcggcggtggccttctgcttggcctcacctcgccggttgccggcgggagccgccggggtcttgccctcacggcgctcctgcctcttctcctcctcccacttcctcgtccgctcagccaaacttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccgcgaatcgccctcgacggcgaggacgtgaccctcgtcgtcggaacgggccgaccccttcttcctcctcctgtcccgccgccctgaccgagcggcggacccgggggcggccggagctgccacaccagaaacggaggagttccaggtccaggcctcctccttgcgagccacacggtccgcgagctcaaaaagctgcgcggtggtctggggctccttggaggcgatcttctcgagcatgcggttgtgccgcatgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactgctggcacaaatcctcccaagagtggaccgacgcgggtggcaagttcattagccaatcccgcgccgacccttcagggccatggggaagaaattcgccatgaccctgtcgtcacccccggcggcctcgatcccggtcatgtagatctggagaaactcggcggggttgacgcttccgtcgtatttttcggtgatggtgggccggaaccttgggggccaacggacgttccgaaggctcgccacaaaggttcgacagccggcaccgccaaccggggacacggggggctggcccccgtgcccggaccgaagtggcgctccggacgaggaagcgccctccgttgcgtgggcggcgtgacgagcgtcgcgccggcgctcgatatcgaggcgggcatccggccccccactcacatcttcttgggttggaggcgttgacgagggaatggcggacgaacggcgggcaacggccaccgctcgccgcgccctccgcctcgacgacttggagccggcggcggcagcgccagaggcctcggtggcggaggaccgcccgccggcgcctagtcgctgctgcgccgtcatgaccaattcggccacgtcatccagccaacgtcgggctggagtctttggatcggggacgacgggcgggtgacgcaggagcgcgcccgcagcctggagcgcgccctggggcgtgccgccatcgcagtagacgaggcagcgacgcgccccgcctcgccgtcctcccccgtcgcccgcgggcggcgaagtcgcggatcctccaacctccctgagcgcctccccccgcccaagatttcggcgagagggggacggtggggtgcgagcccgacggcgcgggttctgctccccatcgtcaccgctagcgttcggagagaggctgtgcgccactgcccgttcggccattgggctgagcgggcgaagcttggcgcacacgaaagaggacgagggcttagaaagacacgcgcgccccctacctggcgcgccagatgacggagcgtggggctcctcaccgggagaccgcgcaggcccccctttgccggttcggccgggggcgctaagtgaggttcttcgccctcgatctgaggaacgtcagcgagagaagaaatgcgcgagacacgggcgacgtagacaggttcgggccgctgagaagcgtaacaccctactcctgtgttctggtggatctgtgagtgaaggaatacagagagccggagagcgagagagagttcaggctctagccccgttcgtcccctctcttctcctcttttttttctctctcctttctttctaggcctgggcctcctttttctctggtcaggggtcaccacaagggcctctcgccacctaagaaaggaaacatgcttttacaatgagggctagtctacagccagaagtgacctctgacaagcagagcgcacgtttcctgctctgctcgcccctttttcggtggacgcccatttcaacctcatttaatggccagcgacttccttgccatacttgcgctgaagcctggaa

SEQ ID NO: 60073 - DNA, 1324 bp, Oryza sativa
cctgctataaatgcggttaggtgagcccgctgtgctcacctaacccacacacgtggcgccaaaaccacaggggtcggggcgccccagccctcggggccgaaacgggagcggcccgacccctcggggagacagagggaggggtggccacgtcaccgtcgggcccgacccccccccccccgagggggtcaggccacgtgggtgaccgcggctaccgaagcctctagtcacgatacccccggccccatgtcaccgacagtatggatgcatgcatcaatctccatttgctccaatgcacaaataacaaatagactttaataaatgcatacaaatatgtagatcatttagaaataacctaaaaaaactatatgtagatcaatttgaaatggaggaagtatatgttatgggaaccaaccaaacagtctcgacatggagtcttgttatggtggtgcctatactattagactagctagctaccctgtgtttattttgtgggtttagcggaaaactcatagaaatattaattattgtgacgagttggatgaagattaagattttcgtggcacgcttttcaaactgctaaacggtgtgtttcgtgcgaaaactttgtatatgaaagttgctctaaaatatcatattaatatatttttcaagtttgtaataattaaaactcaatcaatcatatgttgataccatatcgttttgtgtaaaaaacttaatctcttcttcaattccttcccatagagcatggtgaagcgccatagcctgctgctgcattcgttgccgttccaagagctcctagctgcgccagtagcccagtactcatcatggacgatgctgaacactagtacagacctgtcgatcggttcgtaataggatttgctcttggttttaatttagaacctgtgggaggcatacgacaatgatgccccgggacatttactatcggttttaaatcggtggtgctagctaggcatcactgctggtttaggctgtgcttagttcttgtgccaaattttttttaagtatacggacacatatttaaagtattaaacgtaaactaataacaaaataaattacagattccgtcggtaaactacgagacaaatctattaagtctaattaatccgtcattagcaaatgtttactgtagcaccacattgtcaaatcatgacgtaattatgctcaaaagattcgtctcgcgatttacatgcaaactatataattggttttttttccgtccacatttaatgctctatgcatgtctccaaacatttaatgtgacagaaaagttataagtttgaagaaaaaaaattaaatctaaaca

SEQ ID NO: 60074 - DNA, 19144 bp, Oryza sativa
  unsure (1)..(19144): unsure at all n locations
aaaatttttggtaacaaaaaagataatatatactatgtatacagatcattaggccaaaatatttgtaggctttgaaaaaagcaatacaaccatccgtccaatggtattttcttcttctagataatagagataattgggtatcattcaatggtattttcttcctctagattggatccaatctttatgggtggtgcagccatataatcgctacaatcgcaacggttagttgtgtcttctgtactatttttttcgttcattgttcactacaaatcattcacaacaagttatgtataaagattgagatatactttgtttatatatgcatgcctgcgcttcgattgagtgttcattagtggtttgagtatattttcatcgtcgaactgtttccttggtactatgtacacagtccgtagtctgtaacttcgtacccccattgttgaaatcctgcgtccgccactgcatggtagcctcagacggcgggtgcacctcctggaacaccggcgccgaacagacgggcgtggttcctgcgcgacgtgggggctcgtatatatggtgacaatagcggccatcgacagtgtccatgttgagcacactaaagggggtaataacccaacatcttaacctccctgtggcctgtggggtggatggcttggctgatgaagggggtaaaagcgtaagttattaaagcgcacagcataacgggctcggcgtttgatttcttgccgagccgagctccaaacaagcttgaaacgagccgaactagcttgcgtctcgagccttttggacagctctgtccggcgggcgatgatataaggacaaacagcgctctacatgccgatactccgtcccattcttccgcaagtccaacaagtcaagatgtcctcatcagcgccaacaggtaggccagctgttcttttttttttccctcccatttactgttgaattaaggccaaaagatcctactgtggcgctgctagttttgaatctgcactcatctacaacttaactgttctttcattcattcgatctcttgcaagagaagttagttacaaatcttgcactcctatcctttgcaactagcgctttgttcttaatttcattgatcctcttgcaagaaaagaaaatggtttttttaaaaaaaaataaaaaatttgcttgtggttaacgtaccgcttctttttgctcttgtgttgcttaccaaggtgattcgccgccgtcgcggacgccggaacagcgcgtgtacgacgaacaccgcgtttcggtagtccaggtgacgtgcgtgctggttaccaaagaaggcaggaaacttggcgtgggaactggctttgttgttcacaacgatggagcgtcgtgcttggtattaacctgtgcccacgtaatcgatcctaagcggagtaagctatgttctttttccctctttcccaactcccttcactcgtttttcacgtacacatttttcaaactgtcaaacgatgtatttttttaaaagttttctatatgaaagttgttttaaaaaattatattaatccatttttcaagttttttttagctaatacttaattaatctcactaaatcgtgtgctttgttctccgtgtcaggaggaacacagcctaaggaactgtccgttcggtttggtgcggatcatatcgcctctgctcgattggtgcacgtctcagaacacgttgatcttgctctgatccgtgtccaaggggcgcctaactgcattcctctgggattctccgatgaggctgatttgtctgggaaggaggttgtcgcgattggattcttcggacttgacggcacctccatgtgtattgatccgggaacatcgcgcggccacatactgtaattaacgagagcctttctttcacatttttctttatgaaactacatatgtatatgtatgttcaatgcaatagctttgttaattactgtacacgctgatgcaaacctactgctcctagtaggtaactaatgctgtttgacgctgtctgtttcacaacatgcatgtgcaggggcgaagcagtggtctttccaacagattctgatgatctaaatgaattctcccctaccaatttgccgacggcgaaaggcatgtcaggcgcaccggtcctcctggaggataaggtggccggcgtcctatgcaatagtgatgctgcggttatcaatgttatctaaatagttatgaaaaaattttaaaaaattgacatgataggttagtatgtatcacttcacaagcatgcaagttcaaattcaacttctacaaattgtaacaaaaataacaaatttgactgtaaatatacatatactagttagagtttaatttgttatttttgttacaacttatagaagtcgaacttgaacttacatgtttgtgaagtaatatattacgtattaatctatcttgtaaatttttttaaaattttttcataattatttaagtggaatgcaagaaaagagagattagaatccatcctctgagagtgagacagagatttgtcgaccaccattgcttcaagaaccaccaatccggcaatctctgattccgttcatccttcgttccagcttggtatgatccaggacggcgtctcgccgcagagggccatctccagcttgttgaggcagcaggcgagcttcttgaagctccggttctccaggctgaacaccgactgtacttcatcgtggtggaatgccgatcgttcacctccttggtggtcaccgagtagatggtgttgccctcgaggttctcgaatcccgcggtctccatggcaaatccgtgcaggaatcgacaaacagggcgcggccgccgatgccggtgagctcctgtcaggccaagtcaaagctgtccggaagccttggagaagtcgatgtcgtcgccgaagaggtacatcctttggacttgatgagaaggaagagctcgtcgcctgccaccgcgatgcgcgcctcggcggggagctcgacggcgggcaccgggatgacggcggcgatggggagggtgagggcgtcgacgatggtggtgcagcagtagcagacgtcgtcctcgaagacaaagaactcgccaccggagtagttgatgctgctcgcgttgcagtcggccatggcggcgataggggcccaggcggcggcgggcgggtcggaggcgtagaagaggagtccctcgccgcaggacgccatgacgccatgcggcgaccagtcccaggccaggtcgtccgtctcggcgaagaaggccgggagcggcgggagggcgcggacggctccggtgaagaggtggaggagcgacgcggcgaggtcggtggggtcgatggcgagcgtccacccgtgcggggagacgtagaggatgcagtggcggcaaggagcggcggtggaggagacggcggcggtggagaaggcggcaggcgatgaaggcgtgataggcgtgaggaggcgtcggcggcggggttcgcggctgccggcggcgggcgacggggtaggcgcgaggaggcgtcggcgccggtggagaaggtggcggggcaggggagggggagatggatcgctaattaatttctataaccgttcacacggagtgggatcgctaatttctgtgtttgttcagcccgggttgggaacccaaatcctcagaacgaaaacggagcgatacattaatacttgattaattaaatattagtaattattttaaaaaataaattaatttgattttttaaacaattttcatatagaaatatttttaaaaaatacaccgtttaacagtttaaaagcgtgcgcgagagaggggttgggagctgaagttctaaacacagccataaattcgttggatgaataagggcggtcctaaccctccatttaggatggtgtctatggcattaactatattgccatgtaggacttttatcttatgtggcactatattaattaagagagagtgaagagaggaagaaactggatctcatgcaagacacagcttcaacatgagaacctatgcactagacactatcaagttttgtattggaaaagaatagtgactttataatagatgaagaataaatatgagttatccctggaagcggcggaccaataatttcaagccccttggatcaatttttcattgatccattatttggtcttgatatgggtaacttttatttatcattcacaaatgaatccttgtctatggcggtaactatcattttggtgccatctttatttggagttgttacgaaaaagggcggggaaagtcagtgccaaatgcatggcaatccgtgggtagaggagagaaatgatgtatttattaatagcccactttaagaaaccatgggttgtagagtatagtttctattgtgatgtcttattgatatggcaccatagacattgctgcttatggacactatgggttgaatgccctaaatctgagggttaggaaagagaggtgtttaatgaattcgtactttctatattagtagagattatcaaatgtgtagtgtatttgtgaaaaatgcatattttaaaacatggttatcgtgacaacaaattatgatataagttcgcattgttcctctcattctttttgttgtctttaatttccagaaatatatcgatttggttagggtagcttccctgaaaaaaagaagaagaagaagttagggtagctgcctcaatttccgattcaagccatagtatataatttatataaaatatttttacttctttctttcttgtatttaatttttttcctcctttttcgttttcctcataattccttttccttgttcacgcacgcaactgttgaggcagaaatgctactgggcgagattctcccccccctctctctacttggtttcttttttttacaccgcattactttcctattttagtaaatttatacacctcaagtttacacatctaaagtttagagactaaaagtttataagtcaaaagtttatatatctgattcaaatttgaatttgaattcaaatatttttcatatatagtatttctatacatctaaagtttatacacctaaagtttatagacctaaagtttatagacctaaagtttatatacccgattaaaatttaaatttgaattatatctaattaaaatttgaatttgaattcaaatgttttctatatatatagtatttctgtacatctaaagtttatacacctaaagtttatagacccaaagtttataagttaaaagtttatatacctgatttaaatttgaatttgaatttaatttttttatatatagtatttctatacataaatttttctaattttttgttttttaaaattttttatggtatactgtagactatattaggaagagaagaagggaaggaggaagggaggagaggaggagatgaattggcaacgcgtcacttgcatacatcaacatagtgaggggcaccgagtgggcaggtccaggtgagcgactgggctagctaggcccaactaagtgctcggagctttttttttttttttctctttacgcttgtgtaatgttggagaatttggttacgcttgtctagaggttttcgttttctttctcaaggaacgacccctcgaattcaccaattcattcgcaattgattaagccacgtggaccaatcaaattctggcacaacggccagcttgagattagtatactagaaaatgagcgctcccgttggcgcgcaggctaacttttagcctataatattatcgtttagattcgaacttttttctttaaattttttaactttttcatcatatcaaatgtttagacacatgcatgaaacattaaatgtggacggaaaaaatcaattacacagtttgtatgtaaatcgcgagacgtatcttttgagcttaattgcgttatgatttgacaatgtggtgttacagtaaacatttactaataacgaattaattaggtttaatagattcgtctcgtagtttataggcggaatctgtaatttgttttattattagtttatgtttaatacttcaaatgtatgtccatatactttaaaaattttgtcacacgaactaaacacagcctaagttacactcctttttgaatgtgtaaatattgttgagtaccacttttatatgtctgtcgacgtttgatgtcgcgattccggtatttgcatagtatgaggatcgttggtattaggatatacgcgagactgaggtaaaagagacggagacaaggatttttatacaggttcgggcccctgaattatcaggcaataaccctacatcttgttggccgaagccggtattgctcttattcaccataatcacaccagtacaatatttggggtagcctatctaactgttgttggcatggtgatctgaaggtctaactcgtggtcgacaacaggttagtcttcctcctcgaatccgtacccggcgagatcagagatagcgctttcgtctctcctgacagtatcctagccgtgcttatccctgaagtcgatatccggcgtcttatcttggtgtatgttggcttgtattggcttatggctttgtggcgtcccctctcctcctagggggtcttgtatttatacccataggtgtcctcttgtccaagtagaactagggaaaccaatatggatacaatccgagtagttcttgtcgtttccatatagaactctggttgtctttccttatccgaaactcctcctatatccgcaggttgtttccgtataggacatggtatgtggtggatactgctgagatttagtcaactactattaggtatgtggtatccataaccctgacaatgtcttctttctttttgccacttcatcaaattattacacatattacttggtatatgtttttttttcaaaatactttcctctactgtaatgcctagtcgacttgtttcataccacctgttaagtttatttttcacataatcaggcagataatatgtagtaataattcagaggataatttaagtgggccttaaggataaaacattgtatcacttttagtttggaattaattaatatattgggttaaaactaacctagtgctaggaataagccaagattttctattgtccgtgacgatggaaaaacctgagtctaggccctgttcttttcactttttctttaaaaaaattgccaatgattattttctccatgcttttacaaatatcaatatattctccatgcttatacaaatacaattctcaaaaaacaaatcttttattgttttgttcgtacctcttgctctaggttatttctaaattttatttctcaaattactccatccttccactatatatgaagttggttagttcatttttaactaaaaaacatcatatatataaatagaaggagggagtattaatttatcttgttaatatagtatataatctccctcaataatacgcaaaaaaatccatttgaaccaaaaccttaattgatcagcatagtgttgttttttaaacaacgcatagtgatatctttaaaatactatttattcggttgaggttaagacgtattcacagggattaaaaacgtaaaaaatgcctaagtatggggtagtcacatgaggtgacattccgagtgtttctataatgctcatctctaataccgatatcagggctctatccctggttagagattgggccatgtggcgtcctataaattaagcttctcatctccgaaaatctgccatgtgtctccttgctctccgaaagttcactgcgatggaccaacgaagcttgattttttctggcaaaagcgctcgacccttaatccacccatccctcctcccgatgcacgcctcgccgcccaccggatcctccgccacccgcgtgccgcagcggaccacccactcatgtcctccctcaaggcgcgggctcgtcttcttcaccaccacccggccaccttgccctcccctgcgctccccgccgccatgctgctgcccttccttgacacgcggggttgtcgccatgttgcaggagtcacctcaagcacgcgatagccgtcgacgatacaaacttcggcaagatccattgagcccaatgaagagaagagtagcggtggtggccgtcgacccggaggccggatcaggagaagggagggggcgctagctagcggaggagaggaggcggcgtgcacgggtaagtggtggcgtcgcgccggatcctctgtcacctgcacgtcgcggctatgacgctgcggcgaaccacccgtcgacggcccgaggagcaggagggattgcaggaggtggaggacagggagcgcatcgcagacttctcctcgctcatgttgacggcgctacttcgatcttttagacacaggcgccatcgaacttcctgcaaaggatgccatatactgtccgttgtcgcagcggcaccgtggcgaagatggagacgctgaggagcaaggagcagattgaggaatggagactggagagcagcggagtcgtcgacgactacgaacgggggctggggactgggaaggacaaatatatatatatatatatatatatatatatatatatatatatatatatatatatatatatatatatatatatgactttatttagctgcaagcctgcaactgaagacatcgtacgaacggctagatcaatgtacagacggacggctctgattttttgcatgacgttgccatctaaatgaaaaaacagtgagtattacattcagatagtgtgggggagaaaaactaaagatcttattatatcatttgattgtgctctcagttgacacttacaggctcccatcggatggcctaatcagctaaagaaaaaactaaattttgaattttcaagcttaattttgagatattttcaacgtagtttctttttcaacattggcttttaagtcaccaagaatacatttataaaagttttacctacaaatttatttttattttctaataagccgttttggcttattaggaaataagcaaacgatgcggaccacagttcggctgcacatacaagttgcaatgggcagataaagcctctttgcaatcatttatccaggatataatttttttagggagtatccaggatataattaagtagtagaagagaataaggaggtaccagtatcttttgctttagcttgagctcaacgcaattccaaattttcaaacaaataatttattccttactcttctttattgtgcaaatagaattttttaatgttatgcacttttagaacgttatgtttaaagaataagaagataaaattattttttaaaaaaggattttcttgatttttacagacatgtggaggcaggggtgaagccacacctggctatcgcaggcggccgcgcaaactcaccgacaaaaactccattaaatttatatgttattgaatgaattgatgatgaaatttatataataaatactagaagtatagtttgcttgggctcaaaaaatctttttagctccgccaggagataaaatgaaaatactccctccatccaaaagtctaagacctactccctccattccaaaaggactcaattcttgggttttcgtgcccaacatttgaccgtccgtcttatatgaaatattttttatgattactattttttattattgttagatgataaaatatgaataatactttatgcatgacttatctttttaaaatttttcatattttttttcaaataagacggatgatcaaacgttagacacaaaaacccaggaattaagtttattttgggatggaggaattatttcttttggcaccaagaccaaggagtaattaatttatttacaatgtgacaaaaccaataagcatgtaaccaataagtaataaaatggtttattgggttccgatcaataatttaatttaaaacataatgactataaataggacttaaacttttggaaaaaccaaagaatagaataagttttagacttttagaagaagggagtaagtagtttcattactttggtttcgttggaatttggaatttgtgcgcatatattcgacttccaacttatgtctatgaattcaatgtctcgctgctttaaattaatatatgaataaaagggcatagtttccataatttcaggcattaaatagataaagaaattaagtgtacttatcataccatatcatttactccctccgttccatattgattaccatataactttttcaccaagacaaaaaaaagtattaactttcctatatttcatttaatgtgagtatgtggtagggaaaaatcaagaaacatgcacactttaactcctcttaggccccatacataagagcaggtccaattataaacacatttcgatgagataaaacagaagagagaagagcagtgggctatagatttgtagccagctgtagcacagactccaagatacatgtatgtatgacaggtgcgaccaagtataaattgtgtagtgatgtttataggagtatatgaatttcctactaaattgactatagatgatttgaagtcagtggttgactatactattaaacttgctctaagaaacgatagctttactacctcgaattcctacatacatgcatgcatactcaattttcatgcttaaatgcaataatattacacgtcaaacgaaggggctatgataacatgatgatcaatttaaaaaattcaatttgtgttaaatgatgatcaatatgaaacggatggagtatttcataggcaaagccgcgtctattttttagttctttctttcccatggtgcttctttttttcaagacatttctctttctctatattcttttagatatctcatcccagccaattctgcattcctatgagcacgtacaccaagctcgaactgggaaaatactaatggttggttgatctggtaatagaatagtttggtgtacttctgtttggtgatgacttgagcagataagcaaaggatacttgtccatccttccaaaaatccactgctgcctgtgcacctgcttcgcatggttgagcaagttatctccaattcagaggtttgcaaggctgcaagcataagaaacttctattttaacataaatcaaaatttaaacatgataagaggtcatcaatagaacaataaagtaatacatcaagcaattttctgaataaactatagagcaaaagtatacctgcaactgcagcttcttcataaagcaaggtactagtaccactccttcacagcttgagccagaagggcccttgtcaggtattcagatttcaggtgtagtgaattacttgcaagaaacatggctggtcattataaagagtgttcatgaattctaggcatgccatggcaggaaacaatagccttcttgccatggactccaagctctccatgctcttcttgttgctaggctttgtggcatgttctgccactgctagtcaccatgatccttccgttgtcggatactcgcaggaggatcttgcattgccaaataagcttgttggtctcttcacatcatggtcagtaaaacatagcaagatctatgcaagcccaaaggagaaggtcaagaggtatgagatcttcaagcgaaacctgaggcacattgtggagacgaacaggagaaatggcagctattggctcggcttaaatcattttgctgacattgcacatgaagaattcaaggccagttacctgggactgaagccagggttagcaagaagggatgctcagccacatggttcaacaacattcaggtacgcgaacgccgttaacttgccctgggcagtggactggaggaagaagggagcagtgacaccggtcaagaaccaaggagaatgtggtaagctcaatgtctgaaaaatgcacactatctatttagcatagtgatactgaatccctgaaaatgcacacgatctattcagcatattgaggccgaatgcctgaaaatgcacacaatttatttcagcacggtgatactgaatccctgcacacaatcaatttcagcatattaatgctgaatgcctgaaaatgtgcacaatctatttcatcgcatcgatactcaatgcctgaaactgagagtgcacacagtctgtttcagcatattaatactaaatcactatctgaaatagtgtatgatatgatgcaatttgttccatgaaaatgctgtaagagaaaacggtctcttgcaggaagttgctgggctttttcaacggtggcagctgttgaggggataaaccagattgtgaccggcaagttggtatcactatcagagcaggaactgatggactgcgacaacaccttcaatcatggctgtcgaggtgggctgatggacttcgccttcgcatacataatggggaaccaggggatctacacagaggaagactacccatacctcatggaagaaggctactgcagagaaaagcaggtagaaacatgaaaaccacttcttcttcagaggcaattcagctgtaaacacatgtagtgatctagcaggatctctaacagttgaatttatctgctgtgatgaactgatgactggtggttagcctcattccaaagtcatcaccataaccggctacgaggatgtcccggcgaacagcgagacaagcctactgaaggcactggctcatcagcctgtcagtgtggggatagcagctgggagcagagactttcagttctacaaaggggtaaacaaaattatcagctgttcttcaatcttcattcaccatgatacagtacagatcagcacaaaaacattaaactgacaaaatgggtgtatctgaatactggatgcaggggatctttgatggggaatgtggcattcaaccggatcatgcactgacggccgtgggctacggctcgtactacggccaggactacatcatcatgaagaactcgtggggcaagaactggggagagcaagggtatttcaggatcaggaggggcaccggcaagccggagggagtctgtgacatatacaagattgcttcttacccaaccaaaaacgtcactggctggggttcatagctagttttgtaggcgatcttgtaatccatttgtctctgacaagaaagaaccggcctaagcaacgctgtgcaattcctggatgcttcggagtggagctcttaagcagcacagcaatggtttattatataatgacagcttgggtttttaagcaaaatggtcccatggtctagtggtcaggacattggactctgaatccagtaacccgagttcaaatctcggtgggaccttgatatattcttttattttttttgcttctcagcagacatttctcgtctattctcttccgtatatttttcacattttattttccctcttttctcctcctcaggtcaataaaaaaattgtcagcctatattttacacattttattttccctcttttctcctcctcaggtcaatcaaaaaaaattgtcagccacttttcacatttctcgtctattcattttcccagacatgctttttaaaaatcacatccagttcttgtttataatttttatttaaaaaatcttatccacaccactacttttctccagcgtctgctacagtgacgcaatcatgcaatcatttgcaatgaaattttctgatatgaaagccatgatacgttccaatttacttcctcctttttttaaacatataatactgttaatattttaagatagtttaaacattcatcttatttaaaacttgatttattattaaatattttttaagcatgacaaaaatatcttaatatttacataaaaattttaaataagacgaatgtcataaaagttaataacgtcgtatgttaaaagacagtggcaatggccctgtttggatccaagggatattttttagccctccctaaaaaatagtccaaatagccaaaaagatccaaaagggtgagctatttggaaataacccactcaaaaaaaattattctacccaaggggtgctaattgagcctatttcgggtggggctcactgaaaaaacgtcttttctctctatctctctccataggaagatacataaaagcaacccttgaatccaaacaacttagggctatttttttagagggttattttcttatctaaaaaatagctcttaaaataattcttgcctagttctacaaacaggttggttgtttatatttttttttagaaaaaacattccgcgtgggccatggcccatgagcccatgagagataggcctttcgagttcccatccgacgatctccacccggacaggtagtaaagcgcggtcgccgtcgccggcgacccatacagccatactgttccactcgccctcgttttctccgccaccgagcgcatctcggcgtcggcggcttggggggagagtcagagatgcatctgagcgagaacgaggggatcgagggcgtgcggttcgcggtgacgggcggccagggcttcgtcggctccgcactgtgcctcgagctgctccgccgcggcgcccgggaggtccgctccctcgacctccgcgcctcctccccctggtccgaccagctgctcggcgccggcgtccgcttcttccaaggtccgccatctcgagttcatcctcactacagtggttttggcttttccttcactgtaactgacgcggtcactgagttttttcttagaagtaagacgcactggagcgctagcgctgcgctgctttgcttggctatagttctacctccggatttgttgctaactagtgtgaaattggagtaaactactgcctctgtgctattagctagtacatatgttttggctcttggagtagttagggaatcttgaattttgttttctcaacacagtgacagtaagttagtaacaccaacaatacccatgatgtactgcgcataattgcctggttagcttgttacttgtgtgtccattgcagtcggctctgcatttccgatgcacgaattaagttatcaaatacctgatcggtgaacctgtgttgcaggggatgttagaaagaaggaagatgtggggaaggctttgcgcggtgtggactgtgttttccatctcgcttcgtatggcatgtcagggaaggaaatggtacaggctgggcgagccgacgaggtcaatataaatggtacatgcaatgtgctggacgcttgccacgagcatggtgttagaaggctcgtgtatgtaagcacgtataatgtggtttttggaggagagccgattgtcaatgggaacgaggcgctgccttatttccctgttgaagaccatgttgatgcctatgcgcgtagcaaatcaattgctgaacagttggtgctgaagagtaatggccggcaaactaagtaagttgagccatttttgccatgattcttatgtctgcctcattgccatgtatatctgccacttacatacccttcatataattttgccgggtcggccgatacccttcatataatatcttcaaatgtgttgttttcacctatgatgagcgtattttctactttccatgtgtcaagatccaccaccaattatttcattttggcttgggacttaagttgaacattggtaatatacaggctgtcttactgatttgatgtttttatacaggagtgataaaagcagtcgtctttatacatgctcaatacgtcccgccgctatctatggtccaggtgaagagcggcatcttccaaggatactatcccttgcgaagttgggattagcattcttcaagattggggatccaaatgtgaagtcagattgggtctatgtggataatcttgttcttgcactgatattggcaagcatgggacttttagatgatattcctgacaggaagggaattcctgtagctgctggtcaagcatatttcatatgtgatggtaagtgcagttagcctgtagggcaactatattactggttaaccttttctgataccatggcactatgttctgaattttatttccatcttttgaataggagtgcagccatttttatttttgtcttgtcatattgataaatctgaactgttgaacactagactactaagctgaatgctaccataaaaaaacagtagtttacactcttgtgttctgcattggtgtctttgttgaggatatctattcaaaatgatttactgcatagctcgttttagctatttatttgttttgcttattctgaggttgaaaccttttttcttttagagggagttgaaatttttattgcttacagatcatacgtaatgagtctactggatgctctgttgaatatatttacattcaatactgaaccattactcctttagcaacttgagcaattacacttatattccttaccagaattgctcttaatgtttgttgtttgtaatttgaaagaaatgttgcattttcttaacaagaaactattggttgtttgcaggatcgcctgtcaatacttttgaatttctcagtcctctatttcaaagtttggattacacagttccacgagttagaatggatacctcagttgctcttgccatctcaagattttttgtgttcatgtatacactactctatccatggttggatagtaaatggattcctcagcctcttctccttcctgctgaagtatacaaggtcggcttatttatcatgttccaatgactttacctaatgtagtccattatggaaatatgcctttacactgttactatcttctcatgtgacggcaactctgttgttaatcatgatgagtgaggggtaataagatctaatttgtttggtaggagtttgaatcttgttaagcgtaatatagtgctaagatgtaatgatggatgtgcagtattgcttacagctattttatccttttttatatataaattaatcattttctgttgatctttagtaatttcttgactaggcaagtagaaatgtagaattacataattgcaattctatttttatagctgagtgggaataaacatgatgtcaaacccatagtcgaagctaatgttgatagttcgctgtgacaggtgggtgttacacactacttttcatatttgaaagctagagaggaaatcggctatgtacctatggtgagcccgcgagaaggattggctgcaactatttcctactggcaggagaggaagagaaaagaactagatggcccaaccatatttccttggctgtttgtaacaattggcatgctggcattgttttctgctgcttaccttccacccgtcggtccattgaaatgggtgcttgacctccatttatttgttttccgatcaaagttggtgattcggttagtctttgtgatagcaactgcattgcacgttggtgaagctgtttatgcttggttcttggcaaagaagtatgacccgaggaatgctacaggttggttttggcaaacattcatgctcgggttcttttctcttcggtatctgcttaagagaatgagagagtagatttgtgctgttattcccttcactttgtcaggaaatcttcaacagtaatttctagctgaaatgcctcagcatatgcacttttaactgctgtggaacttcatttttctgagtcatatgtgacttctgtcagtcttgagaagcagagtgtgcagaacccatggtcttctatgatagtaggtattcagccatggttttcgatcttgcatgaagccaaaccacacagcacattgttagagttgcagcttgtaccattagcttagatggcatttgttttgggactggagagaacaattgaacataatggagttgaagttgtcattgttacaattggcatatgtttggaggctataccatactgtacctcctatgctttgaaactgaactataaatcaataattggaaagctgaacaaaagccagcttctcttgcctgtcagttacgtacatatacagcacaaaccctgtcttttgccaatgcagaactggagtactcttggattggtctttgttccttctctgcagctatctacctacctctgaactggaagtcccaagaactacaagcatattacagcctgatggcagagtgacgacaggtcagttaaactgcttccatgagaaaaatgagttgttgcaggcttgcagctgtgttgtgcccctccactcgtctgattcttctaccaacctcgcaaccaacctttgcccttcatttaataaaagccagtgtcggcggcgagaggaagcaaccgaatgaaaagaagaagaataggtgaggtgaggcccgagtgttattatcggagttggacttgtgaacgacttgtgaactgcatccgcgcaatccgtcgatttgtgtgtggctcgcgtgcttcttccagatcacatttcaggtcccttcggtttgactgtatgagatgatttttctgtccaatgaattggcgtatgagataatttttctgtcgattgattattcgggttgactgaatgggatgattgcacgttgccgcaaagaatatatggtgtaagtaaggtcaaagtcctctgatcttggaaagaattgggcagaaacatatcgtaggaacaaaacgtgacacacgcttgcatttgtgctgatgagaaatgtaggcatgcagtttcagtttttgcattgtactgatgagaatgatgtttgtgatggttgcaatggctggcatgtttgattgtttcctgcgtagaaaaggcagagtccaattgctgaaaaggccttgaaaagtctaggtgcaaccggaagatgacaaacagcttcggtaggaagagggagggagcaaatgtttcattggatgattccttcccccatgttctcatgtgatatatacccttttgcttttggtgacacggcagctgcctctcccgtttgtttgagtattagatgctaaccaaacacagaacaccctttcctttctgaaaattagtgataatcaaaaggctccagtgaaactagcaagaacaaatggaaacatttgcctccttatgaacactgaacacagttaaaaacaccgagcacaaaggtatatcacactgtgaccctccaagaagaatcagagtaggaagcttatgataaaaactgcgcaatgggatagacaaggactgaaaaccttcagtttcaggttttctaaaagacaatttaaggtatttcaatgtagattatgaagagcatcaatgctgtttgataatgtatcctangacacacactacatcattgagtgctctttcaccacattgggaagctttgcatcgatttggccagaatcaacccaacatattgc

SEQ ID NO: 60075 - DNA, 15830 bp, Oryza sativa
gtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgtgcgagcgtgagtggaggagaggaatgacgattctgttggtagttgtcgatgtggcctacttttttgttttgaggattaaattttgggaatctcttggagataaaaggtattctcataccttaaatcctttttagagatctaaaaaaaatgatttaggggattgaattttgggtggctgttggtgatgctcttaggcgtggcaaactgtggcaaagtgtggcttgcaaccaaacacacccatacagccgcaagttggacatagagggatatatagctcagagatccagtactgatgttaatttgtacggcgtacgtgcctctaaaattcgcaaagatcaatgtatcgaataataatgtaattaaccatatgatggagcgcacacgcaatatcaccgccagcaggcaagataggactatattcaatgtttcgattgctgtaaattactccattcgtactcgtaaaaaaagtcgtttagaacaatgtttaaatcaaaccctaagaatataaatcatgaataacttttaagttgttgagtttaaaaatataaaaattatatgaatagatttgtcttgaaaaatactttatgaaggtatacgtatatcacttttcaataaaatatttttatagaaacaagaagtcaaagttgtgttttggagaccgtatcgctgtccaaaacgacttcctttaggccattcccaacctaagacactagatatggtttccataaactccacatcatcaagaaactagtactccctccattccataatataaggcacaaccacttttcttacatgttccataatataaggcatgcatgcaaatatgcaattaactatggcatcttcttcattaaattataacttttttaaatcctccactctcatattatctaatcctattgaatgcatgcattatatttacgaggatgatccaaactacaagatgataataattacttcttggtctttgggttaagggtggttgtgccttatattttggaatggagggagtactagacactactcttccaatgcaaacaccactattctatacttaaatttaatgctacttatctcacatgatgtcttggatgttgtgtagaaactatgtctcatgcaagacatggtttccttctctttcctcatttattcacttgtcacatcatttttcatcataggtgacagtttatttaatgctatagacaccatcctagtcattgggttgggaatgcccttatattctgagcactgagggagtatattactactaatttaaaagcacaagaaataataactaattaatcaataagatcctcagaggcaatacatgcatgaatcttacttttgccttgtcgcagaatataaggtagctttgtgatatcgagaccgtattttattccatatctattaatttttatactatttaattcatatatcaacttttgtactactccctccacttccatggttataagacatggttataaagtcaaactacttcaaatttagttaagtttatacataaatataataatatttataatacctaattagtttcattaattcaataattgaatatattttcataataaatttgtgttgaattgaaaatattattattattttttacaaacttggtcaaatttgaagcagtttgactttgttaaaagtcaaaacatcttataacctgaaacggagggagtactgatttatttattcaattattatattaacttttataccatgacttgttatttagctattttcttatttcggagagcgtgcagtttttcctatgtgttcattgaactcaaataactatagctaatttagccatcttactccagtaccagataacactatgcctgcctctaaatagtcaaagtctgcacaccctactagagcatagtacaactgaatttgaatctactccatccattttatattataagactttctagcattgcccacgttcatatatatgttaatgaatctagatatagataatgctagaaagtcttataatatgaaacggaggaagtacgatatacgaagatatgaactaaagtcattgcttaggagtattgctatacgaccagaattaatcttagagaaaaccattctttacagcctgttttggcgcacaatggttaaagcaggcagcagccaattaagcaactacagctatatgcctagctagccgcaggcaccaagttaattaatcaatctgtacgtacagaatcaaaaagcctgtcatgatgtcgcttattagccagaaaagtacttaagcaatatacaaatctgtgaaaaggcgaaactcatagctttgtttcatctttttcttccacgtccgattcccttccgtacgcgcagatcagcgcgtgcatgcatgctgaaactgcagatcgtacgatccatatatatgcaaaaatacactaccgccggaaaagaacacacacgatctatttcgggaataactcactgcgttgaaaaggacagtgcatcagaataagttaacactaattaactcccagccacgcaaatttctaggctttagttttgattaattaaccacagaatccgatcgaatttgagcacagcaaaaaatgtacatcagcttagtagctagctgcagtcaagctaattaagctaattagctcgcgactggacaggggagcaagagaaccatgatatgattaaatattttctgcaccttaaccaatcatggccaagagataagctaagctagctaggcagcatccgatggccggccggctaattaagaattagtgcctgggcgaaaggctgattaaagctgcgtggatgcaagtggggaggagtgattagattagattaggggggcaggattaagataatccgagcggcgcgctgtctcatcgcgggcatgtgctagctccctcgcctgtcgcgttgcggcgccaagcgtctctcgatcgatcggtagctcgcttgtccgtgcatggcgccatggttaacctgatgatgataatgctaatcttttcgttgaagccgtctgactttagcacttgattgttaatgaccttattaagcagccagttgattactttatcggtcgggaagagacttgaaatgatatgagatatgcgcccagttgccacccgcggggaggtcgtaatctgcggtgacctaatctgggttagagacaggcaacctctcaattgtcacattaatttgtaagcacgtactcatttgtgcctcttttgtgtctcctgtcatttcgtataatttgcctggctcccaaagcttacagtattaattctctctatatataaagctggctcgatgattcaattctactacataaataattgtttgttcaggagtagtactagtacttactaatctttattcataagtaaaccttgggaaccctaactaatgatgaaatggcatcagaaaaagccatgcgtgaagtgtcacgccaaggatatgggacaggtgtcgaccctgggattcgcctacagtttttttctttttcagggggattcgtctactgttggctgcaccgcacaggctactgcaggaggaagagagagagagagagcgcacgtaacgccgcggggaatgggtcacgcgccacacgtgggcgacggccccgcgcggtggcgaggcgaattgggtggaggggacggggggccgagatatgtcacatcgaatttttgatacgggccggccgtggccgtgggccgcgcggccacgtgacgatgccggcggatgccgcgtcccggagcggcgttggccactgtggccgcgcgcgcgcgagcccgaggccggaggccaccatcatccgtccacccacccgtgccgtcgcgtcagctgctgatcgcggtctcgatcgccttggcgcggaacgctccgatgtcgtcgcgtgcgggattgtggcggcgtccgtgcctcacgcggacgtgatcgcgcattgggggtgtggtgtactggtggtggagcaaacttttcgcaaggattgtgtatttttgtgccgtgcgagggctggttgatcttgcactagcagttgcaggagatagtgctggacggtggaggactggaggaggaggaggtgaaggagaattgactgggtgctttatgggctgttttgggctacaaatctggcccaaagtctgttcatttcggtctcttgggccggagagaagacgggagaattgttggggtgctttatgggctgttttgggctacaaatctggcccgaagactgttcgttttctcttcaacagcgtggaaatttccgggattttgatccaatctgccttttctacttgtgtattgaaagcgactacacaagaacagaagttattatatgtgcacttgtagattcgaggtaggatttatttagctactaggagtaggattttggttaaagataaggagaatcattcaagatttcaagtggttctagtgcggcgtaggaaccagcatagcgcggcgaggatattcttcagcaacaacaatagaaagcaggcgtgattgaacacgagaattttcgcaccgaaatctgtgagctcaaggaatcacagcacatttggcttttgaaatctgtgtgcttatggaacgaaccggaccagtatattcgacttaccttataaatcaaagcaagtacctgacagcaacaggcacaccattgcgaaaaaataaaaagagaaggcgttctgatttgatccacactatcaacactcggtcacaggcaacaggcagtcaggcaagatgcaatacaggctacaaaattcagaactgagggacatggagggaacaaaaggcagaacgaacagtaaaatgaacatacacagtcaggttctctatgctgtaaacaaaaattactgagctgctatactgcacaaaagcataagttaacctgacctgctgctatccagaaaaaatggaaaaataagtttgattggttacagaagaatgaaaaaaaaaactgaagggtaaaattacagtcagaagctgcactataggttaatgcctcctcacacattatgctagtataatacaggttgagtttggaactaaagaatcgctctcttatcagcagtatgtacaagcccattgctcattcgcttctccacaagctcagggcaatccctgtctaaatatgtccagcatttgaatgatgcgaagggctgctcaagaagcagccttggcgacatccttacttgatcgattgtacatcatgtggctcttgacaaggtgaccagaggcaagagcggcaaggagcgagagctcgccagcgagcacgctgccagctactatggtagccaaacgtttagcatttgcaccaggtgagccatgatttgaacccttgacaccaagcaggttcaaacaagccgcctgtgaggccagacatgtaccacctccgattgtacctacctgagagaaaaaatgaaccattttactaacatgaagaaattaaataaataaaatcgatgcggatattgctctcacgatcaaactgcatgctaaaacaaaatattacttcagttaatacaagaagatctctatgctatagattttgcagctccatttaaggctagcaggttatgctataatctacataatgcaggtaggaacggaaagtaaaacgaataaataatcacctcaatggacggcatggtgacagagatatgaagatcatctccatcatttacttcttccaacatggtgatgcattgtgagctttcaacattttgtgcaggatcctgtcctgtagcaatgaataatgcagtaacaatattactcgcatgggcattaaaacccccaagagccccagctacagctgatccagcaagatttttgataatgttaagctcaacaagtttttctacagtcgtcttaagaactttctgcacaacatctcctttaataatagcctcacaaacaacagatttcccccggccttctatccagtttacagctgtcggcttcttgtctgagcaatagttacctgatgcacacagattaattcatcaatgtgcatgcaaagacaagaaaatacatggtgaattgatgaaaacagatagtgtgaacacccattgtttcaaaaaaagcacccccggcacaaatgcctaattgatacacgcaaatatattatcagagaatattagaccatgtttgatgcgagtctgatgaaaagtagtacattcactgttattcggtaatcagaatatattttacaattgaactaggctagtgcacaatgagcagaaaataaataaaaaggcatccaaaaatacttcttagggatgaaaaaaatccatcttataacctgctgaatcttctaagaaccgatatctgctttctgtaaatgaagccaagggtttcctctctagatcggaaaaatctaattagggacatgtttctttaagttacaaagcaataggagaggaaatattttgggtgctgatgaaatatgtttttcatcatttccttcgcaacatttccaaacagaagttaaagaatgtgattttttattcgttttctgctaaaaggaggcattgacttagagaggaaagcaaaactaactgaagcatgcaaagttcaaggggaagagttaaaaccagatacgctgatgacatccatgtcagggaagacattctgcagatagcccaagacattctcaacaccttttgacaccatgttcattcccatagcatctccagtgatacagctaaatctcatatataggttcctcccagcgagtgcacaacgaatgtcttgaagcctaccaaatctgctggacctacaccgattaaaacagtttttatgtcaattctaatagaagatgacctctatatggagttattggttctactaaggaagcgaaacaatagagcaaaaaagaaaaaaaaaggatgatgtaagaacgacttaggccctgttctattcttcaacttccttgttttccgttagcacgcttttcaaattgttaaatgatacatttttttaaaaaaagtttctatatagaagttgttttaaaaaagaaaataaatccatttttcaaatttataatagttaatacttaattaattatgtgctaatgagctttctcgttttacgtgcaaccaaaatttatctccaaatgtggagattaaatggggccttagataagcaagctgcgtgattgtctcaaatgaaaatttccacaataaagtatacattttttagataatggatatcattccggcctctacactccacaagagtgtacacagccaacaataaagtatgcatgaaatttactaaattagaacttatatagggcacagaggaggataacaatcagataagttgtacaaacagattgattctcacagtataatggatcttcaaacaatagtaccaaatcaacactgtatagcaaccatattgtgtgacatttgccacatcaaaaactaagactgaaacatatgcaatccgaaatgcagaggttgaaagaacaatgtcaatggcaaactcacacttagctccggaaaagtccctggagaatacactatgcaaaaaggtatccatggaaccatgacacttgcccatatatgcaacccatagagttgcgtcggtattgggtagatggttctagctgccaagaacaactataaaacattgtacagtttaaaagatcagaaatcaaataagatgtatagacacctttgactttgactggtagaataatatgccgatatgtacagtgtctgaataactggatacgaaaaatcaaagaaaaatatgaatatgaaaaatctgcacaacaaagttgtggaaatcacagaagtggcttgtgtggtaaaatagcacaagtgaggatattaggaaagtatactaaatgcagcatacctaggaactaactgttggacctatttggaactttgaaacacacggccacaattttttaaagagattcaataaaaacctccatattttctcagtactctcaaatgacagaaaacaatgtaagaaaagatacattaattagaaacatgaaaaccaacaataacttattggaacacaagcctactgttatctaaagtgtacttaatgacagtaaccaaagcttttgaacatgagcctacaattacgtaaaggttccagacaacaaaataaaacaaaacaacatatcgtacatttaaaaaaaaagagagagacaatagatcctctaaggatactgactacagagcgacagttactagtcagtaacacagaaaaactccaaaagacaaatgacattaatctgaaaattctaacaccgtaaactgtcagtagatgtgtgtaccctgagtccctgaacatctgaaggtgcaaagatacacactagaggttgagatcttaaatccacatattctcaagtttggagagcacaaaccaatgattcattcacattcggtattatttaagcgaacataaaaaggcaattcaaggtgaacacttcagaaaggtattatctatgagctggcattatctgcatttagctggtagctcttagaacaagtaaacatagtattgataatgcattgtccagtacctccagtgcatgtgctagcttacacactgtgggctctaccctgtcagcaatcacatgatagaagggctttccgttgtgggaaatcacctggtcttaaaataccattcagtgctagctatcaacatcagtccattactcaaacataagacgacaaccttaagatacactgaaagatcacatttttcccccattaattaacactgtgcctgcctattgtcgcgcaaagtcttataacactttgagcaagcacacaaatcaacaaactagattagtggatgatgtggagtgtacctattgaagacagcagccagcaactcaaaattcgcaggcgcctcagcaaacgccttgagctccgctgcccgcattgcggaaggcagcttgacagcaggagcgcgggacatggcgtcccggagcagaacgctgaaggcgccgccggaagcggagatggccctgcacccgcggttgacgctggcgacgaggcatccctcggtggtagccatggggacatggtactcgcggccgtccaggagcagcgggccggcgacccccacggggagctgcacgtacccgacgggcatctcgcagcattgccccaggatggcctggtagtccatcccatcgaaggggaggccctccactccccgccccgtcacccgccgcagcgcctcccgcctcagcctcgccgcgcggcggcagtccccgagccgcgactccaggcggtgcgacggcagcgcgccggacgccaccgcggcgacgatctcctcgtcgtcggcctccatcatcccgccaccatgcccatgcattggcgcgggctccgcggcggcggggcgcgcgcggcgggagcccccctggccgtcgtcgtcgtcgccggtggtggtggcgggggcgtcagggtgggcgaagaggctgacgaggtagacgacggtggcgaactcccggccgccgaggggccgctccctgtcgctgcagaggcggagcaggtcgcaggaggagagcacgagggagaccatggccaggccgttggtgatccgcatcgggaggggcagcgccccccaggtgagcgccctccgcgccgccccgacgatgcgccctccgcccccgccccggcgcacgtccatccgcctccttggcccaggatcactggagacagagagagagacacaacccaacccaaggcgatcgcgaacgacgcggacctcgcctcccccctccggctgtgcgtgtgcgtgtttgctcggtacgcgatcggagggggggatcggacggacgggagggtgtgatggtggtgtacacggaaggcgcagcgagagagaggggaggtgaccgcgggattgtctctctcgctcgcctcgggcgttcagatgttcggcgtgacaggacaggacagggggatctaagcggcaagccgcaagcagaggcgtgggcgggggagggggaacggcacggggcccgcgcgcggatgggcggcgggttctttcttttcttccaagcagaagaccgggaggagacaggagaggctcggggttttccacgtccgatgctgtttgcaaattgcaaatctgctcttttgtcagcagtgtgagtcatccgtcatcgatggagctcagcgagaaatgtgtttttttttcttcttctctcttttatgcagtcgatcgtttggaaaagtgtgaacgagaagcactctctactcggtaatctatgatgaaatgtgtggttgatgtgatgaactcgctcgagcatgggaatggtgtgcgagattttggtctcagtcactgctcaccttggaaatattttacatcctgactaggcagttatgtttgggttcagagactaaatcttagtacctgtcacatcggatccgatgtttgacactaatttagattattaaacatatactacttacaaaactaattatataaatgagagctaattcgcgtgacaaattttttagcctaattaattcataattatcacatgtttactgtaacatcacatagactaatcatggattaattaggcttaatagattcgtctcgctaattagtttagagttatggaatggattttgtcaataatctacgtttaatacatctaattagtgtccaacatctgatgtgacatggttccatccaaacccccagttcggtacatttggttcccaacacctctctctcatattccgcgcatatgcttttcaaactgttaaatggtattttttttcaaaaagtttctatacaaaagctgcttaaaaaatcatattgattcatttttgaaggaaaaaactaatacttaactaatcacgcgctaatggaccgctctatttttcgtgcgcaacatatatgttcccagcagtgagtgccgaacacagaatctttatcataaggcacatagttaaaacaaatattcacttcgtccaaaataaattaatttagtatgagaagttatatatctacgaatcatatattttgagacaggtggagtacagtatatgatctattccctaaaatttttttgatcaaattcgtatgagattatttcatacgttcacaggacttttactgatcacacaatataatggtggtcataaaactttctaaagtaattttgaatttctcttatgaataaagataaagaattaagaagtacatgtttcacgacaattgttgtgtgttactattatactacattagatgtttttagaagtgttaagtgcatactttaggtcttctatataacttctacttttagctcttttttcgtaaaaagggtgcgacaacttagtgagtaaaataggatatgctacggataagatcaaatgagtaacttttagccctaagttttttcatgtcattcttcggacaaaatgattcatttataggaaaagctaccatatttactgtagcagccatactatcatgtatcaagatggatgtatggaacgtactctatatatgctacggataagataaaatgagtaatttttagccctaactttttttcatgtcattctacggataagataatttatctataggaaaagctatgtttactgcagcaaccacactatcatgtataaagatatattgaatgtactatatctatccacgattataaaaattcatctaagtgtatagttagaaatccctatatttatggaaaatgtggtagtaatttatcttagcataacaccacttcaacatctcaattccactttagtatggagatgttttctccttcgcatagagatagttaattaatccttaaaaacacctttctcatgacttggtaagtcaaagaaatagctagtaagttacatgttatatatactctaatatacatgtttgtaattaattttgttagaattataaatacaacctcatcagaatatccttgaaccaaaaattaaagaaaaatgacacatcacatccattgaatccaaatagaagaggcatgtagctcttcaacttgttttatataaaatcaattgcttacatgctaactgagatcatatgaacagtataaaaacgcgaaaaacatgcaacgaacttttaaaattatattatcataccgtgatgcaacgcaatgccaatctactcaaacatgtccgaatccaacttaccttatatcgaccaaaacttacgacaagtagcaaatttgctcatcatccacgaacacttcgattccaaattcgtttctaatatttcgaagcgcccgcaatttcgctgtcaaccgcgtgatccatttgaaaaacccaaacagctctctccctcttacactgtcacacacactggcttcttcgctggcaaacgaacgtgacttgggttcccgtagcagaagaaggcgcgccaacccaaccgtcggccccagtcacaatcccccctttcccctcctccgccgactcgcccaccttttcccccttccaaaatcccaccgccgattcgctcccactcgcgaaccctctccaatcccaaggtcggagagggggacagcgaagctagcccacccgcaccaccgatcctcgaagggattccagccgatcgctgcgtagctcgccggatggcgcagcagcagcagcagcaggggtcggggtcggggtcggcgtcggcgtcgagctccagctcggggctgcacctgctggcgtcgccgttcggggacaccacctacaccaaggtgttcgtgggcgggctcgcgtgggagaccaccagcgagaggctccgccgcttctacgaccgcttcggggagatcctcgaggccgtcgtcatcaccgaccgccactccggccgctccaagggctacggcttcgtcagtgccttcgatttttcgccgctgttgatcctgctttttccgggtgtttgtttgtttgttcgtggaattgctggctgtaaacagtggttggcttatacaagtgtcatgttgaccttgtgcaggtgacgttccgcgatcctgagtcggcgaggaaggcatgcgaggacccgacgccggtgatcgacggcaggcgtgccaattgtaacctggcgtcgcttggccgcgctcagcctgcagttcctctcggtattgatctccctgccttgacactgatttgcactaacttattcgagtagattatgagcacattttgataccaccgtgaggatttgcttgctagcaagttactgcagtggtatctgtggtatgattgtgttgccttctgcaaacttatttgatcggttctacattgtgtttgctctagaatttagttacccgcactcgtcctcctagaataagacaactatggaaagaagaaaaattgataatcaagtgaacataggtacagtcaactatataccttctcaagtgggtttgggacttaaaataacaccacaggtgagctaaaatgatactgagcattcatttgaacagaagtactgatgatgttggtgtttggcatgtgcttgttttgttttgcaaacaaaaaactacaaattacagtatgccacccctaatggtgatacgatgactactaatataccattttggtaccttaaacagttcttggaagtgctcatgcggtgataatagttctatttctgtaagcatttgttctgaatacatgcacaatcttttcagggaggccaagatcagctgggtcctactttggcgttccagttccaaggggtgtttatgtagggggttatggtcagcaccggacacttcctcttgggtattaccaaggattcccggttccgcaatacaggtatgatgtgttaacttttccaatgcagcttcctgctcttagatggcccatttgtgacaatcttcaagtagttcttacttaggcgtccacatttggcatataatttgtggcaatctactttgtgtagattgtgcatagcctgcatcctattttttttctgctcctcttcgaaaattgccaaataaatatgttcattttcttcgtggaacataatatcgctgttttggaagtcaataaagtgtgttcggtcattcattttcctccttttgcagctacactacatatgggacagaatacatctatccacaggttgaagtgtgaaaaatattacgtttaattttccttgcgcaacataagggttttacaaagcatcgactgattctgatgagagatctctttgtagggtacattaaacccatatgttggtcagcaatatgttccaatttatggagtttcatccgcagcaaatactgctagccaaccatttagccagttcagcccgtccatttctggtgggggtaatggttatgtggctattcatggttacaatgtgccaggaaatccatttgtacagttaactggatcaaactttagcagtgcatcgcctacacctcggcccaccattcaggccccctttttagttggtaatgtggtcttctttgcctattttttttagtatttagtgattcctcttgtctttccagaaaacacaatactgtgttatgctatatgttctcacaccaaatttaccaggctaacatggatgctatcgttcattcgtcaccctgcatctttttatagtgtctgcttaagtgttctccttttgtgaataacttcatattacttggcctttgtagcagcaccggttcctactcacccgcacttggtcctcccagctcactcacctcagtttacacaggctagtggttcagaccaaagagcaagctgaactatgctgccaaacatttgtaccttgaggtttgttctgtctggactgctgttatcttttcttgtgattatctggtagtaactgttctttttctgtccctaataggtacccttagattgcagcaggacaaaagagcagtgctgctgtatttgtagtactggttcttacctggcaagtaatcccccttgcattcataaggtaccaattatgctgtactgagaagccatgcttacattcatagaatgccaatcttactcttatgggaaattagtccatcaatattctgcccttcagaagttcagatgcatttagtttcagaacaaaatgatggagttacctattggttctaacttgtcagaactcaaaagggacaaactttgatgttaatatgcttgtgttttgtctcttattctcattgttgtactccttaatctcgttatgttttttaggatctcctattatgctccaatagtattgcattcgatactgggtgatgctttcccataattaacttgaaaccaaaccaggaaattcattcttaacgttgatgttagattagttttgcatctaacagaagataagtacattgatggcatcatggcgttcatcattactctgaacatacagactaaacagccaactgaatcttaatcaatctgtttgcttg

SEQ ID NO: 60076 - DNA, 7794 bp, Oryza sativa
ttcctgcagcccgttcacctaaactcctgaagaatcatcaagctactatgtggttgattatatcccagtgttgaagtctggcacaagtccaacaaatgtagcccgtcccgtcagtcttgtgtctgtctatggtcatcgtcgtgatctatgcttgatcggcctttggaggtataaatagttattgcgtccgcttcactcatcatgtccaaaatgttggaccaagatggtccttcctcctgtatctgtaacccaagtgtctaccggaactgctcagggtcgttactcgttaccaactggtagcgaggtcacgaggactatcttctatggtgttactggtatcggtatcagaactaccgtctattgtgttactggtatcggtatcagaactgttgttatgtgtttaatttttcattgctatgtgctcagcagttcctcgacttccgagaacggcactttgttgtccgaccaaaataaatcagttcggatgagaaacccatgctttggggtcttatcggtgttgtgtaagcctggattggtaaaacttgtactatttgtacaaattgttttgctgttttgcagtgatgtgtattatgtgaaattgtttcaaaaattgggtgttttctgtgtgacgacaatgctctctgttcgattagcggtatcagtcttgatcgttaaaacttgtacaaagtgttctgcggtttggcagtcttgtgtattatgtgaaatattgtttcagaaattgtgttttctgtatgacgacaagtcgacaatgctctctgcccgagtcagcgatattgttcaagtctaggttgttaaaaactttactatttgaactgatttatctgcggtttcgctgtctttattttgtgaaatattgttacagaaaattgagtgttttctgtatgacgacacaatgctctcagctcgagttagctgctgctgccaatgcactaacttggagctttggaagtacaccaggtctgtgaatatgaaccctgagatttccccttctgtgcacgattcaatcactggtgctgataatgatgtgagagaatcgtgagtaataaacaaatgtacacatttactttacatacaatgcattctattctgccaaagccaaaccaccagaggataattcgtcagtcaatacgttgccttactgaactgctgttgggaatgtggcgaatcatgtctgaagctactgaattctgattctggctcttgaactgaacacactccagcttcagtgctacgagggattgaattgatggcctaacagcataaccattttattccgtaaatccagatcattagagcttactgctggaacttacagaagccatcatagaactcttaaatggaggttgggatatccagctttagtcttgtacttctcgaacagttcttgtagtgcgacaacaaattgttcatggacttcatttatctgccacatcagggaattacccaattttaattgtaagaatatatacatttttatttttttaccattcaaaaacaattaaaacaaaaaagatcctactttccatggtaatatttatcttagaacatcatttaatttcagttttttagtgtgcagactgatcaaaaggtgtacttggcataatgtcaagatgatatttcacctcatcaaaggtaggctgagcatttttcttaacctcaattggtcttccaacaaccacgtgcatgggtgtcgcaaacggaatgggagtcctgcatcacaatgtgcaaggacatatgaactcttgaccaaataaaaaatattgaaaaaatatatataaactgcagaaagttacccaaattttccccagaacataattggagtaaatttaattgctctagcaattttgacaattaatttgccacctggtctccaccacttataaacatagctctagtcaaagtagtgccaaaaaaaaatcagcaaactgaataccatgaataaatttactatatggataaggaattttgcatttatgaacttattgggtgcaagagtagattacctgtccgaaagcgaaaacagggactaaaggggaacctgtttccatagctatcttaacgaaaccttttcttgatttaagaaaagcaacctgtcatttgcaaaaattaaccatcactattccggtaaaagatgtaagtatttcacttggttttgcacaagaaagaaggcaatgtctttattgataataaaagaagaaatccgcagttacctctgaatcatgatccatgtgaagcatctcctgcacccctcctggcactatgacgcagctataaccagctttaaggtaggagtagaaattcttcctggatgcaggaaccaaccccaaccatgtccatatttgcctcaagaatggggtatagaacacctaacaccgaccaattcaccagtaaagagcatatctttatttagaaaatggattaaaacctggcctctatatccagatggatgttcgcagccacaataaatagcatatgtagtaatagagtgtcgaaagatcaaactcttaagaatgtactcctaggaaggaaatctgggaagtgggaacctcaccgcactgcttgcaagaacctttatctttggtaatggcatgaatccaacaagctccaaaaggaccccaagggcaatgggcaaaacagaatgcggctcataaccaaacactgcaagcacagcacaatataatcaccaacccagtggacagtgccctctatataaaagactccatacttttctatatattactactcctttacttagcttttagaaataggccaaaagggtttgatactttaaagattaaaaagattcaagtatcacaatatcatctttagtagttgtttctgtttagctttaggaatcaactgaaaagcctcggtatcaatcatcaatgtgattcaagaattaatcaagattccagagatggaatgagataaagaggaagctcaccgtaagctctattgggatcaaaagccttgtagtcctcgacatgtaatgtgacggggaagtacccaatcacgcacttgctgatgaacctgaggatgcgtcgtcctccaaaatgtaagatccaacaatgcggtcaggtaaaaaaacgttggcagccgaggaaatcgaggagacgaacctggcgatcttgcgccccaacctgctcatatcattgaccggcgcgaacatgaagaagagctgcgtggcgagcaccctggataatacagcgcggagaggcgagagtgagacccaagtacccaacccgtcaacggcgagcagagcgcgaggtagggaaaagaagctggaggagagatttgggtaagaggttacatggcggcgacgcggcgggggaagaggaagagcgaggcgaggaggaggaaggcgttgaagtggatggcccccagccacagcgccagcgcaaccgtggtgcgcaccggcggctgcgccgtcccccggaacaccgtggtcccgtcgtccgccatcaccgccgcctcgccggcgccggcaccgccgccgccgtaccgcacttcaccattccccgcccccatccgccgccgccgctggcgacgagagagacgtcgcgtctcgcgtcgagggatgcttctagtattgtccgcctctctctcgcgtcgcgggcgatttcgatgcgtcgtcgcgtcgtctccgctgtggctcgcgggcttgacctgtcagtgccccacgctgccaacttatagccggcgcggctgacaggtgggccatcccttggaataagggagatgagatggagtagatgggatggttgtgctgtgcgtgcgcccgacgacgaacccgttcgtgcggatcagcgcgaatcggcgaggtaagctggacgcagggttttcggaataagtttgccgataaattttagtaccaaaatgattgcgttttgattaattttattttttattttggattcgaacggctggctaaccgagtgatttctcagtgcaaaccgggaccggctgttgctgttgctgttgctgtgattaccgtgatttatctcgctgttgctgttgccgctattgattagctcagcagctgactcgcaagatgcggacatgactagacgggatcgtgtttttttaaaagaaacgggatcggatcaggaaagcgacccgcggtgttcttttgtgttggaaatgaaaatattgttggaaatgaaaataaaaatgaaaattaaatattttacgttaaataagatggtattaatgtataattaaaaaatatttatctaatattttagaataactttcgtaagaaatatattgtttggtagtttaaaaaatatgtcacaatgataaaaattttcatccactactcgtagcagaaaaaaaggggcgtcccacgcccgtactcagaccggctggttttgcagcattcggcggcgtcacaactcacatatgaaggtctgaactttgcggttaccgagtacgcagccaacggtgacgtcactgtgactgcgggacgccctgtgatttatggccgagtttagtttctaacttttttaaaaaatttctaatttttttatcacatcaaaactttcctacacacataaacttctaacttttttttcaaactttaaattttaacgtgaaactaaacacaacctatgccaatatgccatgtagcggctactgtagcaatcgataccgtgcaatgctgtcgcattgattgctcggctagatcagatggctgtggccggcacatgcatggatggccggctaggggaggaatgcagattttctcgcacaaaggtccacacaactgtctcgtaaaaatggatcatgggcaaacagatggtagatttgtagtaccacttgtactaaatctaggcgtccagcgcgcaatgctgttcgattgggtaaatttaagcctttagaattgcaggttatatatgatcatagccagggttaggtggggaaaaaaaactgtcacaaccaacaagctgttaaaccgtgttaaactccccccggtttgaagaacttcaagaattccacccatcgaaaatgacctatacctaatccttctatgggtattaacgccaatgattgttgtacacttgcacgtaggatgtctgtactagagctatgacggtactttaataaataggagtattatggaaatatgggcagtccttccggctgcacgctgcgaactaaagtactaaacttcctgaatgctcgtcacacaaatgaggaaaaggacttgtggagttcagaaggtagcaagagtgtgacacagtaatactattatgttcagctggactgcctggacctggacacaataatactatgttcagctggctgatggaagggaattcttgaagattcaaccaagaggaagaaaaatgggtaaaaacagagcgggcttgtttggtttagtaccctaccaatatattgttagtgccaaactctaggcaagttaaatgagtgtctttggattgatgccaattgagagccaaattttaaattgtggtgaagaacattctagaattgtgctaaattgagtataggcattaccaaatatttggctttaaaccaaatcatcacatttactatttaaactaccaaaacattggtatggcaatattttgatatcaaaccaaaacggcgcagctttaccaacaagaacctcatcttggaacaaaaattaatatttcgttaattcggttcaaaggttcaaaactgagtgacaggtcctctcctttccctcaacaatttgatgggctaaccagcgtgggtttgaggacttactcattttatttatttgataggaaaaaatgatattaggtaattttttaatatttgcatttttaacctgctctatgttttaccattccaaggattatcaaatggtcatttgccaacgtatctcgagaacagtagggattcgccatcgggaaagaaaataacgtttctccaacaaaaaagaattggcctgttcggtagctctaattggcagccagctgctacagtgaaatttatagaagatcaatggtagcagctgcacagccgctgtatagggctgccgaacagacccaatactatcggttatcagcgatcagggactctagaaatttcctttttggcctttcggcttacgcagcgaatggggtcccggccaaaccttgcggccggagctttgcctcctgatcctccacaccagcgctcttccgatccacgcagttggcctcacgagttatgtaccatcagccattactcctccagtgcaaccctctcgaaggagggaagaaaaacacaaactgtaattttttgcctaccaaaatttggtttatttaagaacatcgctgtctgaacaattattattccagtccaaccaaacacatcaatagcagactcacgctaccggctcaaaaatggcaaaactctccaaagaaaaaacacgaaaaagaaagccgtggggttgcaacatcactgtttctaaccccacatgtcagatgacacaagcgaatgtggatttagtaatccatttgactcagagtggggttccctggccagtggaagacagatgtcatgatcgccaatgtctcggtcacagatgacatagcgctcagcgctgccttgagaacatcctgcgagcacccacgcttcacgatgcttttcacctgcgcagcaacaacagttagaatagacaccaacatgtgccatttgtccacaggaattcagattgttcgatacgaagatcgatcaattattgggattatggaaagtaccttctccaagtattcctggagtttcttgatcctgcccatatagtcttgatcttccacgcacagtgaaataggctttgaatcagcacctgctccttcgaattggagtggtcctgggtttctgtagatgtcgtcgattaagaagctggtagaattgttcctcaatagcctgtaaacacaagtttgttattgtcaatgagattatgcatcttctttagaccaatgacagcaactgtacagcgatcgaatataagatgggattaatagattgtgtacacacttactcgaatgctttgcctttcaagtcgacagtagccatatggacagcaggtttccctatttgagtagccgcaggaccacgtgaccatctcttcacggtcatcatagactaaagggaaaagaattgtgggttaggtgttcccttcattcatatcatactcatctaattttgccaaaagggggtgcacagtagtaatctcaccgaaatcggagccgcaccacatcgccatttgttcgcaggactcttaagatttgtcacagtagccatgtaaccattcaaaccagcagctaagatgtggtagcacacgtgcccaagaacctgaagccaaacaacatacatataattaatcaacagcaaaataaaattgctttgtccaagtagaaaggtgagctgaaacttgcataggcgtaatcgcagtcaaactttgaaggcagtgaacccctagcttggtagccaaaaaagtgacagatcgcattgaatttctttcctttgtaagtgccttccttctgcagagataccaagaacatcatgagccaatataaatattactcactccacatgtagactgagacatcagtaatgcctcagaaccaagagacagttacaagaaaggctgcagaaagcataccatacgcctgttcatttcatcctcaactaattgggccaaaagtttttcggtttcaatctgcaccggtaaccatgtggaggttgtaatcagacataatgaaatgaaacaaaaaaagcatacgcaaatgactgaag

SEQ ID NO: 60077 - DNA, 1302 bp, Oryza sativa
aggaatcacaattttgtggcagccacctacaatccacaagctggcctccaaaagattttccatcagccaaatgaaaacgggtgaagaagcatcattgaggcatgacgagtcatagagcatgcgaatatccacgcacaaactgcaagtatataattaacaaaaaaaaactaaattgatgaaaacgaacaaaaagatcagaacaagatgtcctgacatattgtgatgcactagaaacttacgtaaccactgtctatctgttagcttgcgccttcatcttttatgtgcattgctaagggcttttctcttttttcgaagctctgatagactgacgctatcaacgtgtggttttactcttttttgaagctccggcactagtatcaactggtggcttccttttctctaataaaacattcttttggtccataaaaggctgcaaaatgtccttgattgcctacacaaaaaccaagagattgtaaataagagaaatttgtgatgttattgattgcaaaagatttcaaaatactgcaccttgctttttatctgtgtttgaatcttctgaacatgttgtataatagattgcaccttataggcccggacagcacctctattgtcgaagcagatcccaaccaaaagaccatcaacagtaaagacaggggacccaaatgaggcacaaggaagtagcacaatcatgagtaaaatccgcctttcttacaaacctaattaaacatttcataagagcctataaatataatttaatcatttaataggactaattaagcatttcataagaaccaacaaatctaatataatcatttaatactccctccgtttcacaatgtaagtcattctagcatttcccacattcatattgatgttaatgaaacagaggaagtaagacagatgaaattagataaaaataaggattttagctcaccggaccgatccaggagataaaaggtacttttggattctgatatcccaaggtgtaaacatcctcattaatcaacggtccagattcacagattttcacagcagctaatggattagtgcattttggtttgcttagcatgaaagagacaactatcagcaattgatacatcggtaaagttaatcgccacactctccatgttcaagccaggaaaaacagcagcatagagcccttcagaaccataacaaaatgtccccttgtctgttatgacgtagcatgatagcttcttcttcgcaataactattcctggagcaaataaagtcggttttcctgcactcatagctattatcctaacgaaacacatttgaaccttg

SEQ ID NO: 60078 - DNA, 9792 bp, Oryza sativa
ccccctaccccgggcccgaccccgctcgggagagggccacgtgggcactaggggcagcctccttcctctagttttgataccctcgggcaaggaggggcagctgtcactccaccccgggcccgaccctcctcggggaagtgctacgtgggtttaggggcggcctcctccctccaaacatgatacccccgggcctatatcatcgacataattgattatgctaaagagcacgttttattctattgacatgacgaccacatcctcgaccgccacaacatgggcccatcaaatcgagccgctagacacgagggagcattgtgtcattcgccaattaatggatgaagactcttaattgggctcctgtttacaccgggaaacaggaggtcggctttagaccagagcagatgaaccagctctgggcggatctaggggctagaaaaaaaaaccccaccatcacgatgtgatgaggcggggtaacttgccgccgcctgtcacctgttcattgactgggcggggcaaaccgtctgccgcatgtcactttgtcagtggctaggcatggcaagccacacgcacatcggctgccatatggggcccaccacatcaggccggctgacatgggggacgcctgcgtcattcatcatttaatggatggggacttagagtgcaggcttgcaccgggaatacaaactcgggcctggccacaccgatgggatgagtggctaagagcccctcatcattacgatggaacggggcataacccgctgcacgccgcctgacatgcggtcagggcatgagcgctctgcagtcgtcccatccatcattcggccggtcatggaccggtcactgaccagtcacaggccggtctggcgctcggcacggcgtggaacgcccgctgcaactgccttaaatgcggttaggtggacgctgtgaggcacccacctaaccatatacacgtggcggctcgacccctcgggcttggaggggatggccgccgcccatccttgggcccgaccccctgggaggagtgccacgtggacactgggggcagcctcttccctccaatctttgtacaccctggcccatatcaccgatagtggtggccatacctgggtgaccatgtcatcaccctctccctctctctcccctcttctctcctttcctcctcctccttcccctctctctctctctctctctctttctcttctaccctcgtctaggtgggccggccagccagcgggttcgaaggaggccggctgaaagggtcaattaggcctagaggggggtgaataggctaatttaaaactttatgcggaagctaaaactgaaataaggtcggaaagtctgatccacagtcagactatccaaaaatatcagatagtctgatgttggatcagactgtctgatccaccaatgaagcacaacaagtagatctatcacacagacaagagtaaagcacaaacagcaactagatctatagtggcacaattaagcaaagctaaaaggaggatgaagggagatcaccaatgatgaagttcacgaagttgttcccggagttcaaatccttgaggggattctactctccgttgaggagctcactaagagccgggtctttgctaaccctttcctcaagaggttgcactaagcactcctccttccactaaggggtatctctttccttgcggaggcgagatccggccttcacaaacttctcccggccaaccacacatagatcggtggctcgggagtgacacctagccgtctaggagtcctcaacctccaagagtaacaaacaccacacaactcttggtcaaaccctagtgctcaatatcgagtgaaacacacactaggccctcaaacaccaaatccacaaccaccaagatccaccacacaaagaacaaggagggatttgagagagggagaaagagctcaaagatccaaagcaccttagcaccaagttcaacccaaagtgaatgagaatgaaatgagttgggtaaccctagaaaagggttaggtggggggtatttatagacccccccccccaaaaaaaatgtggtcgttggagaggaatctttcagcccacgtcggatagtccgatacaagatcggatagtccgatattttaaacctccaaggcaacgagaaacagagaacgaagttccatgaaatttcggactttccgagacatcagactaactgatgttaaatcggagtatctgatattttagaagcaaaaacttcgtcctcaaacagagactcaagttctatgaaatttcggagtctctgtatcatcagactatctgatccgacatcggatactccgatacttagaaaaactcactcgataggattttttcaaatcaagacagagagtgaagttctgtgaaaaatcggatagtctgatttcaaatcggatagtctgatgttgatcaagtaaaactacaataactttttactccgaactccgatttcgaagatcttggactctatgaaaagctagtttcgtgggtcaaacccaacataaaacatggtccaaaaccttcaagagatgttgaaaaacttgcaaagaaacccggtgtaagtgttgtgacaagtgaaacaactcgggattgaaatttttacttaggtttttcaactcacacaaagatgaagcattttgagcactagtattctaccaataatatgcatgtggtatcgctcttaatagtacgacattcctacgacacaatgtaaggtaaaagatacaatataccatttgatcattgccgcattgcatcgtgatgtcgcattcatggggtatgcatctcattacaacatgtcgaggacataacaaccttcacatttgcttgaataaaagtgttagtcctctctaatcgcattgtaatcaatcatcaaaatcattaggggcctagatgcactttcaccggcaacgggtgatgcggtgggcggccttgttggtgcagtctaggagttgatgaccacacgtgccacctcctccgcctccacctccacagtgcacacctcccacaccatccttctcgccaggaatccccttgctgccgcccacctcctcgacgacgcccaccaccaatcctcacgccctcgtcgtcgccaccggctcgagacctacgacatcgtcgtcgaggccacgcgccgcctacaaccgtgtcatgttccagctccgctgatccaaggccatcctcaacttccccaacgaggtcacagccgactcaaattcctacatgaaattttctttgaatgcttgtctataacttttctaactttgtactagtgaaattcatttgtttataaccctcagtagctattaaaaaactaaacaattagctatctcaaacggagcctcaatattcaaatataaggaatattaggttctaccaatatctgttctgaacatactaacatatacttcctccgttccacaatataagatattttggcatcttcatacctcgtctaaattcaccaacatctatataaattaggacgcgtatatgaaatacatatatggatccatgcatctatttaaaacccaaaacgtcttatagtgtgaaataaaagatatcatataaattcaccaacattcatatgaatttggacatgtatataaagacacatacatggatacatgcataactatttaaaactcaaaacgtcttatggtgtgaaatagaggaagtataaatttaaaatataggtgtatatatttggcatatcctttttatttgtgctataatatattattagtctgtttgttaaaactctaattcctaaatttaacttcacttgctttagagtggagttgtgaagcggctcgaaccccactcagtttacctctctagtccattttatgatagctcttcagtatgttccgctccctttttaggtgaagctatagttctgccaacaagctctctatctagtactactggttctattatagttattggttaagtactctctccgtcctagaaaaaataaatctaggattggatgtgacacatcctaatacaacgaatctaaacagatatatgttcagattcatagtagtaggatgtgtcatatctaatactagatcggttttttcttggacggagggagtaatgccttccatgtgcatcctagccattcagttctctaggcaaataattagccctccgaaatcttgctatttagaagtatttaataaagtctatgtacagaactacttgttgaacccctgggctaattcgcaagacgaatctaaagaggtatattaattcataattagcggatgattactgtagtatcactgtagtaaatcatggattaattaggcttattagattcgtctcctaaattagcttacgggttatggaatgggttttgttagttatctacgtttaatacttctaaatagtaagattctggagggctaataattagccctccggatccaaagaggccctagttgattatgctcccttcaagagccagaccctcgctttcccctatagatggccatgaggcccgctcggcacggcccggcctaggcacgactaggcacggcccaccagccatcgggccggcacggcccgatcggccgcacctccggcctaggcacaacccaccagtagtcgggccgtgccgtgccagcccgaaggcacgggtggcccatcgtgcctttttttaaataagtctattctccctccctcctctttgggctgtgacatactccctccctcctctttgggctgacatatatatagctaaaataagtctattttatgtccctattctttggaccgtggcatataatatgtctatttttactccctttcattgtgtgttgggcctggctaccggcccaacgtgccggaggaggggcccaggcacggcccggcggtcgggccggaccggcacgggccctaccccgtcgggccgtgccgtgcttaggccaggccaaaatgtcgtgtcgtgggccggaccgtcgagcctcggaccttttcgccatctatactttccgctttcaagctacagctctatcgtcgcttgttcggccccttttcctcctttcctccgatgattcgtcgtcggcggagagagggagaggggtccggtccttccccctagtattaggttagtttagtcgggtttttcctgtttagtcggggttctcccgttgtgtagttggttttttgagtccggagcaagatgaacacagctggagctagctctggagtttgttctcagggtcttctagtcatcactcgggatccctccagatctgcgagttcacaggtagcgtcgaccaactttcatttcttcgacgaatttcttcctcggctggttctcctctgctacttctccagcgaaggatttttttttctccaaggcgtttgatatttccaagtctagccgagatggtctcaatctcctataaatcgggtatgcctctcagttttctttgcaaactgctacgttctctctctaatcctcgccagtggaatagttatagggttcatccttggaatttttgtctgcaagccaactttcgccagtggaagtggaatagttatagggttcatcctgccagtggaatagttatagggttcatccttggaatttttgtctgcaagccaactttcgccagtggaatagttatagggttcatcctgccagtggaatagttatagggttcatccttgaaatttttgtctgcaagccaactttctttcactgatccggatccggatccggcgaatttcttatatgttgttgctgatattattatgtgaattccaacatccaaacctcctttgcaaggccccgtttgggacagcatgttggttcaatctcctgcagcgcatcctccaccgtcagagtcaagtttctggatttcgtcgttggggttgaaggcaaaaaagggggaaaggactccattgctttttgctatttttaaagtccttttctgcactttattaagctcaagtgtaatttgcccagttctaaggggcttttctgcaaacctggttgtattccagtgtcctccactgtatgcaaacttgtactcgtgtactgtgttacttctcttacttaaataaagttacatgagttcaaaaaaagaaaagaaaagagccagaccaataatcggagaatgaaaaaatattaccaggctattctacttttacttgtcaggagcatgaattatctcgatagaacattatgcaacttttactaggagccagttagaaggaaagaatacgtatgctccacttttctatacatcagctatctatatgatgtcttcaaaagaagtgatccattccatcctatagcacacaatgcactgtcgtacaacacaacgcacaacgaattgaagaggtaattcatcttcccaaataacatacttccttcatttcacaatataagtcattctagcatttcccacattcatgttgatgttaatgaatctactaacatcaacatgaatgtggaaaattctagaatgacttacattgtgaaacagaggtagtaccaactaatcaaccagcatgtgttgctataagaactcaaaatgtagaataaaacatgagttttaataaacagtcatatcaatattaagacagaaataagcgcttttttcgggagcaagacaaaaaacgagcacttgtgcagatgtgctcagcctccagtagtatacatgtcaggaaataaagcagtgattgtgtgcgctttgctcaagaaggaacagatgagcatcaaatgccttattttaccatcacatattgagatgtttatgaagacgtcaggccaaagccataattaagataactcactccacattatttgtttttactggagctgaaagtgaactctaacatttaggaaaaatgggagtagcccattaccaaaaacaaagttcatatttgaagggcatccgcaatcgaaccagcaaggctcaacacctcaaatggaggttgttggttgatggctttcactgtttgagggcaggagtcagtgatccagaaatacgcaaacttgtcagctgacccagctgtgagtgggaaaaaaaagggtgagaactgaagttgagtggctgaaaggtagaaagagaagagaatcacgaattaccggaattagtgtgagtgaagcgctcatacgactgcttgggaaaaacagcatgagtcacgtaagcactaacttttgcagcaccatgagcagccaaaactttctgcaaaataattagacaaagaagcattaatgagaaatgcaacataaagcagcatatcccatcaacagtttatgaattagtacgtcctcaaaagtgttaaaacaattacatggagtaaaatgaacatcaagcctactaaaaaatgaaaatgcaaaaataagcatgtgactgactttgctaagatcaggttttacaagggcatgtaattaatctctgtttttcaggacctctgcctgttggcaattaatatgtgaaacgtatattataggaggcattactctttgtcagacaactaaaaacaaagatagcaaaaaaccatatccctcttggcctctcccactaaagtggaagtaagaaaatccaacattagtaaaaattaagtcactgaagcactactttgtagtatcatggcaaagccacagacagtatgttgatacctgacattctctaagagttcccccagattgcactaaatcatcaacaataaccacatgccggccttcaggattcccctccttaattcgaactatcctcttgtcaccttcccgaacctttgcgcagacaaccttataatcaaacagcccaaagtaaaaactcggagtctttcaaccagaaaaaaaaaagagcaattccacaatggcatgcataaccgaatttcgacatgttcattcattcacacaaaacaagaagctaaccattgggaagttgagcaatagcttgtggaaacgcttccacgccccatcatccgggaaggcaatggtgatctgcgcaacacacaaatcacacaagtcagcagtagcaacacgaattgggtacttgaaagaaattagtaggacaccggtggccttgctacgcacattgtcagcatcggggagctgccggaggcgctgcagcaggagcggaatcccggtctcgaagcaggggaggacgtcgtccccgaagtagaacctctcctggagcgcgtggatgtcgtagatgacgacgctggtcgggccgccccgggacttgggaatcatggagaggatgcgcgcgagggtgaacgcggtggcgacgtcgccctcctcctcgacgcgctcgaaggagcccgtggggaagaaaggcagcacgagcgtgaaggaggcgatgaacagcttgggcagcgcgaagatgacggagatctgctcgaagatgaccgacggcgagctgaacgacgccaggaacgccacgtgctgcccccggatgtcgtgcgcgttgttgatgaacaggttggggaacccgtcgtcgaagctcctgcgcggcggcggcggcggcggaagcgaatcagcgaatcaggtgactccacgaaaccggcgaggaggaggaggaggaggaggaggaggacggggagcgtacctccagttgatggactggagatggatggtgtcggagctagcggcgaccttgagcgcgagctcctcgcactcggagcagtagaagaggtttatctgcttcttcgccttcggctgcctcgccacgacgacctccatcctcgtcccgggctccccggcgggcggctgcggcggcggcggcgcgcgcgagcggaatctccgaaaagaacggcgcggggggacgcgagcagtgtggtcggctttatcgacaggggagaagcagcaaaggtctaggagcaaattattcgctcaacacttttctttttttttttcgcgagcgtaaaccctagcttagaccccagccgcgcggcgcgagccacgaatcggcccgtggtatgatcgatcgatcggccgacgcgagcaggctggatttgggctcgaggcgagactagcacctactagtagcggcgcaaattggggaagaagataatgcgagatttttatagagcgctacttgcaaaaactgacgaaaaaaaaacaaaaagggagaaagcatggaacgcgccgccgccgctgcaacgcgacggattactatcaccaatccgataccatatggtgtcatagagaggcatgaagtacacagccaacggctggctctcagggattaaacgtcggttctaaaatatactctccgtttcgaaatgtttgagaccgttaattttttagcacatatttaaccattcgtcttattcaaaacatttaagtaattattaattcttttcctatcatttgattcattataaaatatatttttatgcaggcatataattttacatattttacaaaagtttttgaataagacgaacggtcaaacatgtgctaaaaaatcaacggtgtcaaacatttcgaaacggagggaatactagtatactaagtacaaatttgaattgactgatatctaatactatctaaacggatattcgtacggtcagattcgctaaacaaactcttaccacactatctaatactattactactactaatctataaatagagagtcgctaaataataaactcttactatacaatctaataacctgtttggtacaactccaactcctaaatttagcttcaggagttaggtctgcagtgaagttgtggagctgtctaaacctagcttcacaactctagttcattttatgagagaactccacccaactcca

SEQ ID NO: 60079 - DNA, 4639 bp, Oryza sativa
tactactattagtagtatgtagtgttagactgtagtattatataatatctaattcattatttggttaatatattttagtacgaatgaagcaccgaagagcattgttggtgaaggtttttcccatgaaaacaaagtgtacagaagcaagggaatcgtaagaagcatatgagaacctgagcagaagacaagaaaatttctcgagttctaatgggagacatgggactagtttattccccacttgtctctagtggggtgctaatttacaccagcccgtcttgtgtgtatgattgattatccttagccaaaatcaacggtacaaaaatcgtaagttacagaaatgtggtcaatccaaaaaggtatacgaaatcaacacctgaaaagaatgccaaaacttttgcaatgatccaaccgctgttcaccaacagaatctgctccaggcctattcaagaattaagataaaactggcgtgtttttttcaggagcatacctcgcttctccggaacaagctaagagctgccagagtatctgagtatatacaagtctagctaacgcacggatcagttgacgaatagcccttttccaaattgaatttcggctcgctgggatatacaaagacagttgcggctgaggctgaaggagtcagtgcagcagaatacctcactgaagttattgttatccttggcagctgctgggaaccagaaccaagcggcacaagcttatggctaacaatatgctcggttttcggcagaatggatgcagcatgattgtgagccccagagaagacgaagttctgggaatcaacaagagagtacttgatttcctgaagtaaggatgttgaattgtagatcttcacatgaaaagtgaaagggattccaaggatagcataaggagggcactccatggtcacaacaagtggcggctcctcgatatgaacttcaggtaacctttctttcattataacacggctatcttgactctctccaatgcttgaatctcttgaccagctcaggcaaatttcacctagaaaaaagcttggactaatagtatgtggattcactgaaaatattcctttgtattcttcactaggagcaataactgcgtattcattggaaatcccactgatctgttgcactgagcagagttgttttccatcatcattagacacaatagtcatcgtgtgtagccgcaaaggtacctctgtgcaatttctagcacttaaaataagcatatttgactcgttgaaagcaagagaactttttttatcatcatcacttgaggatctgatcctagataataacaggggttctcgcctaaatggtctcaaaaactgttgactgactatcatggggatcttaccttcaatttgcaagcttctgtgcacattaagtctgtgcagtgctgcttcttcagtcgagtccagggaatagccaagtgagacatagaacatcactgacattgcttgatgccattttatttccaatttgcatgaccaggaatcacctgcatataatgtgggaacagatacaaccccaaacgagtgctggatttttcttatgctatcaacttcttcctttgacccattttccgtggtcacatctgagacaccaagaagttcaacatgatgactttcagattcttctgcttccctaggactcatcaaaaggcctccacctttggcatcgacaaggttgattttcagttcaccagaatgaactgcgtgtccttttgacaatatggtcactgggactgtaaataattctccaaccaatgcaggaccaggacaatctaagacaaggtcaacttgagcatctggctcttcaacttggatcagtttctgcccagaaaaagcaagtacattgtccttcataggtaatgcctctacttggtcctcaaatttccacaatgaaaattctcccattgaaacaggactttccgcttggcagcaaactacaagacgtttacttattgttgccttcaccgccaaacattccagctttccactctgtcctgcagaaagtactcacattgttatttcatgataggactaacagaaggggaaaagttaacatcagcaaatgccgaataaagcttaaattttgattttcaatctatcagccacagccaaaatttggattttagaacttaattttatagttgattttgatgttttttcatcgtagttcattttccagcattggcatttaagtcgctaagaacgcatataaaagagttttacccgcaacttatgttttggttgctaataagtgtcatgacttaaaatcggttgtacgcaaaacgatgagactggtaatgtcctgttgtttctgtatgttcagattaagatactaatatgacaatatttacaggttacttttcaagaaataaaacatttacaagttacaatacgtgcagagagcgggtggatgaacatctaatgaaataaactatatataatatatataactgatacctggtttaacttcatgagtcaaccgcatccatttatcagtgaacagtgtcagaggagtctgaacagctccatcatgaacatgtgaatttgatgcagaacaatcttcctgtgcactaactataacaaagttacagtcggattggttaaactgaacctccaacttatcaatcataactggacaaggaagatgagactgtagagagacactgacaagcattggtgaatcaggttttacagattgatcgtgaaaagcaacagatgcgagaaacactatccttagtggacttatttgatcaatatcgaggtgagtagattcttccatcaaatgaagatcaaattcatcatcagtgttctccgatgcatgctttccttccaagatattaataacttcctgctgtataactctctactggaaatggtaggagatcctgctggtccatttttccttttattttctgaatttccctgtccactgccagagaataaaggtaatgcagccatctcaagtgaataactgataaagtccttcagagacttaagtttccttgcacattctctcaagtaacctaggttttcccaaagtaaagtggcccaaccttcttgacggtataggccagcaacaccatcaaaaagttgttttgcattactaaaatcccctgctgcataatactcaatggccattccaccactacaggcagaagccattcttgtggcacctaggctccgaaatgattcataagcttttctgaacaatgcaattatctcataggaatcttgaaacctttcagcttctgacaaagcatagctggtatactcagtatcagaaaggctgcaagcacagtgtcagatataagtagtcatataaaaattacgttaacatctaaaagtaactaagggtcaaagaacttacggaagcaccgcaactgtatctccttgctcaaacaagcgtacatactgaccaacatatacggaaggcattactgactcaggtaatccattgactcctttggtaaggcttacacttgatgaagagaactctaaggcatacctcttctctctcaagtaatttgccgccaactgccagaagggaaggcatcataaaaagatcactagtgtggtcaagtaaaaggaatgaaatatcctctgttgtagtgctgtgtagggagaggttgaacctgatagtagtaagctggttgaaattcccactcggtcagtgcgttgtcagcagtgccaaaacgaggagatagtgtatccggaacagttgtagatgttgtttctatgagctcaccaaagacaaggaactgcctgctaaaccattcccagtgaagaaaagcaacttctggtgatccaacaacacgctcatagcttctgatatgcttacggaaccatgtgattgctcccacaaccttccccccatgaagtaatattgttgatatcttaaagtgaaattgctcagcaactgcttttacctcaacaaggcgttgtgttggaggcagtcttgttgaagttcctatcatctaaataagagcaattgtcaatgcagggtgtaaagccaatagaaactgcttaagcaatagtgtcggaaaaataaaacagtaaggaatcttgaaggctttcaatatgtaatgtaagatgcaaacacacatggagaggatagggcaggatagagtggtagcttggataaattatctttaatgctagacaggtatgagatcctcatgaagtgttttctatatttaatattttaaaagtagcacgtgcacaagagtatattcagcattacaaatatatacgacatttggatggatagcaaccatagctgtctttctttatttactcatgagttcagtgtcacaataatctggcttctaaaagagtatgtcaggtgtggattcacttaattatcagtcttttaaggtctatggcaaacatggaacagggatccaattcacacctcacgcagaacacgaatgccctcctcatagaactttaatgcttcaggccaatcccgcctaaactccgcataaacagcgacctggtgttagaatcagaaatatcagaggaatgcagcccaaaaaaaataaaaattagagtagtgagaagtcattagcactactgactttaccaagcatgtgagaaaaatttttgtcccaataccccgggcattaa

SEQ ID NO: 60080 - DNA, 10787 bp, Oryza sativa
tcgccgccggggtggtggccggggaggacgggagctcggatctgtggtgactgtttggttcgtttggaagaactgggtgggggcgaggacgacgacgcgcaaggagtggaaacacgtatcgctatgtgagatgtaataatgaatatagtcagggtgttttctatgaagtctgaaggaccttgttataaaatttcagaattctgacagtcatcaggttaaatgaacaaatcaataaactacgtagtagcttgtactccctccatactcataaagaaagtcgtttaatacaatatttaagtcaaacattaggaatataaatcataaataactctcaagttgttgagtttgaaaatataaaaattatatgaatagatttgtcttaaaaaaaatactttcataaaaatatacatatatcacttttcaataaatatttttatagaaaaaagaagtcaaagttatgttttggagatcgtgtcgctgtccaaaacgactttctttacaagtacggagggagtagttcgtttatattgaaaatgaagatgaacttagagcacggaaaacaaaaaaatcataggcgtatgattaattaagtttagttattacaaaattagaaaatggttttatctaacatttcaaagcaatttatatatagatagttttcacacaaaatacaccagtaggcagtttgaaaaaactaaaatatagggatgcaagcgggtcaacccgcgagttcacttataggtcaaatactccctccgtactcgtaaaggaagttgttttggacagtgacacggtctccaaacacataactttgacttcttgtttctataaaattatttattgaaaagtgatatgtgtatagttttgtgaaagtatttttcaagacaaatctattcatataatttttacattttcaaactcaacaacttgagagttatttatgatttatattcccaaggtttgacttaaatattgtcttaaacgacttcctttacatgtacggatgggagtagatgataactcatggatttttgcaacgtggtccggcttgccgcatctagatatgcaagtgggtcgatctataaactcatttataggtcaaattaatagataacccgcaagtcaaatccatgggttacccactaattttgcctataaacgggttcgcggacaagcctgcttgcacccctagtgaaatattttttaatggcaaaagaacatgatctgtttggatcccatgaagacgaatattaagtatggacatgtaaaactagaaagccaataacacatggttaatttagttttaattattttaaacttagaaatggatttatcttatatcttaaaacaatttcacatagaaagttttagcacaaaatacatcgttttagcagtttgaaaaacgtgctaacgaaaatcgaggtaaaatatgtatcttataagacaacggaagtcattcgaatttttttagtgaatatcaacaactaattcctaactacactaattcgaaagtagaaatcacagattcagaggtcgggtggaccgacacgggaacagaggaggcccgtggtggtggggcgacgccatgctccctagcctcgccactcttctcgccaagttcacgcttcccctcattgtgtcgccaaaggtgatgacacctagcctctctctctcctttcccatatcttcccattatgttctctcctatcttcacgacgccgaggcctgaggccctcacgacagcaaaaatgacaacctaagcatcaacctgagcttccccgtcttcgtcaccgatagagctcggtgatgccgccgccaccgtctagctcctctctgccgactaccgcccttctccctacacaggcacgtgccatggaggcctgaatagagatgaggaagagagagaggggaggaagaagatgttgtttcaatatttaggaccatcatgatttttttttattttctatttttgcttttggttccaggtcagcttaacacagcctacaaagctgccttgggactacattcgtttgttttgaaagataaagaacgtgtgttatacttatatctggtactgcggtccaaagacacgattcgaactcaacgtgaattatgagggacctaaagtgaacttattctatcacgcggttggagttcaatagtctatcaggcccatccgggcagagagaacaaagcggcccatccaggcagagagaacaaagcggcccaccactggcgggagtaggcgtaggaacaatctgtccctcgctcgcaagccgtggagatccatcctttttttcccattgcgtgccagttgccacctctcaaccccccgcccctggctcaccctccgggcctccctcccccctcctctcctctcccctctctcgcggtcgcctcggtgcagcccgcgaaaatagcagccgcccgttccctccctctccctctcccctgccctgccgaagccgcggcgatgaacggcgccacggccggctccggctccggctccgaccacgacgacgcgcgcgccgccgaggaggccagaggggaggaggcggcaggccgtgccgtggaggttgaggaggaggaggaggaggaggaggcggtgcccgtggcggaggagagggccgcgtggggcggcggcggcactcccccgacccccgagccgaagagcgacgcggacgcggagggcgcgggctcgctggatcgggtggagctcaatgcaggggcgggcggcggccgtgagcgcgaggacgacgagggggaggacgaggccgtgggggcgaggggggtggagatgaacggggaggacgccatgagccacgacggccacgacggcgatgaggatggcgatgacgaggaggacggcgacgacggcgaggaggaggaggaggaggatgatgatgaggaggatgacgatgacgactccacccccgatgcgtcgccgagggcggaggcgaaggcggagggcgagagctccaccgtgatggcgggctgcgccaaccagcccgctgagcccgaccccttcctcgacggtgacgactctggaacggaggaggagcaggcggcgttcatggtggagctggagcgcttccacagggagcacggcctcgagttcaagcctcccaagttctatggcaaaggtctcaactgcctcaagtgcgtgtctttctacacctctcgtttctgttagctcctcaacccgagtacacccatctcttctcgtctaagcttgctctgttccttttccaatccaggttatggaggcaggttgcccacctgggaggccatgagcaggtatggtcctcgactccttgtcactagcttgctcgctgctgctactgtagagtaaaatattttcggtgacatatgtccgggtggatcacgatcaaataagttcacagtgattagtgagctgcaaggacctgagttatatttattctagttaaatattttgcttgttcaggtaacaatttgtaaactatggcgtcaagttggagagactttcaggccgccaaagtaagcctctaattttcacagaacatgttattcgcagaaaaaaaaagacttccatatgtgagtaatttgttgctgccgtaatcctttgcaggacgtgcactactgtatcgtggtcgttccgaattttctatgagaaggtgatgcatttgctgcatgattttcttttgcctctgtacttgtcacaagagaacttcccccttttcagttctttctgtcacaagtaaatggtcaccaacaatcattttttttcctgcaatcagtatcatatcgcatcaactttattgtaagttttagttgcaaaactgttagacttattagtatagttcttagtttcaaacataagaattgatctaaaatgatgggtctgcctttattagtgtaaaaattttaggggttcccgtgtcagttaatgttgcttccttttttggcagggaatatttaatgttcttacttcttacttttagtttaacgagcaattatcttacttgatgcgtcccttcatcattttattgaaactgttgcgctttcttcagatgctattactcttaattctttagatcattaattttcttagttatttatatgctaactgatgcatgttttggatggaatatagtacagaagcattattgtaagcttagattccatcccatatttatgcattgttttctgcttgatttgttaatttttgtttctcattaacttaggcacttctcgagtatgaaaaatacaaagtccgaactggccagcttcaagtaccattgtctgctttaccacagcctggtggtactggccgtgaggtaattgttctaatagtgcagtttttaataagagctctaatttattaattcagtttatattttagttcaatactgtacaatttaacgggattcaccctatttgtgtaaatctttaataattagatgaacacatgctgtccttttaggacctgtctaattcgcgcctgcgccaaaagtcatgatcagttacggacaggatgcagccacgcaggacttttttttaaaaaaaaaatcatcactggaagaatagtaagacgagagcacccagaaggcctcaatccagttcttgtgtccccaactcgtgcagcttgcatctcatttcttgaactccccagtcacagtcacgcatgggcatggcacatttgtttatagcttttcgtgcatagtctcccctaatcctttccctggaatttgtagcccttcttgttctgcatcccgaaaagggaaactttcaacttctcattgcaaaaaaaaaaaaagatgctactaaaaacctttgattggacaactttcatctggaactgaaaactttcacctggaactttcatctggttactgaaaactttcttttggagactaagctttctactagagattgaaaagcttcctattggagactaaagagcttttgatcggaaaactttcacatggagactttcatctcgagctaaagctttggagcacacaactttcatatagaaaaccaaaagaataaaacggaaaagagaagggaaagcataatcaatgtgcttgtcaggggcctcctgagtgaatgccaagcctaaacaaaattgcataccccttcgtgtcgatcaggcccgtatgctagcattcctcacaatgtgcgtgaggggatttacttttttttttatatccatttgtttatggaatggtgttacgcctttgttagcatgcacctcattagtcatgtataaatgaaagctgtgatatttacaccaacctagctgaattaaggacacagtctggttatatccggaaagaccaagggattttagtcactgaattccttctgaaaattgagtgttggttatggatccaattttattgacatagacgcactaataactgatttaagatgcctgccatttgttaaggtttccatcaagatgtgtggtgttgcgttgttgccaaaagtgttttcttgtcgatgcgtgtaaactactagttttagctagcttgacaagtttgtttactgccttgcagattggtatgaatcaatcatcttctgccagagttagaagggattctgcagcgcgtgctatgcagggttggcatgctcaccgtctccttaccaatggcatatatggagatcaaatgttgaaggttaaaaagatcttgctctttgtttacatgtaccttttcaagtcaccaactatttaatcagaaaagattcaaacttgtacaggaaaaagattcagtcccttcttcaagtcgtggtaagaacctaaagtatttggtatgtttgataagttttctttcagcagtgcatctgttgttttttctcatttatttgttttgacacatttaggagtactcaagaggaagaaagcatctagtccagagtgtgctatcaaggtgtctcgtacaaaaataaacaaatcacagttaagacttcctttcctttctgttggttatatagcattggctgataatgacttggatttagctacggaatatgtcattacaaaattttataggaaaatcctaaaaattacagttacattttgttcaattaagcttctcagcagaatttaaatccatatatttggatacttagcctatgaagcctgaacttgtatttatgtaacgggattctcaatttcagggatgactcaatggtcactgatgttggagaacctgccgagtgggtgaagattaatgtacgacagactgtaagtctcatatggtgcattgatattacagacaagtttttcagtgctcttctgaaatcctaatagcatatgagctggtttttctgttgagttgccatttttattcgggagaaatctcttcatttggctgtttctttcctgcagaaagattgtttcgaaatctatgctctggttcctggacttctacgcgaagaggtgaaaaaatatctttaatgttgaacgcatcacttcaaactgttccattttcctaaaataaatacctgacttaatttgtgcgtaacaaacaaaaagcttccacttcttgaactgaggcactacctgcgagaagaaatgaattgttgaattttgttctaaatggtgcaggtgcatgttcagtcagatcctgctgggcgtctggttataactggggacccagagcagcctgataatccttgggggatcactccattcaagaaggtgatagcagcaatttgaatactaatttgagcacgtttgcattctcttcagataacatgaagtgattactctttctcaggtggtcaatctgccattgaggatcgatcctcatcaaacatccgccgttgtcacgcttcatggccaactatttgttcgtgcaccatttgggcatgctgatatgtagatagtttcctttgagtgcagataccactggcccggtggtatttctggaattctttataggtttgtgattcaccgttgcatctatcccttgcttcaaattaagctcgtcatgctttgatatcaggtattctgtttttcatgcaggctttagacaattttgttgcagaagcaagtttttgtgtgagcagacgctcaatgccgagctgacaacggaattttgctgtaatcagtagcaagacttggggatctgctataatagtattgtttatagtagttgacataagtaggctggtttattttggtttgacctaccggagatttttgttttgttgtttatttttagtcggaagcagagtatatcaaaatagagagatgaaaataggttaaatgaaagcttaacttctttattttttggaaaacaaaggattagtttcttaacattattatttactattttcatagtaatgtttataagtgcctctgggcaatgcttgtccttaagcaaattttttatgcttgcatttgattcctcgtcccaatggactattgaattctaaattttgttgctggctatcatcgaatattaaggtccatgttcttttcagctatttcactagatattgtttgtggattatttgtttcatgtgtccaaaaatattgaagctgttgctaacttttctctaaaatttacatgagccatctctaatgaatttcgttggatttggtgaaaaaaattccacatatacaatcttatctacatcgaatttataccgtattagattacctgatagaggcattattttccaatgctattgggtgggttgatttgatagacttcttttgcttttgataaataatagcgataaaaataccaaactaaaaccccttgaaatcaagggcagccccatcgtttggcatacttgaggaaaaaacggaacggcatatttgcaaataaaaaataattgtgaataaaacttttatatacatgttttcaacaatccaaaagcaaaggctggaaaataaactatgatgaaaaattcccaaaatcaacttcaaatttaaggttgaaaaatttaaattttggttgataagtataatcgaaaagatgagaatgcgaggttgcgttcgttggaatgagttgggaactaatcccttgcacacaaatggaacgaattgtagcgtatgattaattaagtattagcttatttattttttatgagaaattaattaatatgattttttaaagtaaatttcatatataaactttttacaaaaggcaatacgttcgagatgtgaaaaaacgaggaatgtgagttgagaaagccggcaaaagaacacatccctaatagctccagtaactgagcccacttgtaactgcgatcctacggcccaactcccagggcccatcaattagtagtgaaacaaatccggtggtgggcccgattcgcaattcgccaaacggcagggacccgacgcgaccgcatcggcatcgcggcagcggcagcgtgcggtgccgacttgtgggaggagccgcctcctccgcctccgactatataacaaaaatcctcccgcacccccggcacatcgtccccgctagtcgccgccagtcaccaagccccgagcccacccccccaagctaccagcacagaacgaatcggagcgccgcgccgcgccgcgctgcgtcaccggcgatggactccgactacggcgtgccgcgcgagctctcggaggtgcagaagaagcgcgcgctctaccagcccgagctgcccccctgcctccaggtccgcacccacccattgccgctaatcctccttcccctgcgtgcgacattgcggtccctggcgcggcttcccggccctagatctgtgtgcttccggaccgcgcggcgccagatcccgcgccgctccggcgtccggatcagtccatctcaccggcgctggtcgtgtatactgttcgtctgcttccgatttgatttctcgggggtcttaggccataggtttacgtgtatcagctgtcagtctgtcactcgttttcggggaaccagattggatctgaatcgtgctggacctcgcctgcgaggtgcagggctctgtctagcaatgtactagtagatccaaccggcgtgcctggcttgcgggaggctgcgtgcgcgggggaatttttttttttgaaagctcgttttgccgtgttggtattgtcgtgttgctgttttatttatgagtttagtagtggagcgtagcaacttggaataaacagtagatggattgattcgtctacagcaaccatggacttttctttttggactagctttcacggtcctgtgttgtgttgtttacttttgtggtgacccatgaatcgctatcaaatcgtaagactttctcctgtttagttatgctgtttgactggtggctggatcggatgaattcatgataattttgcgaatgattttctcgcgtgcgtgtgattggtggtggatgaatgattttgtgaattcacgctctgaatttcttcactccatgtaaatcagggcaccactgtgagagtggagtatggtgacgctgcaattgctgctgatcctgcaggcgctcatgtgatcagccacgcgttcccccacacatacgggcagcccctggcccattttctccggaagacggctaatgtccccgatgctactgtcatatcagagcatcctgttgtcaggtatatatgtattttttacttgtgatattcaatttttttacttgatatgccatctgctgcaagacaagaaactgttttgaaaaaaagaaaccaaatactagtagtaaagtatttgtcaaattataagagaatgctggagagaaattacatcaaattatttgtcttcgcctctcactgcctgcacatataagacatctgattgttttgttttggatgcagggttggtgttgttttctgcggaaggcagtccccgggaggccataatgtcatctggggactccatgaggcaattaaggctcacaacccaaacagcaaacttattggttttcttggtgagtcctttgatatgcaactatgaatgtattaatagttcgttccctttgttctcatgtctgcttgttgcgtccaatcagactttcagcgtttgcttaaatagcttcacaagctacttagcacactatgtgttgtcgacttcccctagcagccaccagtgttttaatttgaattaactcagcatttttgttatattttatttgttttcattaccttagcaggtgatcacaactgtatagcatcatacatcatttagtatttttgtcacataagtagtgacatctaaagctcctcaaccgaactttgataggtccacttaatgaaattaacaacacagtgacatacctatactaaaaaaaaaaaaacaatcagtgatgctttgctacaagatcttggacagagtacctatctttcttaagtgtctaatccaaatcaaatgtgttaattttgtgattggcatcctgtgcatgaatccccccaaggcgggcttctgtctctcatgcctgcttttctgaacatgtctaacacttggagctaatgcttacagattttctttaactgtttcttatgtttgtgtttatttcgttcttttgttgaaacaggtggaagtgatggtcttctcgcacagaaaactttggagatcaccgacgaagttctttcttcatataaaaaccaaggtggttatgatatgcttggccggacaaaggatcaaattagaacaacagagcaggtcaatggtgccatggctagttgtcaggctttgaagttggatgctttagtaatcattggaggtaggctttgtggcattagtctactaaatagctacattgtgtatattttttttaatcctaacatctgtttaattctggtttctgaaggtgtt

SEQ ID NO: 60081 - DNA, 1657 bp, Oryza sativa
tgttgcagtccgtcccttggttcctgattccctatttccattgcaagtgtatgttttacttgcctgtaaatggcatgacacaatttattattgaacaggttgtaggtgttcctgtaactttgaatggggaccttaagaatcagtttgttgagacaaccgttggttttgataccatatgcaaggtagctttacattactatgctggggctccatttacctttactgtccttccattacctctatatgatgcataactgacctgttaggcatgtttggttttgtcaattgaggttgtttatgtatgcgaaagtgtgttttttgtgctatggataactttccaagttgcccattcaaaaatactacgcatttaatttaccactttgcaatttttatttattgttgaacttatttattattataacaggtgaactcacaacttataagcaatgtatgcaccgatgctctttcggctgagaaggtaatatctaatatggttgatccgcttcttctttagttggatgtactttcgtgtctgtgatactatttagctatggtcaattcctttatttttttctcagaattaaataatcaaattgaattgagacagtaaaaaaaactctgaattgatactgttaagtcccagtacagaaagagctaaacaaatatagaacacgggctataatttgcggttcactccttaattcggcctatgtgggaggttcacacttcacacacaggtgtacacaatctttgtataggcaataaaggatgccaatactgattgataacaatgcaaattcgcctaggtccattagacaactgaattatcctttttcttggggttccatggtccatttgttcttcagtatttctctcagcgtggttattcagtagacatacttttccagcaaggcctgctgagccttcctgtttacaaattcacattacaaaagtaacaattttatatgccttgtggttgtattctttctggcagtattactactttattcgcatgatggggcggaaggcttctcatgtggcattggagtgtgctcttcaatcacatccgaatatggtttggacttttcaacttttcgcttatgcttcctgagttgctgcaaattcttcttgcatttgtttgaacctgtatcatatgttcaggttatcctaggtgaggaggttgctgcatcaaaacttaccatctttgatatcacgaagcagatatgtgatgcagttcaggcaagggctgagaagggtaggggccttctattgtgatatgctcatgtaaccttgctttcaccaatgaaatgccattttgtgaaaatttatgaatttacttaaccttatatttgttgcacagataagtatcacggagttgtacttattccggagggactcgtggagagtattcctgaattatatgctttgcttcaggtaagtttgtacatgccatatggctattcatttacaacatttctaagtggcatctatgtaattgtaggaaattcatgggcttcacggcaaaggtgtttccatggagaatatctcctcacagctttcaccttgggcatctgcactatttgagtttttgcccccatttattaggaagcaggtgtgtattgtctgatactcatctatcaactcttggacattcata

SEQ ID NO: 60082 - DNA, 3958 bp, Oryza sativa
ctattcctgttagcactgttgcatctgaatctgcatttagcacaagtggaagggttcttagtgagcatcgtagccggcttacttcagaactcttggaggccttaatgtgctcacaagattggctgcaaaacaagtatcgaggtacatatgctgttttattcatacatcatgcttagcatagattttacaatgcaatggatgcaaaataattcttataattgttatcttgtagctgataacgaagaagcagcaagcttttggagttgccttcaagatatccaagatcggattgagctattctttcaacaacttaaaattagcaatcaaactcctaccgccattatttgttatatccttataaaatctatatacctaattaaaaaatatgtaaggattctgggcgtttttttcgtctgtcccacacgtgtagctaaatccgttttaatctgattaatagacggatcggacagttttcaatctactccaaaaccgaggtttatatactatatgtaagttccatgtaatctcgtagcacatatagtaatctgcctacatggttaacatcgaaagttttcatcccggcgaccagggttcgattcccaccttcctctcccgcattttttcacctattattgctagcactatgcctatgggctaatgggcccctcctagaataagtctactttccctccctcgtgtcaaatctcccgcattttttcacctattattgctggcactatgtctatgggcccatcctagaataagtctactttccttccctcgtgtcaaatcatattaccatgcacatcccattgctgaaaaataaaaagtattgcacctctttcttcaacagattgcttctgaaatcttataatgaaccattttttaattcgaaattattgattctgaaatcttataatgaaccattttttaattcgaaaagtaaagataatcatattatatacacaaaaatatatataaatatatgcttaccgatatataggatgtaatacatattcaagtatacaaaattaatgccctttctttccatgaaagaaacaaaaggttgctgcacatgcaaaggacccacggtcactttttatggtgttaatatgtacctaataataaaaaagtatgtaaggattcgtccgtccttacctaaattttttcatccgcaacatcctgtgtccaacactggccgtgccaaagaggcaagccgagcggatggagctagcgaacaaggctgagggttgaaaagaaatgaatgggactttcagcctaaaaccaaggagtattcaactaaaaaaccgaccaagctggataatgtatatcaattttaaaatatttttacccgttgcaacgcacgggcattttttttctagtacttgactaattgaatatcttttgctacttctttaatttagggacttgctcttgtttgaagccatgaatgtatggacatgcactgttctcgcaatgattttggatgtttgtaacccctgttatgtgtcatgataaacttgtaaaccatggcaatgcttttggatatttggcacaaaagacctactccgactatggttttgtgtatgcctggacaacatgtgttgctgctgcaatgtggtgataactaatgagtgatgactgatgaatgatgaatgatcatgtattattgtgttgttgcttaatctgggaatatgatggatattgtattcttgggcacacttttgttgcactgcttgttgctgcactgttgttgtaagtgatgaattgatgatgtgcatttgtgaactgatgatgtgcatttgcgaatttgtgaacttgtgttcttgtagttgttgttgatgtgctgaaattgatggctagaattgttattttgagtgttaatcttttgtatctaaattattgtttgatatgagaaatgcatacatgttgactgttgagtaagttgatagcggggatggaggctccacggggataaattacccgcacggaggcggtgatggggaaagatgttgccccgttgcatttcacggtgatggtgatggggaaaattctccaccgcggaggcgggtatggtggagtaacctccgatggggaattccccgttaccatatctagacccgacgaaccggaggcaggccgcacgtataagaatataagatgccactcaaaattggaccctctgtgcaaaactgctgcagagaaaagcaggcactgtactgtatcttttacatccgggctgaccgaacaggaaagggattaggtaaaaaaaaattttgccgaaacatacacgtactcgatcggataggagttccgactccaaaatctaaacaaaattggtagttccatctagtagtgccttgcctagtttacagatgctttactacgttgttattagttagtagatttagtacaatcttaatggatggctctgtctctctccccctgtgcatgcacgcgcgcttttttttgagagaaaacaccaggacatgtttgcgcctgagaaaccctgtggacatttcacgaaccaaacgacctatgcagcctagccagcctaggaaaatgttcatttgagctccttcattttattgtcaagtttcaaaaccattcctgagccggaatacaagatataacacattcttaattatacaaaatcggatcacattggatctcaaaacagtattgctttcgatatcatccctgtacccactcccgtgcaggtaacgggtacccatacccatataattgactcataccatttatagttttgttctataattagctatttttgaaccgtaacccatcaataattcttctggcaacaatgctattaacattagcgctcaaagtcgagtaaaaaaaatctacaaccatattacataatcaagaaatcaaataataatttcatataactagaatagaacttaagataagaaagaagttttatgttactcatggatttaggcttaatctacaggttttttcaccctcgggttggtaggtacgagtagataaagaatagacccatacccatgtacctaataggtaagaattttcgcccgtcggtaaactcatgggtataagagttaaaacataattagcatataatagataattagcttctaatagagtaaaaaccagtcaggtgtcgggtcatagcaccctgttgccatctctagagtctagacatgtatgtaacagtgtacacctgcttgcggggctatcagaggcctctgcatggacatcttctcttcaccttcacggcccaactacctgtgcggcccagccagcctatgttacagggctcgcaggctgggtacgctcagcccagatcatatcgcggcctctactggctttagcccttggccaccggacaccggccggtgccccctacaaaatctaaccgaccggatttctgcgtgattgcgcagcgccggccggcggccgcccaccgtacaactataccaggcatcccggcgcggcgggcgcgtgcgagtgtgcgacgcatctcgtcgcggtagcggcaagctgcacggcggaaggcccggcgtacgttctgggggagggagtttccgtacctgcgcccgcagcgtacgcctgatcatctgggcgggcagcagtacacgcggtaagttcctactttcctcttccagtcttcctcttcttcccatcgtacgcctgatcatctgggcatgataaattttgtgtgctcactgggtaatggccgggtagctaggctacctgtacgtacgtgcgttgatatagcgttgctgaaattttagaccctacgaaacgtacctcaccctagtggaaaaaggggctttaatcctagttgggaaccccctatacaaccggaactataaatccgggtatctttaatcccagttggtaatggtggaagcagtccggttgatccctagtttttttctttttttttttgtttctttgctcaaattga

SEQ ID NO: 60083 - DNA, 8908 bp, Oryza sativa
tataccaaccgggagtaaaaataatcggggtctgtcttgaactcaacaacttcttaaaccgagactaaaaatgatctactaaagatcaaaaagtacccctcaacttttaaactggaactaaagatactttttaatcccaggttttattagaaccagaactattgtggaatttgaccgatcgagcaaagatggtttctctaccagagtcatctggctcacattatccattacccagtgagtgcacaaaatttcttgttttgttagttttctaggaaatgattttttttaaaaaaaacaatgtccatgttacagttgggagctagctaacttagctggaagctaggttgcaccgagtgtcacgctaagatctacttcaccttcaatttatttcctcccctattcctattatgcctcctccataacaaatttatccatccaactccactcatcttgtcatcgcatataaagataaagaaaaattgtattggtttatctgtgcatgtattagaaccgcatgatgctaacaaatatatatctctatatacctaataaaaaaatacataataaaatatacataaggctaataaaaagatacataaggcttctcggtatatttccatccgtattatttcgccgatccccccgctttttttcatctacttttttcatcgcagttttctcttcacatgtttttttgccattttttcagggtttttttcatccacttttttttacatcgcggtctttttggcacgcttttttttcatcccaatttttttacattacgttttttcgcatgcggtaaggcttcgtttttttatcaactaggttttcttctgtcgtcgggctgaaccctagctcagccgccacgttgatctatccctctatgcgtttcctcctctaattgattgcaaaaattgattccccacaactccctcatcattttccccttgatttctccttaaaattcgtctttaattcaccggatttaatctcaatcactatttttattctgagttttgtggattgctccattttttaaaaaggaaaagaggagatcgagtggataaaaaccctcaactaacccatcgtgaaagattcgaccgaatttgatgggaggatcggctccggtatcgtacatgcacttccggaggttgaagacgatagggctgaaaaggaagaaaataatgggctttcggtccaaaaccaaataaggagtataatgtataggcgataaaaaatatttttacccattgcaacgcatgggcattttttctagtaaaagaaaagagactagcttcagcaaccatgaaatcccaagctagttcttagaagataagtcccccctatagtcttattctggatctgcccttgctactaagttcctttagtttctttcaaatttaatgtaccataatatagagaacaacatgtatatataggaccaaattaggaaaacttggcaatctgatgcttgactccaatgtgatttgacaaaggccttcttgacgaaagaagtcataagaggtgcatcatcaggtagaaaatcgagcaagatcttagtcttacattattgtcaatgtaccgggaacaaataacatagaaatgttaacaaaactctatataaattaacgggatcaaatcaggtgaaacagtacattatttagtatgatcatctctttaaaacataagctgattaaagccatgaaaattaaaaattaatccacatgattatcactaccacccattaccaagcaaataaacggccggcattatggtgaacaaacaataatatatagtggttttttaaccaccaagttaagtatttcattcatcacaaaaatattctgtttaaggcaaagttgcaaggtacagttatcattcataagatgaatgtaggttgaactattgccgactgcatattttaatcctgtttttgcatgttctgcatcgatattttatgtttaatctgaatactaggcctctagacaatagcaaatacagtttgctcgcttgctgcaagatttagttgtagatgacacaacatccaatgccactcaatggaattccacaagatttagttgtagtcttgtagatggcagcacccaactagagacaaggtgcatgctaatacaatttaccctaatatatatgcactgttattagcacttagctagtactattagacggttagacctcgtcttaagttttcctttcgcaacttgcatttcattaataatatatccaattagagaccaaatcatgtctactataactcgcatatagtactagctagctagtaacattgaaagatatataatgccaacaagctagtgctatgcatgcatgggtgcaaaaacttaattaacacttgtgctggtttggattactccagctaatttaattcagaaaatatacttcataatctaaacagttgctttggaaaggtggctgaacacatcgacatctgaaaactaaagtgtactgaacaaatggacatgatgatgctccaaataaaggggggagagatactatgacagtatggcactagcttagtatcccggatttggagaggcttgaccaccagatattggtgtggggatgctctggcatctgatctccaggactccgagaggacaaaggttgcaaagctatgagcaagttccaaagctctgggccttctctctccccccacaaattatgcgaaagtgtgaaacgtccctctcctctttatttcccattaagggaccgagaccctatttccagatttgtacttcgagaatgcaagatgcatgatagtacaagtaccatagcagatggtgagaatcttgcagctagtgtcaattttgggcttggcatctcatggccagcagctttccagattttgcagctctgccctgctggttaaacggaacctcactgccactgccttgctacagctttgcctgttggttaaacggaacctcacctagacacagtcttaagtattgctatatatactacagtattcaatcacacatataattccaagcaatgaaacgccaaaaacatgactgaagatgtcagagattcagaggccattataaaagctgcaggtgaaacaaaaagagggagggcagaaggctcctgcctcctggtggctggttccttctggacctatatactgaatgccaaaactaagtacagtacagtatagtaggagtagcagtacaagaacgccaaaattaagcacaggatagtacagtacttgatcgtatactatcctgaatttgttgagagcaaactttaagctaggagtatactactactcctactttcttgcaaaaaaaatggtgttcaaaatgcatgcttcagatcgacctagcttagctagggttcgaaattttgaccaggtcgagaaccattcaatatcaccatctggttccaaaacaaaaaataaaaataaaaaataatattcaacgccaccaaatcgtgagcttgaattcagaccagtgaaagtgaccataagacagttctggtgttgcacatgtttcagaggttgaaaaaagggaacaagagtttttcagaaacatggttctaccgatcaaaagatacaaactagaataggatagtaccatattacagaatgcaaaagagaaaaaaatgaaaaaaaaacacttggtagaattaaacacaaaacattggataatctcactgacctttggtttattccgagcttgctcttgcaactctcctctagcttcttgcccccacagatgttaaaatatgtgtatatgataaacctcctcatgaatatgaattgaaatcttaatttgcaacgcatgcatgatagatgcatacgtatgttgcacccagtacaaaggcctgtcgatcgtccaatcaacaatccaacatgcatgtcgcaattttgtaccattagcttagcttgcatatctgcattggattgctatggcttctgcactgcgcaattcttaatttggagaatttttgaactggatgctaagacatgggtcagaacggtggcctgactccgccggcgccggcgccgctccaacctccgaagttgtctccggggagctgatagcctcccacattcccggcgaggttgtagagcgacatgccaccggcgccgccggtgccgtcgcctcctgtcacgccggaggactgtgacgccgccggttgctgccctgggggtccagctgattgtgccacttgatcttgtgcttcgcctccggcggcgggcgcggcgacctcctcttcctcgccctccagcggcagccgctcgtacacggcgttcgcgaatgaggccgccatcaggacgacgggccccgcggcgaccagcgggcccaccacgctgccgccgatcacctggccctggccgccggagaggaacacggtgaggccgctcgcgccgggtggcgcgggaggcggcaggaccgtgcccgtgagagataggatctcgaaccggccccgcagcgtggccaccatgctgcccggcggcgacgcgcccggctgccgcagcgccacgttgacgacggcgccgccgccgctcagcacgcacacgccgcgccctcggcggcgggcgtactcggccacgcagtcgacgacgtcggcgccgccggcgacctcgagcacgtgcgagtgcagcgcgttcgggctgtcgcgcgtcacgatgatgggcggcttcggcttgttcttggacccgggcgggcgcccgcgcgggcgccgcgtcggcccacccgagccactaccgccggcgctgccgctgccaccctcgacgggcaccatggccgacgacgacggctggtggtcaccgccgacgccgccgcttccactccctcccgcgtgatctccctcgcccacggggctcttgtcgggtgacatcttggagtgctccatcttgacatgggatgtcggcgacagcggtgacagcggcgacggctgctgcggtcggagcagatggtggaagtaccgtgagctgccggcgccggcgccgcccccgccagggtccatcccggccatggccgtgtcatctggccgctcccaccacttcccggccgccagcttcccggttgatcggtgcccctcctcctctacaactcgctcctcaccatcaccaccacaacctgccaagacaaagcgagattaagccccttgtaaagaatctcgaagtaatttgcatggcacagtagtgcagcccaaacccaaacagcgaagcaaagcaaagcaaccaaagcgaaatgggagatcttttcatcaacagcaaagctttggcctttgacttgtccacacatctagcagctagctctagctagcatagctaagctacccagcaatgatgaagctctcaaaacgatcgatcgctgtagctagcatgttttccttacctccgccgcacgcttctcctcctccacgcaccgctcgacacgtcgacaccccggcggcgcgcggcagaaacctccctccgacgaacctgcccagccgatcgatcgcccaagaaaaacctccccggagcagcaagcgaaacgatcgttattccaacaaagagaaggtaaggaggcacgcggtgtaggatgggggtgaagcgggcggcgcggggccgaattaaaggagaggagatgaagaagcgaggcggaggggtgagctcttggggggacggcaagggatgggatggcgctgccgataaggtcagggaggtccgcctctctctctatcaatctctctcacgatacaatgccaatcccacccacaccaactccccggtttttactagcagctcgctcgctcggggaacggaaaggccggcctgccccgcccaggccaggccaccgcgcgcgcgcgcgtgtgggggcaacccgaagtagcagaggccacgtacgccaaagcgagcgaacgaggcgcccgccgcgccgtggactcgtttgtcgcgttcgttgaacataaaaaacgtggagtacgtctccctcccccgcgcgcgcccacgggacgcgcccgcactgcagctgcacgcgacgcgttcgcccacgacgtcgtggtcgacgcgggtcgtcgtgaaattcgcgggcgcgccgttgctctcgcgcgcaggcggccgcccaaatgcgtgcgcggtagcggcagcgcggtgcatgtgcatgcaccgatcgatcggtgccaagtcgagggtagtggtgctgtcacgtagggtgtgcagggctcggtcagtcactggacagtaggcagacaagcaagcaaataattggacctacaaggcgtgttaaacaattgggtcgtcgctttttactgtaccggtgatttttatatacacccgggcaagtacaagcaatccgcataagataatactacacgggacctgcatactccctccgtcaaaaaaaaaataaaaaaagacaaaacctggtctccgtgtccaactttaactggccgtcttatataattttttttataattcgtatttttattgttgttagatgataaaacataattaatattttatacgtgacttgtctttctaattttttttataatttttttaaataagacggacgatcaaacgatggacacgtaaactagagtttgtcttttttttttttatgacggaggaagtatgtatgcaacgtacgcttccttcctgctactacttgaaaacctacgaaccggtcctgatttgtgaagcttttttatattaaaaaaaatctgcccggtttatatatatgtagtttaattatactatatagtatggggttgcagctaggacgcgtataaaataggagtagctaggtttcgcatgaaggctttttcattcgatcatatccaagagtattgggttcgtttagtactagtataggctgtgtttgatacttggggttgggaacccaactccaccgcacggaaaacggagcggtccattagcgtgtgattaattaagtattagttaattttttttaaaaatggattaatttgtttttttaaagtaactttcgtatagaaactttttgcaaaaaaacacaccatttaacagtttgaaaagcgtgcacgcggaaaacgatggaaaggggttgggaaacttgtggaaagaacgcagccgttttggcccccatttggagcactgtacgtacgtaattgtccaacgattatatacatgcgctgtgtatcgcaagcttctagagctagccttgatatgttccgttaaaccaaactgcatgtactagagcctgtttaggataagaaatcggcttacgtttggaaatatttcaacatgggtacaagcagctgttcacaattccaagattggataactttagaaatgaagtggtttctcaactaatcaaggacgactcgaggtattatcggctgcgcccaaatactggcatgtggcatgcatggataggtccggtttggtgagaggtcccattcaggaactggaaattaatcaaacgagctgggcgaaaacttgagttttgcaatttgtgaccaggcttttctcggcgtggagaagccaagataaccttgtcgctttgcgtatgctctcaagtgttcaattaatttttaatagcggattacgggtcattgtcatgtgacgcatgagagagagcaaacaaatttgaatgaccacggcctgattggctggatctcgagacgcagcggtattagtttagtgccgcgcaatcacgaacagtgacttaatgatcgtcgccacagattagcagagtggagacatgaatggtgtatatgtcaatgaaagctacacgagcatataaaaaagggaggagctagcacgcaacaaaacaggttgaaatccaaaggcgagtacgtctttcggtcggccagttttttccccgttttttacgtgcatgggccagtacacatgttgactttgatacaccaattaattaaccatctttttttgacagcggccgtatagtaacatactggagtaagcatgttactagtaatttctaaattttgactctaaacgcaggtaccacaaacacgcgctggacactcttaagttgaatctcttttgttcggagtaattcttaaaagacaagagatcatgatatcttgagatcgtttaactgttgaccagctaactattgattgcattagagcaggtacaatagcaggttataagctagctataaacatattttaaagagataaatgaagagagagaaaagtagcgggctacaaatctgtagccagatgcagcacggacttcaagacgtaatgtgtgtatgatagatagaaccaggtattaatactatagtaaacaactattgtataaattggctattatattggctatagatgatttagagctagtagttggttatactattaaacttgctcttatatgcacctggtacatatacctggcctagcatgcatcatgatttattttttatttttaaaaagcatttctgcacggtgcacagtgccatgtcacgcgtgcatgcatgtcagaacttctcggctgctagttacaatagctgtagcatcaattatagatcagttttgccactttgccctaaattaaaacagccatcggtgcagacgtaattaattaaccatcttcttgaaagtgatcggtaccataacatatcatgtcaacaaatggatacctctagcagttgtattattctttttcacagttttttttaagaatgagttactctctccgtctaaattaaatgcagttttacactattcatgttcaacatttgactgttcatcttatttgaaatatttttatgattaatatttttattgttattagataataaaacatgaatagtactttatgtgtaactattttttaaaatttttttataaacttttcaaataaaacggacggttaaacgttggacacggatttctacggctgcatttattttgggacggagat

SEQ ID NO: 60084 - DNA, 797 bp, Oryza sativa
accatatgatcggcttgaattctcggcaatattactgcacctaggacaatcttcaatagatgacagcctcataccttcattccaacaaaatctaaagaactcacaaccccaatgaggatcaaaaccatcatcgtcttcttcatgatgcttctcctgctgcttgtcatacttcttctgacatttgtttataatcttagccgaattcatctgaaaaccccttacacggcccctatcagctgttcggccagctgtatgcaccatattaacaggaaaaggattgccatcaaccttcatcggcctcttagagtcgtcaaacttgattttgcctccttcaatagccgcttggatctgctgcctgaagaccttgcaatcattagtcgtatgagatccagaattatgccacttgcaatatcttttcttgcccaattcttcagccgatgaaattgtgtgaccggcaggaagttgaatctgcttctctcggagtagcaagtcaaaaatcttatcaaccttggttatatcaaagtcatacctttcctctttacctgagctctttacccattggcatggtataacattcttacttcttacccactcggctacagctatctcagaatcatcatcctcatcatccgatccatatatataagggcaaacatgattaacctttctagaatttctcctagcctctgcatacctttgttcatgcaaggctaccttctgtgtaaggtgtgacaagctttcaaagtattcagatgagaacttctccctaattggagcaatcataccctgaaaagcca

SEQ ID NO: 60085 - DNA, 2042 bp, Oryza sativa
tgggagaattggcaagtgggcatatgctttgattgaatatgatttggcttatgaaccattgaaatctataaaaggccaaattgtagttgattttatagtagaccatcatgtagatattgcttatgaagatgaggttttgcttgcttgatgttaacccttggaagatttattttgatggttcttgcaaggaaggtcaaggtctaggtgtagttttattttcacctagtggtgtgtgttttgaggcatcggttcgtttggaatattattgtacaaataatcaagtcgaatacaacgctttattattcggcttacaagtgatggagatgatcggagttacacatgtggaagcatttggtaattcggaattagtggtgcaacaagttgccggagtttacaagtgcttggacgggtcactaaattggtatcttgatcaatgcttggatattattgccaattttgatgattttgctattagacatatttctagacatgataattctagaggaaatgatttagcacaacaagcatctagctataatgtgaaaaggggattatttctgatattggaaaagccagtacttgatttcaaatctttggacgaaattggcaaagttacagaccaggggcggtctgaccggcattgcactaccggtctgaccggtgaccatgggcggtctgactggccggatgccgccggtctgaccggctgacccgagcggtctgaccggtcctgtgtggccggtttgaccggttctggacagggagctacgggggcacgattcattcaaaacggaggccgaattagttgtaaattcagatgtttgtgcccaggaaacagaagaatattggagaattcctttgattagatatttaaaagatcctagccttaaggttgatcggaagattcagcggcaagtgttcaaatatacatggcttgatggagatttatatcgccgaaatatagatgcagtgctattaaagtgcttagatgatgaccaatctaaggttgctatgggagaagttaatgaaggaatttgtggaactcatcaatcggcccataagatgaattggtttcttaggtgagcgaggttctattggctgaggatgattgcagattgtttcaaatattatagggcatgcgaagcttatcaacgatttggcaatgttcaattggcgcccgccgccatgttgaaccctatcatcaaaccatggccgtttcgaggttgggctttggatttcattggtcaaatttatccttcgtcaccaaaggggcataggttcgtgctagttgcaacggattacttcaccaagtgggcataggctctagaatatgactcatatggaggtaattgactttatattgaaacatattgtccatagattcggtatcccacaaacattgactacggatcaaggagcttcttttatgtccaaggaagtgaagagttttgccaaatcttatggtatcaaatagttgatttcttctccttactacgttcaagctaatggacaagccgagtcaagtaataaaacattgctaaagttagtcaaaaagaagattgaggaacacccaaagaagtggcatgaggtgttttctgaagcattatgggcacatagaatatcaaaacgtggtgctactaaagtcactccttttgagttggtttatggtcaagaagccgttttgtctgtctctacagttggaaatattacatgtgttctctacagttgcccgtctcagtggtcaaagctattgacactgcaaggaaaaattgtctctggaggggaaacaatccaaacttacgtaaaagatctcttgcttcatgggatttggtatgcaggccaaaggaaaaaaggtggtttaggagtcatcaacttgagagttcaaaatacaacacttctgcttaaacacctagtcaaatgggttcatttgatctggaatacttattatggctccaaagtgcctcatttggtttggataaaggctctttctagtggagagatatagtggttttgtctaatatcctcaggggaatttcaaaatg

SEQ ID NO: 60086 - DNA, 6884 bp, Oryza sativa
acggggtgcatggagttcaaggtgacggtgctcaggggctgtagcgaggaaatcttaatagtgacgtggcacaggactttttcaataacttccaagatcgggttgattacgctgtacatcatgctttgatcaatcagtctggggtgttagtcaataccctgtcaaacatgatgaagtcaatagccgatggttcaatagctgaacatcaggctgcaggcctggtctatttgcaaggaggtgtttttccaaattatcagtctttgattaccgacgttcagtcatctactcagccagttccctccgttacacccacaacttagccgacggcaccggcatcaactcccctacctgctacatcagctatagcgccaggccagccaatgaaccctcggctattaatgagagagcatccacagcatagtgggcaggttgcgaatcggccaacccaaggtcaagttgctgcaatgtttttgccgcctcaacatgcggttgatctaatacagcaacagccgattcagcaacagtcgattcagcagacaccccaaattcagcaggttgtgcaaccaatccagcaacagatcatgcaaccagcacaaccaatccagcaactggtcatacaaccagttcagcaaacaccaccaaggcagcagtctctgcagccgattcagcaaacgacgttgaaacagcagatcgtccagccgatccagcaccaaggttcagtgagcgcatcggccgggtttgtagcgcctggtggtcagcctgtacaacaacttttaaaccaagttgtcccagaacatttggttcaccacgtacagctggatagcacagtaatgcctcaggttgttcctgagcacttgctgcgtaatatccagccagaccctcacaattactaagggggcaacctgagttatcaatatcaacctccttccccgcaagcccaatatcggccagggggattggctcaacctcagtttgcatcccaatacggtcagttcgagcccatgcagcgacagtcacaaggcgcaactcagcaacgaccgtgggccgatgtaattgctgacgtaatgagggaacagtttgggcttaaaccaaaagagactagaaacttgtatcggcagccttaccctgagtggtttgaaagagttcctcctcccaatcggttcaaagttctggacttcttcaaattttcaggacaagatggtgtgtcgacttatgagcacattagccaattcctggctcagtgtggtgaagcatcggcggtagacgctctgaaagttaggttattccagttatctctgtctgaatcggcttttacttggttttcctccttgccatatggtttgatcaacagttgggccgatttggagaagcaattccacagctatttctacagtggggttcatgagatgaagttatctgacttgacggcgattaagcagcggcatgataaacctgtgcacgagtatattcagagattcagggagataaggaacaaatgcttcagcttgagtttaactgatgcccagttagccgatttggcctttcagggtatgattgctccgattagggagaagttctcgtctgaagactttgatagcattatagccgatgacggggggagatggcccacctccgttggggatcagtcctggggcatacttgatatccctgccgctgttgctttggtgagggggagaagattctgttgtctgcaaatcaggaggaaagttagctaagggctaatcaaccaagtagttattcaaataaaatcaagtgagttaggacttacttgggggacaatatctggaaagagatctatcatatacatagaagccaattgatggaataagtgtagcttccattcaccccaccatctgtcaaatactttgctcctaaaggttgccagctttatggtgtcaatgctgcctagaggaggtccttggagattgagcagccgatccatcattaaagatgatgagatttctcctcggcattggatcttatcggcaaagaataagccgattgggagttggcccattccaaattgtctcgcagaactcattggatgataaaactcgtaggaaacttggatgtttctcccttgatgaatgccgactggaaggatgcatggggtgattgcagataagaagatttctctgggcttctgatatctgtcattgttgatgtcttcgaatctgaagtcccatggattttccagaagtgttgagtcccatggacggccgtccgatcaaatggacggccaagatttcgccttcaccgctgaaattgctgcacgagtcaaaccctaaccctaatccccatttctcatttcatcttcctcccttttcctcgttctcttctccggcgagccagagtgcgagtaagagcgaagcaatacggcgggaatggcaatacggcggtccggcgaagcaagagcacgcaaggggcgtcgagcgccgagcggctccggaccttgccggctggggggcggagcacatggcagcgccaagccgtgttgcttttgcttcccgtccccgacagcaagcggcggtgacggtccagcgagcagcgcgcgtacgagcagaagggactccgccaggcgccccgtgctcgtcggctaggggggcgcgcccgagggcggcgccaagccgatgcttcccgttcccggcgagggacggtgacgaggtcctccaagacgacgcggatgcgacggcgaggaggtgaaggagcggcggcgccgcttcccggagggctccgacgagcttaggatttcgaatccggtaaataacccaaactcgaattaattggcttgccaagatttggaattttggttctttagggttcttctcaattttggggatttcgggtggattaatacaatccggcttatctagagttctacacccgaaattagggttcttagcttcgagattttaggccgatttgatcgggctgattgggtatttttgggaaattagggtttcgcaaaaccgtggcttaattccctcttgcttaacagtggggaatttcaatctagtttatccccaccttcttgattgctaagtgcttcccgaaaccatagctttggtctaggaaaatctaaatgcgagaattgggaatttcaatcttgtttatcccaatccttttcttctcttaaaaacaatgaaattaaactcttcaataattttgcttcttctactgttggccgagaccaacagtataacagggcttagccaattatgcaaccaaggcaaagagattaatctagtctaattaactcaaaattgcatcatgccgaatagcaattagggtttaattggcataatggcttcacttaaggatgatgggatcaagaaggctaagattaggctctgataccacaatgttggaatttaatccaactaattaattgagtcttagcctaaacataataccttatgcttatgcggaaattaattgatcactgacctgagatgaagccattgctcttcttctttcttctcctttgtttcttctgttgtgagatacctcacgaaccccttccagtgtctaatcgatcgggcgattgatttagggtttagggttggagagagttgagttgtcacccatcctccctccttctctttttttatatagcgacactggtggggctcgggggtttatctcaatctaaatttgaatctattttgtaccgatcacacaaaacagatttatctcttagtttgtttcttgttaggataggaaaatcggtggaattttaaccttattctaacaaaccggcattagccgataaaatcaaccaacatatcaattagatggtctacttgatccctgagtctgtccagcaaccagaagacaaacattttataggctgtgtttagatccaaacttccaacttttttcatcacatcaatctgtcatacacacaacttttcagttacatcgtaccaatttcaacccaaacttccaactttggaaggaactaaacacagccatagttgttgcaaattgcaatccacttttgacagcgggatgcctaacttggcacaacccacatggtcacagagcttggctttattattgttgttattatttgaaattagtattatatccgatagaacacttgtggccgtactataagaggaagctttcaatccgtagtagtccgtactttcgtcgagaggacctacagttttgctagaacgcaatcatcaggtaccacgtttgcttttgcgtcggcaacagctccggcagtgagccccttgttcacctcctgtattagcctctctatcactggattcggcaaccttatgggcacaatgacgcctgcctcaccaacctcattcctcccctcaaggtgaaacgtggccagcattgtcgtcgccggccctccatacaccggctttccccagccgaagtcgatggccatcagcccggcctgtgtcatgtccgagatgaggtacgtcctggccttagggaacggcggcctccggtgagccgcgttgaagttggccaccgactgcacatacccctcctccgacgcacgcgccttggcctgcatgagcagccgcagcgcgtagccgaagggcctccgccaaagctcccccgccggcacggacgcggcagcgaacacaatcgcgttgccgtagtagcccctcggcacgggccgcttgctccggttcctgacgcgggcgttcacgaacatgtgcaggcggacgacgtctcccgggtcgtaccgcagcgcggcggtgcggcagcgccacatgaacgctcccaccaggtcgaaccgggagctgacggcgcgcaggtcgggcggcgcctgcgacctgagcgccgcgatctcactcgccccaaagaagaagacgtggtgtgcgtacgcgtcagtgggggagagcacgtccttgccggggttgggcaggggtgtgtactccacgtggtcgcgcgtgacggtcggcggccatcgggcggtgagcacctcgcgctcccacaccgggcgcaccgtcggggctccgtgcacgccacgggcgaactcggtcagtgcagtcagaaactgcactatcccagagccgtccgccatgcaatggcatatgtgcatcccgaacacgaagccgccgcacgccagccgcgtcacctgtgtcgtccgaatgcatgtaataaccatcatttgttattagacgtagtacgtaccatgcatgaattttactacttcactgtaaaatgatttgcatgctaataacctgaataaacagcaaaggacggtcaactacatctgccgtcgggctctccggctcgcacagcaacatgtcatagcacggcaccggcggcgccagcgacgtcccgagctcatccatccggaagttggcgtcggcctcgacgaacacgacgccttcgccggtgcactccaccacaagcttcctagttggccgcagctcacggaaccgaccggcgacggggtagaagtgcacgagcgtctccgagatcgccgccttgatcaccttgacagggtcgaggccgtccttggaggggctgtggcggtagaagaggatgccggagcggttgaagcgaaggatgtcctggtcgtcgatgtccgacagcatcttgaactcgtacggcgtcggtttcgccggcgccaccagctcgcgctcgcgccgcctgacggagaaggctaaggtcggtgctccggccatttgcaccctaagtagctactaagccactgagctacgtgagagtacttgttgattataccaagattctttgatgtgtacttgtaaggtaattggaacataaattttgctctatatataggcgtgccacggcgtacgagccgagagagtcgatagattttgatctatattcgatgtggacagagaaaaaaaataagtttgtaaaatgatggtaaaaactagaccattagccgagagggtggtgaattcacaaattggctaaaccattaatgcacacataactacacgaggaaaaaaatggctaaatctaactaataaagaagatcacatttaacgtgtagttagtcgattgaaccaatgctttccagataagtgacttcgtgtctaacaatgcgatattacagtacgacgatgagttttcactggcagttcctataggcttctagcatcgtcctggattgaattaagcttcggccgcatgcgttcggtagatatatatatatatatatataatagttctgattccccgatgtaaccatcaagccatcgaattagtgtttttttgtcggtgtgaattcatgtcgcgttcattctgactgtccaaagaaatcattgtatgtctgtgtcgcttgatcattttcaaatgtggctccaaacgaatctgtagggcacaccgaatttataccgtctggtgtcatttgtgtctaccacatacttttgtatgagtgggatacatacacgcataaatagccaatcaaagcacatgtacaaaaagtgattttggggctaaagtcctatttattttcctccatctatttcctaccaccttcataaaaatttatccaaaatcataaaccatgccatttacatttcctttccttcctatttgagtgcttcaatataaatttccaattctctttagtatcctggaaaccctatttgaattctttgtcaacatccaaagagtccaaaaacaaactcccttagttttcatctccttgaaatcctatttaattttctttgccaaagttcaaaagtccacaactatttctttttaattttcatctcctttgaatcctattcaaatttatccatacaaaattcctagaagttaccattctttcgggctgaaatccccatcttttggcccatccttcttttcctctccctccaccctttctacttctcgggctggcagcc

SEQ ID NO: 60087 - DNA, 2707 bp, Oryza sativa
ctgtgccgttgtccttctttccacgccactgccaacgaattctccttctccttctcctttgcaaccgcctccaatcaccgcctctcgccgcttaaaagtagacgacgagtgtcacgcccagaaattcactaacccaaatttcaagcagaatgtgtattaaatctctatccaggaccagccagagtacacaaatgacaatttgatacagttccacctcttacaaaaataacaaaaataaaactcatgcgcaacgaaaaataaaataaactagacttaatcttcacaaccaaagcgaagcttcctccataaaccacaagaaatcatcgacgtctggaacaagctcaatccttaaagaactcaccatctgaaccaacctctgcttctggggtgggggaaaaataaagtaagaccgagtaccaaccaccgtactcaacaagtcataccaacaggaaggtatgatgcaaggtactctcaaaggaatggctcattggataatttgcagtaaaaacagcattatataaatcatattttgaagaagtaaaaacaatatataattaagcaatactaaatcatcactgtccaacgctaaaaccatgttgaaacaggcccaaccaaaccacatgaactacaccagttctataagtcatattattatagtgagactaatcacggtgagctggttgaccgccgaataaccgcgggcacagctattcgaatagttttaactctgatcagaggtgtacaactttacccacaagacacgattccacacatgttaccatatcccgaagcaccaccgagatactgcaaaaggggaaatcgtgacaaaaaccttgtgccaagtcaaacagtcccctctcttgcctaggtaaatccggctacaacagagaccaatatatagatccgaactgcaccatcgcctctacccttgccatgctatgtcagctagcttaagttatactctagatttagcctagtgcccatctagcctgtggtgagtatgagtacatcttccagggattcttgagaaccggtccttaattatgatgaaccctgagttccactcgacactcaaggctgttgttggcccgatctttcagtgagttgagataactatgatttgggagaaacgttgacaatccgactacaaccgtacgagacgttgtgctgcgccttagcgatcgatacacctttccgtgggttgttgatattgccggtgcagatcaaccctattcctgcaagcaaatcgaagaaacaagcaagaacaagataaaagcaatctgatattgcaaataggaatttaatacaaatgataagttggggtttcgaatacaagcagacgggcggtctagccggcacgcgcgctgcaagcaagtagcaatggctaaactttaatctatcaaaacccaagaaaccctgaaggggtacctacctatttataggggtgggaggacgaccaaggggtgccaagagtcgttctccacctggttggggcgcaccccacatgggccccacttgggccggggtcccagacgaagttacaagcccataggcccattacaggtgacgcagcaccttgttgcttcaaatgcggctcactaagatggaatttctcaattaggctggatctgttggaaagaggactccgagagctttccatcaagtactcacgggccgaaaacggagctcgtatggagatttggcggccgtttgaaatcagcagtgcagcaggtggccgaatcggattccagcacttggaggccttgaccttgatgtctacttgttcatccatgatatgagcaatgattgtatccgtagtagctatggtcacatgaaattgtcaagggcatgacttccaaaatcatgcatgtacccacaacccaccattaaagcatattttagttttattaaaccataaccatggtgctacatcataatataattaaggactaaattataatgagtcccattgtgagctaattgatctaagcatggctaagcattcctaaaccaatcatctaactcaagttatcaatggcataagatattcaatagactgagtacgataggcatccatcccacatgacattctaaaacaatgccatttgatagaaagcaagggattttgtaaaattggctcaatatgatcaatgatgtatgcgtgacttgccttgctcttgagctgactgaacctcggcaatcacttcgaagtaaactggatcactggaactgatggaatctaaacgacaaacaaagcacacaagaaatacaagcaataaggctactaaaacagaaaaagaaacaaattttaatggattctgttcattttaacggattcactgcaatttgaatgggttaaaacggagctcaaattattagttatgaattttacaagatgagctgtgttattactaataatcgaaaaaccttagtcatttattacatattattgcccatagataaaaagatcaatgaaaataaacctccggtaagcaagcctcacgaattaacgactcaacgagccaatccttcgtgacacgggactatccaaacggtcaaccgaaccggcgaacaaagcggcggctcagaacaacaaccgaaaactaaacatggtttatggcaaagactcggtacggcaaacgataggccagtaggaatttagcgatgcacctatggctttgcaacatggctaccaagatacgacaca

SEQ ID NO: 60088 - DNA, 2834 bp, Oryza sativa
atgtggtgccgtcttagtaaaagaacgtaaacggaacccgcgaactaaaacggtcaaggctcgtcatgcaaaacgaaaccgcggacagagaggggagtgaatcacgcactattcacgaccaaaggtggaggacaaagattattattattaattcaaatcttgacaaataaaattaacaacattaactccgatgctccgaatattcagctttaagtcctgttagtgattttagagccaagagaattcgaaaaaaaattctccctgacaattccgaatattaaatacatttgtaattaagtttttctcctggttaaccaaagtaatttctatagttcgatttattggtgaagtagaactacggaaatagggaaaactataagtgcgacaaacctacccccttaaacggaatctcgtccttgagattcggaagaacttgcgaagagatgcggatgggcggctttcaactcatcttctcttttccatgtcgcctcatcttccaaatgatgactccattgaactctgcagaacttgatcactttattcctggttctcctctcactggtctcaagaatacgcgtaggcttttcaacataagttaaatcctcatgtatctcaattctgtcgggacttgcctgtaactcaagtactcttaagcatttcttcaattgtgacacatgaaacacatcatggatactcgccatattgggtggaagttccaactgatacgcgacttctcctcttcgttcaagaattctatatggtcccacgtaacgtggtgccaattttcccttggtttgaaaactgtgcacccctctgagcggcatgactcgaagataaacatgatctctggcttcaaaactaagctctcggcgacgattgtcagcataactcttctgatgagattgtgcaatcctcaatctctctctgattgctcttaactttttccttagcttcactcaacacttatgttccaaacaactgacgttctcctgtttgatccaaaaacaaaggcatacgatattttcttccatagagggcttcaaacggtgccatctgcaaactggcttgatagctgttattataagagaactctgcatacggcaaattcttatcccaagatccaccaaaatcaagggcgcaaactctcaacatatcctccaaaatctaattcactctttcagtctgaccatcggtctgcggatgataagctgtactggaattcaaacgtgttcccagttcttcttgcaacttctaccagaattttgaagtaaactgacttcctcgatcatatacaattttctttggaacaccatgcaaacaaataatccttgccaaatacaattatgcttatcttttccctgtgtaagtagtgtgcactggcagaaaatgtgccactttcgtaagtcgatccacaattacccagatagaatcatgtcttgacgacattctaggcaatcttgttataaaatccataccaatttcttcccatttccattccggaatttggagaggttgcaacaaacctgctgtgatgttctgctttaactcgctgacacacaccacacatagctacaaattcagctatctctctcttcatactgacccaccaaaatttttccttcgtcttgatacaacttagtactccctggatgaatagaatactgggtctgatgagcttcactaagaatcaaatccttcaattcctcattatcaggcacacacaatctttctcccatccagattgttccttgctcctcttcaggaaaatcgcgggctttaccaacccgcataatcttcttgagttcggctatcttgctccacgagcgtaggttgtgcttccaacatagtaacgaaaccatgttccactatccccaaattcagacgctctaggtcttgaatcaactgactacttactcctttttcgaaacatgttgcattgcaataacttttccgactaaaagtattgtcacacctagagttttcccttcccttaggtttcaaatcattaaaaaatggcttctagaatttgccttggttaacccggagaaaaccccaattaacaatatatttaataatcggagttatcaggtgtaacaaacccaaaatttcaggacttaaaatttcttgtcaaaatagttagaggttaacttctccaatttttagagtcaaaaatttccgttttaatttaggtgatgaccaacttaaatcattgcatgattaaaatttgagaacaaaataaaaccttttcattcccaacattagactagaaatgtcaccaagtatatgagcatacatgtgcataatgcatgcctaggctcgagtctcatgtgcatttggattttggtcttgcttttcataatatgtctcatgagcataaactaaaagggttaaaattactaaacaaaactatagttaatcttgggtgataacatgtggacttaatattaaactcaaatatcgtcttctcagcccaaaagaagtttaatgtaatccctgtaacaatattaggtgcaattatgaagtgggaacacatatacaaagtaaagtaatcctaattctctaaaatattatgtgcaagttaaaatcatggaaaaaattagatagataatgtttagcacaagcaattcactataatattggtacaagttaataactaagtttaataccacaaattaatcagtcaaagcagaaaactaaaaggaatcaaattaaattttaattggctaaagccatacttcatccaaaagtacatttaactgctcataagtgaacatgtaaaataatttattcaaatactagattatttatcatgcctaaatataatttttctagaa

SEQ ID NO: 60089 - DNA, 11635 bp, Oryza sativa
catcacttcctccactgctccagccgagagagggagagattgagcgagccgacgcgtggccgcaacgtgtcgtcgatctcggtttcccttttctcgctctctactcctcccagacgcgtcgccattctccattcaccactcagagccgaagaaaccgagggaggaggttctctgcctctccattgccccaaaccttgccgccggccgtggagacgacgaccatcgccatcgctaattgggtagaggtcatctccaggtttttcgcgttcccttctctccacacagtgccgaaccatttctcttttgaccacctcccgttttgtgttttgtgcatcacagccaccggaacgcgaccacgccgacaacgccctggagcacgcaccggagcgccgccgcttcaaccatcgtcgttgtccggccattcttgaccacctcggagcaagccgctgcgccatcgtcatcgcctcaacctcctcttcaatacgcctcaagaaccccagccggagatgtgaaggactcggagaacgcatcttttcttcaccggcgccgatctagaatcgccttcgccatcatcgtcgattaccgctgcctcggtgagccattgtttgatttctcgcgcatacaccatctccttgacctcacaaacctcgtgcatgcttgcttgtagcagctcatcgtcccgttcgagccgtcgtcgttcacccgaggaggagcaccgtcgccgagccgttccacaagtcaccgctgccgccaagacctcgacaaccctagctcgacccacggtgagcatcctgaaggctagaagaccacatgcatgcatcctttttgttcggaatcgacttccatgcacacatgcgctttcaccccaagaaccaccgcagctcacactcgccatcggcgctactccgatatcctctaactaagaaaactagaggaatggaatcgcaagatcatgctcttcattttatcttttaaccccaactccaaccgagccaccaatcgccgccggtgaacccgggatcgagctcagccatggctgctctgcctctgtgcgtgtgaaaaaggagtcagggacttcattttgagaatttaaataaatataaggttcattacgtaatgttcccaatcaatgacatatggaccttggactgcgggttgatttcctgattccctaggggcctttttgcatattggcctgatactgacaggtggaccccatgagtttaaaatctgaaaatgtaaaaagataatactaaaagctttatattttcaacaggaaagcatgtaaacttataaaatccataacaaattgaaaacaactcattttagagtaaatcaaatttctgtgaactcaccaaatcaagaactttagagttattgcataaaactagacattcactgtacaaactttgtctctaaaattggtctaagataaatcatacataaagcatacacaaatttataaaatgcatataaaattcatctcaaatcattttatagaaaactcagtttctatagatccaccaatttatgttttcctataaagtaaaatgaaatagtatacatactttagatcaaatgcctctgaaactattatctttaaaatgactagttttaggtaagctgaattttagaaattcacataaaattcatcttagatcctttttgagtaaacccaagttctgtagaatcaacaaaacgtatacttccatgttataaaataaaattatacacctactatgtaataaaagcctttaaatatttatataagtaataaccaagatagagcaacctttactttgtaaaatttgtagaaaattcatctttagttcaaatgaaatgaaccaaatttccatagaaccagcaaatagtgagcttcaacataataaaataaaatattgcaccttttgaacatattatagctctaatctttaaatagataaccttggagttaatcacctagtaatggttaagcaaaatatatgtgtaaggtagttaaaaaaatgcattctagctatgaataaaccaaaataaaacttgttagaccagagaggccatagttccatccccatccactaaaacatagaagaacttggctcatataacaatttctaggttaatataatatattgctagtttagtttagagcatctctagtttataaaatatgaaccatagtagtaaagaccataaacatttgaactaaaaatgttttagttaaccaaattattccttttattcaacttaaacaggaagtagaatgttctgaacctacaacttaagagtcgtgcacatataaaacactatatgcctaaaacacgttgtaacttgtaaaatctataagaaaatcattgtaactccaaaaattgtgaaaccaaatgagttagtcttataaaacacatctctacacccctgtgaagtctaatctagtaaaaatcactttacaaaagtatttcataacactacctaagactatactactataaaccgataaaacttctaaaattcataactccctaatggaataagataaaataaaaattctttcacctaaaattcattttagaccagtacctaatcactgtgcataaataatgcattttagagcattttggattttcagctatttcggtgtttaattgcataacgtgtcctttatctagataattgcataatcggtgaaggagtggattaggtgctaacatttctctgatcaaggcaagttttctcctcccatcctttgaacacattgaatcccatgatttgaggaatgaaaatatttgtttgcaaagttgcatgtgaacttagactatattggtatttgaaattgggttaaggtagttatgacctatttgctgcataccccaccttgaataattgatcctcttgctatttgaacccctagaaatggttagagtacactctttgtgctcaaatgggtttatatatgctctatttgcaactacttgcttagccatgcttagaactatgcaaatgctcattccatctataattaaaatatgattttgatacatgaacctttgctggaataaaatgaatatgatgggtatttgcgaactaaaatgtgtaaaatgtgattttatacttgggcggcaagtggtgtgcatatggtgttagttgcataccgatagggggagtgtttgcccaagtccataaggaccgaacttgtgtcacccatttaaagttattcgtacatccacatgtgctagtatgggatggcctaagctgagtaatctatttaggactagccttgcattctggtaggccggtgtgtatgagttcgtataattcagaggggcttcctatttaccccgccgtggtagtttaggtgactaagcgtgtccaatacaacggtattgtgccacgtggtgggttcccgtcgtgtccgccaccacggcgttaagtttaaggcgtgggcccgccacttaacggttctaggtatattccaagtatgcctaggatggaggaacacgtatcgtgctggtgcaaggctaggctctaagtagtgtaaaggcttcgttatgacctctagatcacattcaaaatgaagagtgtggtggagtcttgcaaactcaaaacaaactagagagttcatatcatgtgggtaaagctgtacaaactctgcagagttttttaaactaatcgattagccgtgctcacggtcatgagcgctttggtgatgtgtcatgagtatagactatgttttaaaaatgtgatcatgtgacattggtttgaaattgatagatgtgttgagttgtgtgtgtgaggtgatatattatgacttattgtcaaaggatgacaacaagagattgattatgatggaattatgatgaatttaatattgaaacttaaaatttgttttgttaattgaagcatcaactcctttacaaaagaattgcgaaacaaaacttgctttatgctgaaaatgaactacatattgccttcctttgaatatatgccttacatgtagtatggtaggattgacttgtgcttgccagtacattaacttgtttaatgtactaactcttgctgttgatataaccttttatttgcaggtttagtcttagtctttgagtgatgcgggttccgattgtttcttctaggatgagaacttaatggggtaaacccctagtcggtgtgcttgtgattgggtaatcaagcttccgctgttctctaataagtctatttggccggtcggcctatgtaattattaagttgttgtaagtcttaagtttctttcatcttagttgtgtttgctatgtataatcatgcttaagatgaaagtgtggatctagtgcacattctgggaactagattcacatgagtatgagttaggaatatttgagaggttgtagatctttagccatttttgtcaagtctcctgaatgtgcaatacatctggtcgccgccttcgagtggtttgacgggcacatctcaggctgaagttgactggcaggctaagggcccagcaatgtctccaatattcctctctcgaggcgtcggatgtttcattatatttgtttgatgacttgaattattcacttcatctctcaaatataatggaaggtctggagagcctacgacatcagggagaatttttttcgaaatctctttgctctgaaaatcactaacatgacttaaagagtaaatatcataacaccggaggccgtgttgctaagtttaaaagtgtcaagactcctctaatagtagtttcttcctttgcccttggttgtgaattgtgcccaattcactcccctctcaatccgcggtttcgttttgcatggcgaaccgtatccgttttcgttcgcgggactgtttccgttcttttcctaaaacggcaccgcattgattttcctttttgggaaagtcctagttccctcctctttcttttttccctctccctctctagctagccgagcgcccctctccccctcccccgcgcgcgccgcccctcctcctgcggagtcgtcctcccaatcctactcccactaggattcaccctttcataatctaatcctcccctgtataagtaattcctccccttgttttttttccttttcccaaccaatagctctagtctccacccaagccgctgccgccttagcgccactgctgcccagcgctgtcaccgccgctggttgccatcaccgtcgtcgctgtagcgccgccggtactctgttctcctcgtcctttgatgtaattgcttctgcaatcatcaatctagcaacctaagtttttcccctttttgcctccctctagcgtcgtcgtcgatctcgggtgctgcccccggaaccgccgtcgctgccgtcgtcgtccttccccggtttttgctcctcggtgaggaatccctcctgtttttagggttttgcttccgtgtgtcgtagattaattgtctaaaccaaacaacacttttggtcaccgtacacacttcgtaatgacccggtgcaacgcacatgcacttttgctagtatattgtaaaatacccttctcaaaaaaatagacttggaagatttgctactccgtgcaggcagtggcggagccacatggtggtccgtgtgggccatggaccacagtaaaatctggcccaaatgcctattacccttgttctgatccaaacatagaaaagaacgatgcttttgtttcataagttgatttgctttatcgagttgttgttccggtttccgtccttcctagttcccatcctgactacgccatcgatcgtgcgagtgctgctttcataactcgacgactcaacgcttgggattgggggcccatgtccaatggcggcaacaggcgtctggcgactaggatcaagagcagtgttcagcaagcaggtatatcactatattagtttcggttcgattttgggaattccgattagaattggattgataaatccgttaaaacaatgcataatcctattgtagatttgttgaagcagttctatgttaatagtatattaacattaatagtgttcagaaaaattatgttaattaaattggaccaccctaatcctagctacaccactgcgtgcaggcaccgtcaattagttctatgttgtgattagggcttggtgagtggaattggattatttgctactcatcagcgtcatcggtgtttgcggccttggacaaggacaatgacggcaaggtttccgcgttcgagctgcgtggctgcatggtggtggagcttggcgaggacgtgttcgaggaggcggcggcgatcctcggaaaggctaaggggtgatcgatcgcccctagcgcggttcccccaccctccacgtaattttctttttcggcaccatattacttttctattttagtaaatttatgcacctaaagtttgtacatctcaagtttacacatataaagtttagagatccaaagtttataagttaaaagtttatatatctgattcaaatttgaatttgaattcaaatatttttatatatagtatttctatacatctaaagtttatacacctaaagtttatagatccaaagtttataagtcaaaagtttatatacccgatttcaaatttaaatttgaattatatccgatttcaaatttgaattgaattcaaatattttttatatatagtatttctatgcatctaaagtttatacacctaaagtttatagacccaaagtttataagtcaaaagtttacatacccgattcaaatttgaatttgaattcaaatattagtttatagacccaaagtttataagtcaaaaagtttacatacccgtttcaaatttgaatttgaattcaaatattttttatatatagtatctctatacataaattttttcaactttgtttttttattttttaaaaatgtatggtgtagtaagaagagaagagggggtaggaagggagagacagtagcttatagggggatggggggtgatcgcctggagcggtcacccgaccattagccgaacccggtgatcctcgctacggccgactacgacgacgacaggttgcggaaaagaatatattctttcactgatttgcgggttccacatggattttatttttttgtttcttctagtgccacgtcaatgccacttcatccaaaaccactctcaaaactgccttgcgacctaaagtgatccagttttacaagattatggatgcgctatatctggtatttcggtgtagggatgattttcaaactctgctacaagatgagagaccacaaatgaactttttccgaataagatagagcggggaacttaatgggctaataccaagtcaatgggccagatggtaacgggtcgacccgtcccggcccatgtgcaggccgtaccgttgcacggcacaccgttccgtaatctccctcaaatcgaaatcctatttgccccacttctcccctgtctcttcctcccacaactcccctcccgaaccctaaccctagctctccccccgcgccggcggcggccatggcgctcatcaccccagctagcggcgggggcggcggcggaggagacaaagccccaccgtccgcctccgacccgagcctcgggttcctcactaagcgcgacacggaggtgaagctgccccgggcgacgcgggtgaagaacaagacccccgcctcggtccagatcaccgcagagcagatcctccgggaggcgcgggagcggcaggagcccgagatccgcccgcccaagcagaagatcaccgactcaatcgagctctccgagtaccgcctccgccgccgcaaagagttcgaggacgtcatccgccgcgtccgatggaacgtcaacgcctgggtcaagtacgccaagtgggaggagcagcaacgggacttcgcccgcgcgcgctccgtctacgagcgcgccctcgacgtcgcccaccgcgaccatacgctctggctcaagtacgcagagttcgagatgcgcaacaggttcgtcaatcatgcccgcaacgtctgggaccgcgccgtttctctcctaccccgggtggaccagctgtggtacaagtacatccacatggaggagctacttggcgctgttgccaacgcccgccaggtgttcgagcgctggatggcctggcgtcctgacacagctggctggaactcgtacatcaaatttgagctgcgctatggtgaggtggagcgggcaagagctatttatgagcggtttgtggctgaacacccacgaccagatacgttcattcgatatgccaagtttgagatgaagcgtggagaagtggagcgcgcgcggcaggtgtaccagcgtgctgcagacctgctcgcagatgatgaggatgcccaggtgctgtttgtagcctttgctgagtttgaggaaaggtgccgggaggttgagcgtgcccgagctatatacaagtatgcacttgatagggtgcccaaaggccaggctgaggagctgtacaggaagttccttgcatttgaaaaacagtttggtgaccgtgaaggaattgaggatgccatcgtgggtaagaggagattccagtatgaggacgaggtgaggaagaaccctctcaattatgattcatggtttgattacattaggctggaggagagtgttgggaacaatgacaggatcagggaggtgtatgagagagccattgctaatatccccccagcagatgagaagcgttactggcaacgatacatttacctatggataaattatgctttgtatgaggagcttgatgcaaaggacgtggaacggaccagggaagtttacagcgagtgtctcaaattggttccacacaagaaattcacttttgccaagatgtggctcatggcagcccagtttgagataaggcaaaggaatcttaaagctgcacggcagatactcggaaatgccattgggatgtctccaaagggcaagatattcaaaaagtacattgagattgagttgtatcttggtaattttgaccgttgtaggactctctatgagaagtatattgaatggtctccagcaaactgttatgcctggaggaagtatgctgaattagagaagaaccttagtgagactgatcgtgctcgttccatatatgagcttgctattgctcagccagcccttgatacaccagaagttttgtggaaggtgtgttgttctttctgttatcctagtatatcctcttttttagggctttcaaactagaagtggtagatatgtatttcttatttctcttgttcctcaagtggtaaatggttctatagtgaaacgtatacaagcattgttttaatttctaaaatcagttgatttcatattgtagtgaactgttgaattgacattgtctgagacaccacccactcatcacataaaaactttttcctcgttttattggtattgctgtggcgcctaagcattccaacatttatattttataatgtatctgaatatccatagttcaacaatgtatgtattttcaatgtaaaaaagggacaattatattcaccattgaaaaatgttttgattatcaagttaaagaaccatcataacccatgcctactttttgaaaccatgccaattcaaaacacattctgtaaacaacagtagtgggatggttctacctaatacctataccaattcttctatggctgattctttggtcctaaaatacattttacttgataatattggttcatatctgctcatgttttgattaaaggttctgttcatttcatgaatacaaagcaaagttgatatttaccgatcagctttgtttctagatttcaatataatgctataatgtgtttgacatactagctagagagtagaaaataagcttgattggtatctttcttggttgttctccataatatggaaggtgtaacttttatgggcataatgggcatgctgcataactagtcccatttttcttgttttgaacactgaatcccaatatttatttcttttttgagatctaggctttgtgtgttgaagtgtgtattgttttaccattgatctttgcattattatattctggcactcaaaaaactgtggcgtgattgttatttgttgtctattcttcaatttctattctatcagatttacttcagcaaggctagaagcatatttctcttcaactatatgataatatctgctatttcacagcagtggcatattgatgtagttatattattcaatgtaagattttgacatacatgcttatttagaataagcatatctattttagatgcctcatttgcgtaaatcaggcggcactttttttggcattcttgtactcttttggttttttggctcttattcccccttgaaaggtgaagggctgaaccatgtgtatagtactaatgccggctaataggaaactcttttacgctcctttatggtcttgaatttcctcatcctttttttacttaggagaaaatgtgatggactatcaacattttacatttatgtccagaatacagagagcacattctgaaaatttgggccttctattaggaagtttttcaaatagttaggccctgctgtgatggtgaattaaaaaaaaggcagtttctttcagtaatttcactagaataattggaatatttagttactgcaggaataaggataaaattctctatacaaaactgtgcatgggcattgggccgtaaggcgcccatgggcagcccataccaggcaacttagatataagattattagttaggttagggataatacatcagtaagagttaaagataagactaggtcgagtccttacttaagagtccaattattccatctatataaggatgggaagtctattatcattaagcaatgatgaatatcacttagtctaatctctccctccccataatgttcttctccctagcctaaatctacatcccttctccaggagctgatgacgcacgtctatcttcctggctgtgggtatcctgtcatgacctcaggtcgtgacactgttatacatgttacaactgagagagccatcaagcaatggtcttagaaaatctacagatactgacttatttagtccatcctggagtttcatgtgtttatttgctatgtattcttaatcatttcctgttttgtatcttacaggagtacttgcagtttgaaattgatgaaaatgaattcgataggactcgcgaactatacgagagattgcttgatagaacaaaacatttgaaggtatggataagctataccgagtttgaggcctcggctggtttggctggggaagacggtgagagtgaggagattaagaaagaagttagttatcatgaacagcagatagaacgggttcgaaggtgccgaggtaattgagagcaaatttattcatgggtaattgaagttaggcaggtacctctgttccttttgtcattcaaagtgcaataaacctaacttatatttccttttttttttcaatttcagcaatctttgaaagagcattcgaatacttcagaactagtgctccagagttaaaggaggaaagagcaatgctccttgaagaatggcttaacaaggaggtgagctttggtgaccttggtgatgtcaccttagtgcagaaaaaggcgccaaggaaagtgaagagaaagagaccaattcctacagaggatggctccactgttgcgtatgttccttactcagttatttcattatgcta

SEQ ID NO: 60090 - DNA, 1948 bp, Oryza sativa
attcctgcagccccctgttttccatttaggttgcctgcaatttagggaacaaatgtattgatacaatattttgttaaccttaggtatgaagagtacattgattatattttccccgatgaggttgcgctggctccaaacctcaagatccttgaagcagcctataagtggaagaagcagaagacagatgatactgatgatgtctgagctaaactgccactgtttctgtggtcacgaatgagctaatcgttgtcaaaattagatctgaaggtcttctacaatgctgggtaaagttgtgaatgtgccctacctgatcatgtggtgtggtgctggcacttcgatcaattcagttttacatctgtatgtctgatggatagaaactgaaacaagttcatagtctttaatttagttttggcatgcatgatcttgtttcttgctcacgatatttgtctctaaggtccaaaataggagacggttgttccttttagttttcttttatttatacatcaataggtaggcagctccagccatattagtctaagaatggcgcattttgtgtaaagaagctgcctgtaaggtgcggttgtgtaccagtgagatggactgtgaaaacttgtcttgctgatggtatccaattttcctgagcgaggaccgaggagatagtgcatattaatctctctaaacgtcgtgggagcgctggagatttagagtgccatgtcatcgacttttttcagaaaaacccttgctctttccgctaatagtatgtgcatccctgttaacgtggcccgtcagatcacgtgctaaggtcgatctgaccgtccacgtgtcctagcctggctacccttccaccatcgtctgatcgacggtatggatttgccaaaaaccctagccacctcaaacctcgcgccactcaacgcgtagctcggccacccgacgttcttctcacccacgtcgcctcgcccttctctcctcgcgcgcgctgctgccttgccctcctcctgccgcaggcagcccggcctcgcctctctcggtctggtcgctgcagctaccaatgagggaggccagcctccccacagatggatcagaccgcccagatgaaagagatgtgagccgcctccaccttcttcttcgtccctcttggtgtagcgccagatccgttggcgggccatcgatggtttggtttcccaccggtggatccggttgctcggagccttggaagcgagggagcaagctgtcgctgccaccctctactactctccttctctgcacctccaccgcccctctccttctctcagctccaccaagtgttagattcggcttatagaggtcgccgggtttggtaggaggagaaggtaggagcggtgcagctgttggggagaaggaaggaggagggtcgcggcttggccattactgtgatgacgacggttgttgctcggtcaggtcgatggctagggatggcggcggctagcggcttggttaggacgatggtagggaatagcaagtcggcaatggctcagtctttgcttttcaatttatttttctttgggagaggaaacctgatattgacaggcaattaccgcgaaaataatgtcatcctgcctggatcacctggtgatgcttgtattggagtcacatcaaggagcccagagtaattccattctctctctatgcaatatgtgattcttaattcattgtgaatttgtctaattttatggatctctgaaatcccaatttgcatgtccaagatacacagacgaagcaagagctgttcatgaatgtgatttgagcaacatataacaggtaggttgtgttcagattcttttttacttagctcatatgggaaagacaaggtatgcttctttattctctcattggtacttaaaaaggatcagctttacctatttatacatgagtgcttgcagtactaatacaaatcattgccatgggttaa

SEQ ID NO: 60091 - DNA, 15581 bp, Oryza sativa
atattatatattgttagtttggtggaactatttcagtgattatcatatgtctgagatattatattgttgattgcacatttttgcaaatggctgaaacaattctatttttatttaattgctatgccttcgaaactacattattgtttcagactttctgaactttcttgcaagatatcagaagacttttagcattgcccacattcatataaatgttaataaatctatacatacatacatacatacatacatacatacatacatacatacatatatatatatatatatatatatatatatatatatatatatatatgtgtgtgtgtgtgtgtgtgtgtgtgtgtgtgtgtgtgtttagattcattaacatctatatgaatataggcaatgctagaaagtcttacattatgaaacggaggaagtagacaggagtgcgggttttgtttttgtaggcatacatgtcagttcatggagagccccatggacaaacaaagtctgtcctgcaaattctttgggtggctgtcgctgctccataattgactatgaacagcgattgcttgcaattgaggggttggctaaataattatctttttgccaacattgtgggaggaatttagagaccgccgaacagtttaacttgttcctgcattgcctcttttaggaaactggatgcctattaatagaggggatgagattcattattgtacacttgaggaagagagtgaataagaaagcatgtcactctaatatctttgtaaatgttatgcactctctctctctctagtactctcttgcgggaggggttgcactggttgtacaatagttatcatcatgatgttttattggaactagagcagctagttgtaccagttgagtttctagcatcttattaaatatcagctggttttagaaagcgaaagctaagccgtcagttgattaaagcacttattgacagttagcttcttgcttaaagcatcagtagttttagcttgggcaaaaacaagatctttcaagggaggttgattattaaaattaccgttgttgccattgcctccttggtagaacaggcagggctggttccacctgtggcctccttgcggacaatatctattgttattcatgaacattgcttcctcctcacgggtctcgagacagtctgtcccggaatgacctgcattctcgcagacctcacacgtgatgtacgagtccaaggccttgactgtgcctcagcttgttcttttcctagtcgtccaagcgcttcattaggaagtccagttttgcagctaggatttccatctccttgatggtatgcatgccacgggtctggagtcgttctttgctccagcccatgttcgagaccatcttctcaattaagtcgacggctcctctgatcgtctttgagaagaaggctactccagcagacgcgtccaaatggtcccgggacgagggggtgagtccattgtaaaaactcggcaggatcagccagtcgtccatcccatgatgaggacaggcggcaacgtactcttgcagcctttcccaggattccggaatggactcgtcccttctgctagaagcttgaaattctcccacgaagggcattggtcttgcccatcggaaagaactttgataggaatgccgtagagcattagttccaagtgtctatctttgcacggttggcataaaatcactgctttgctttcccatagagggaaaacggaaacagtctaagcctgccggtgtctgggctgacgcctttaatcgtgctcgtgctacagatatccaagaactgttgaagatgagcaccggcatgccatagaatgagcttgcctgtgccatcataatgaggctagtcttcaagtcaaagtcgccatctcctaagttgacgtgcggcccaatgggcacattgtcagcggagggagcaacgaactcacggagggtcttctcagccatgttcttgaagctcgatgacactgggatggttggtttctttgccgataatgttttctgcgaagggacaactcgcggtttgacaatcctaaagaaaacttctaggttgtcttggaagtttttcggcaaattgaaaccggtcatacactaccctgttttcacgacaaaagtgaaaacaaccaaggttagcctgcaaaggacaatgattatacataggtaaatataaagttattaccatataataatctcttaatcattaatcttccctagcaacggcgccagaaatgcttgttgatatttcttaacgacactactagaaatataattcctagcaatggcaccgaaaaattctttgtatattattgttgacggtcattatagaccaatttcgaccgtcaatataactaaaataaaggagaactagctatacttgcaatgcatatttgttttagaataatctatttctaattgtacttggattttattcgattgcagagattgctacacaaatgaaggagaatcgacaggaaaactaatgaatgatcaatcagacgctgttgagaagtaggcttatgagtaaatgggcctaaaaaaccagagaaataacctcaaaaggcccaaactccacatcactgaagtgaggagccaacagggagatggcctgcaaaaaactaggctagttgggccagcccaagcacctgctctgttggatgcagggtttggtgtggacgtttccgacctttccaaccatctcatagttcagctataaaagtacctcaccttctccactccaacacacactcaagcaagaagcacttgatctttctctcaagtttagtttagtactctagtgctagtagagtagaatagaatagttttttttttagtcctctagtctctaggagatttcgggtatggctctagcagtttttctctccttttgtaggacttgtcaaattaatagaatattcttctttatatatcttcggtattttactttatcttagtaccggctttattttatatttgtctcgatatagttgtgtgactagcttaccatagaggtgcaatggtgtgggtttaatgttcatgcaaatgattgctctatgtcattctagaggatatggagtagtatttaataatgtaaacatggtgcttagatttatcattatttgggcatatatggtgatagctcagtacgggtattcctctacgttagtatatattcctaagacactttccttgggtgggtactcctccgtatttgattctggtaggatggtcatgacaggttgtcgtaataaactccgtatttgatcccgattggatggtcatgacgggttgtcgtgagaaactcggcaatcagggttggtctctcaaaacaccaggaaggcactgttagggggtattggttgcatagctatatactagcaattgtaaactaaagatgcatatatactagaagtataggagtgatttgttttctatttcgttcttcacatagcctagatttatttaatatagcctagatttatttaatgagagtatgagtttttcttacatcgtgtcactctacccagcataaatgaattaacccctgcttagactataatgtatataagtaatatataaattattagcatagttctctcttataaatctttctcttgtgtcggaggatgtatataagtaatatataaattaaaattctcttgtgtcggaggatgtatataagtaatatataaattaaaccttctcttgtgtcggaggatgtatatgagtaatatataaattattagcatagttttctcttataaatctccccttgtgtcgtaggctcttcggatctcccattatatttgagagatgaagtgaataattgaagtcatcaaacaaacataatgaaatatccgacgcctcgagagaagaatattagagacattgctgagcctttagcctgctagtcaacttcagcctgagatgtacccattgaaccgctcgaagacgacgaccagatatgttacacattccgagacttgacaatggctaaagatctacaacatctaaaatattcttaattcatactgatgtgaatctagttcctagaatgtgcagtagattcacactttcatcttaagcatgaagatacatagcaaaatacatttaagacgaaagtgatttcaaattacaactacttaataattacaatggccgaccggccaaatataattatattagagaacatcggaagcttaactacccaaacacaagcacaccgactaggggtttaccccattaagttgaaatcctagaaaaagcagtcgaaacccgcatcactcaaattatgccaagtctattccctgtaaaacataagttagacaaatcatggcaagactcagtatattaatttgattaatgtactggcaagagcactatcaaacctgtatacatgaaagctctaagtcaaaggaaggctatttgtggttttaattttcagcataaagcaaattttagttcacaaaccatttgcaacgtaatttaagcaaaacatttaagaaatatgtaaagcataataatcatggcatggtcaacatatgtagataagcatcattcccttaccaatccgaaagtaaggcaatcatacttgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgcccggccccgagggccgaggcgccccgaccccttgtggagttagcgccacatgaatgggttgggtgaacacggtaagcctcacctaaccatatttattgcagtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttggagatggcacgttagccctggttagatttataccaggcttcatcccaaccattacaggcaagatgctacatgaagaagggcaaacatgcacgttgctaagctgacacgtggtggacaaggatgactgatttgtgaccggtctgacactggtcgcatcatcaacagacagccataatcccacgtcgcacctgtttccggcggaagtgggggtagatatgggccgtcccatcagaagggcacccggagaggaaccgtaccgatctccgtccatttatgaagagaagaacagtccagtttggagaggggcatgtggtatccccttgagatataaaaggaggaccttgcccacttagaaaaagagaggacttttggacacgaggccttggccagatccgatcccagagcaattgggggctggttgacactttgttacttgttcacacacaaatccaccaaaacacaggagtagggtattacgcttcccagcggcccgaacctgtatacatcgcccgtgtctcgtgtttcttcctagctggcgatctttccacataccgagagagcttgagatttcaccctaagcccccggccgaaccggcaaagggggcctgtgcggtctcccggtgaggagccacgagctccgtcatctggcgcgccaggtaggggatggtgagtcacttcgctcgtacattcagcggttttgccaagtccgcaataccataccatgcatccctgcacacgcggtgatctacgcgttcagggggggggtgtgcggcacaaccgcatgctcgaaaagatcgcttccaaagagccccagactaccgcggagctttttcagctcgcagaccgagtggctcgtaaggaggaagcatggacctggaacccctccggttccggagtggcagcttcggccgcccccggatccgccgctcagatagggcggcgtgacaggaggaggaagaagaggtcggtctattccggcgacgagggtcatgtcctcgccgtcgagggcgctccgcgggccacccgaaaggggaggcctgcgagcgacaaaaagaaagaggctggtactcccatcagggagcgcccagccggcaagtggtgctccgtccacaacacctccctccacgatctcgcggactgtcgcgcagtcaaaaacttggctgagcgaacaaggaagtgggaggaggacaggaggaaggaacgccgtgagggcaagtcgccggcaactccctccggtaaacggcgaagtgaggccaagcagaaggcccccgctgttgacatcgatgacggtgatgatgacctaggtttccaagaacctggggccaccattgccactgtcgatgggggagcgtgtgctcacatctctcgccggagcctcaaggccatgaagcgagagcttctggccgcggcccctactcatgaggcgacgcgccgggcgcagtggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgatgccggggcacacatggccgttgggtcacatcgacctaccggtcacctttggtggatcagccaacttccgcacggagcgggtgaacttcgatgtggcggacctcagtctgccctacaacgcgatcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcggaccacctcgctgctgcgtccaagcccgagggtggtgacgagaggcttggcacctccgcccccaccgccccgaggcagcggattgtcacatgcgccgaggtcccggtcaaggaggttgccctgggcgacggcccatccaagaccacacggattggtggtcttctggatggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttccaaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaagacgcgcaaccaagagactttgctcttagatctagcggaaacttttgaaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactaagttgaagacatatctcagctctcccccagttctagtcgccccggggccaaatgagcccctactactctacttagcggcgaccccccaagtagttagtgcagcgttggttgtggagcgcgatgaagacaatcctcatttcgcgcacccccgccctgtgctgacttggcccgggagcgagcagggaggagaagcccccgagtcgaacggtggcctaaggcccctgacgaccggagtcggccctctgcccgcttgtcagacggtgctgggtgcccccgaccctcaggaaggccccgaggccactgcgggaaggccgcacctatcgccctttggccccgaggctaaccttgtgctgactcgacccgggagaaagcagggagaagaggcccccgagccgaacggaggcctgaggcccctgacgaccggagtaggccctttgcccgcttgtccgacgacgccaggagcccccgacccccaggacggccccgaggccactgtgggaaggccgctcctgtcatcctccgaccccgaggtcatcggcacagaagacgagtgcgccccgagaggccacttggacgaagaacgccccggggatgcggcccctagcgaagaggatcggccccgccgaaaggtgcagcggcctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagaatggaccccggctccagagaccgtctcaatccccgaggccagcacggacccctctcagctgcctcacaccgcccactgggtgatgcagttcgacggttctctgtctctccagggcgccggtgcgggggtcacgttgacctctccgaacggagacgtcctcagatacttggtccgtctcgactttcgagcgactaataatatggcagagtacgagggactccttgccggactcagagtggcagctggactggggatccgccgcctcctggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatgattgccgacgaactctcacggctcgcgtcctcgcgagcccagaccccaccgggcgcctttgaagaaaggcttacccagccgtcagcgcgacccgaccccttaggggagacggatgcgcctgaccggcccccgaggcccgtcggagtccaggcctcgggacccgaagggagcgctccaagctcccttagattgattgcttggatctctgagatccaagcatacctcacagataagactctacctgaggaccgtgaagggagtgaacgcgtccaacgcatttccaaacgctacgtgctggtagaagggaccctctatcggcgcgcggctaatggaatcctcctgaagtgcattcctcaggaacaaggcgttgagcttcttgccgatatccatgaaggcaagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtacctgtatgtcgcgatcgacaagttcactaagtggcccgaggcttatccggtcgtcaagatcgataagcactctgcacttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcgtggatcgaggagttgccagcggtgctctgggcaaaccgaaccacaccaagccgagcaaccggggaaacgcctttcttcctcgtctacggcgcagaagcggttctcccatccgagctcaccctgaggtctcctcgggccaccatgtactgcgaagctgatcaagatcagcttcgcagagatgacctcgactacttggaagagcgaaggaggcgtgcggccctccgagccgcgcgctaccagcagagcctgcggcgctaccatcagcgccacgtccgggcccgatcactctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcactgagctgcctaacccgtggaacatcgaacaccttcgtcgcttctacccctgaggggggggtcgagtgtcaggttttggctcgggccaaccccgcacccccctcgggtgtgcagggttagccgggggctaccacgcatgcacattcttatttctcttatttcagcatttcaataaaagcagtttcaatttcctaaaggttgtgtctgtgccgttttttccttttgaagaatcttgacttgaaataaggtcactcgtactcaaccttgccctcgggggctcggttcggtcagctaaaatcgccaaacggggcccagaaccgagccgtgccccggggcgtggtgaacttcgggggggaatcggcaaaaacccacaatcgggtcacccataaccctcggtcaccacgttcccggcctggccagcctcgacatgtggatctccccaggcactagccccgacccgagccattagaggactgggacttgggcacgagcccttaaatcaagctaagacacaaaagaggaccacggcacagatcatcctcatctcatacgcatagcaaaataaaattgacacgaattttttcatcatttttgattgcagattaagttggtctatacaaaaaagaggcatgaaggccttagaagaaagaaaaagaaaaaactggagtctggagggggcctgggggctcagtccgatgcgcccgggtcgccggcctcgtcgtcacgatcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttgaagagcccaggccatcttcgtgaggtgcggagcgaggccttccaggtcggtggagtgcgtccttgtctggcctttccagaggcccgcttgccgaccggcgcgatccaggcgggagaccgcatcccaaagcatgccgggccctatttcgcccgccaagcggagggcctcggcttccccggcggatgagtctagcgcgcactgcatgtcggcgacggtgagttcggcagctgcgaggcgggcggctaagtcgctttcgcccgcagccgccccgctgatacgcgccctcgcgtccagctccttttcccgcgcctcgaggtcggcagcccgctgctccagtgcggctctctcggcgcggacggattccaaattgcggcgtgcctgctccgccaacgctgcctcacggagggaaaggctatccgccaaccgttgcgccgcggcctcggcctcttcgagagctcgctcccgctcagcgagtgcgtcctcgcggaggcggagcgcggactcctcttcggcgcaggcggcctcgtgcaccgccagcgttgtctcccggatagcggcggcggcctcgcggtccgccaagcccctctccacggcgccggcgtgttcctccaatgccatagcacgggcctcaagggcctcctcgcgccgccgggacgccgcttcgatctccgttgcccgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcggcctcccgctcctcctccacctctcgggcgatctctgccagcgccgctttgcgggcttcaagctccgagacgtgacggcggtgagccttacggcccacctccaccatgacatccaccgagcgctgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcggggcgacagaagacgaggggaagagccgccttggagagaatgcgacgcggctcggcccgccggaggacgcgctgggctcggggatgtcccccagacccgtttggtcctgggcgtcgcctggggaagtaggcccaagcgacgcgccagcagctttgtcgtgagctgcctcggaagacgccatcgcctcagcctgacgagcccgggcggcctcctccttagcagcttcttcggcttggcgagcccgggcggcctcctcccgagcggtatcctctgcatggcgagcccaagcggcctcccgggcggcctcttcagcttcccgaaggcgatctgcggcctctcgccggtcagattctcgcctccgttcctctgcggccgccggatcttcggcctcggactgaccggacttgggatggcgggaggaacgtgacgggacatcgctgaagcaaaagaaaaaaccagaagacaaacaagatgggtaagagaaaacttgcttttgggataaaagaaagacggtcgcaaagagagtgggacgaacctgcgagggggtcggttaaatgaccaccttggaggggaaatcaggtttccccgggatggttccgtctcccccatcttgcggagccgcttcttcttgcgctccccctcgggctgcgatgtcggcgcggccccctccgggtgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggtagattgttccccccggcggctctcgcccgcgccgtcgtggcccttaggagtttcctcctctgaggccccgacccccatcataatggtcagaatggaggcgcggtcgggatcgctgcaaagggggaggattccttgaggaatgagagacgcctccacggagctgagattcagcaccctttggaccacgatcttgaagtcctcgggagcccaatcccatctgactccctggtgggtccgcatgtagtcttcggacccggtgtactcccaggcgccccgggcgcgccgttggagcggcgcaatccggcgacggaggtagtcgccgtacaccatggcccctgtgagcccctgggatcgcaggcccgccaggcggtcgaggacggcgtcatagtcatcccccagatctaccggcgcccgccagctggagacctgcgccgggggctgacttggaagtcggaggcgcgcttcgttggcgaggggggtgtagaaccagtcgctcttccagtcgtcccacttcttgcggagggcgcaggggatgtagcggttcaacaccggcccccgcggctggaagtagcagccaccaaccaccgacggcggcgacaccgactgcacggtgaagaaccaccggaacagccgaagagatgggcgcaccccaatgaacatctcgcacaggtgcgcgaagatggccaatgtcatcactgcattgggggtgaggtgcgccatctggagatcgtagaaatccagaacatccataaagaaagaagaaaatggcggaaccagccctgccattgcgaaggggaggaagaagacggaccgccccgggtagtctggtgccgggcgtccctcgcccagcatcactatctcccggccggtggcagattccggcataaagcggcgcggcagcccggcgtgcctctcgctcacgatgcgagaaggcggaagtacgcttccgtcgagcagagcggaaccccgtgccatggcgccggaggaagggatgattgagaacgagcgcgtgtggcgaaggaaaggcgcagcagagaaagagttagagctcaagcagcgaaggcaaggggaatagtggcgaaaggaagggagcaaatcctttcctcggtgtctttatacctttgccatcgctgtgcccggctcctcgtttctcgcgcccactatctcgctccctcgtttctcactatctcgctccctcgtttctcgtgcccacgcttccactaatcctattcgcctgcttgcggcgcatgaggtggatatgcggttgtggcagtcgagatagatcgtatcgtgcgcgcgttaattacgctcgccgaccgaagcaacgttaccatatctccaggcgaagcaaatcggctcacccagattcgtacgtcgctcaagtaatgtggcagtcttgaagagaccgcccattatggacagccaagtcaccgttaccgatgtacatgatttgagaccgttgggtttctgcccaaccatggagaccggtcccacctgtcaccaagctttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgcccggccccgagggccgaggcgccccgaccccttgtggagttagcgccacatgaatgggttgggtgaacacggtaagcctcacctaaccatatttattgcagtctggtcgaacgtgtcacgctgcatgcagcgtag

SEQ ID NO: 60092 - DNA, 3318 bp, Oryza sativa
ggcccgaacctgtatacatcgcccgtgtctcgtgtttcttcctagctggcgatctttccacataccgagagagcttgagatttcaccctaagcccccggccgaaccggcaaaggggggcctgtgcggtctcccggtgaggagccacgagctccgtcaatactacttatatataacaatctcatcatcattctcaaacatttagttccaaaagcatttagaaatcacaagattatacccatagtataccatcatgccactgatgatcgtgagcatggctaatcgattagtttttagaactctgcaaagtttgtatagctttacccacatgatatgaacactctagtttgtttcgagtttgcaaggctctaccacattctacacgttgaatgtggtctagaggtcataacgaggcttttacattaagtattatctaaccttgcatgagcacgatacatgtttccccatcctaggcatacttggaatatgacctagaaccgttaagtggcggggccacgctttaaacataatgctgtggtggtgaacatcgaacggaccccaccacgtggcacaataccgtagtattggaaagacatagacgcccattccgtgaggcagaacattacactcgtcccctcacggaaaatacacacgtagggaatttatcatcgtacgatcacacacacatatgggtagtttctataggtagcccagcatacactcgtgaccgctacctctactacaacggcctcccaaatgcaaggctagacaagtgtttaacttaataggccaaggtcccccatagacacatgtggatgtacggtaaacataatgggtgatatgatgtttggtccttaatcgactcaggcgaacactccccctatcggtatgcaactactaccatatgcataccacttgccgcccaagtctaaaaatcacattttatctcatttgatttcacaaataatcagagattcacctctgtccataatattcaaaaaagccttaaaaaaagtatagtaagtgacccataaccatgtttttactttttatttatcactaaccatttgcactttataaacacatagtatagtcatatgagcacaaataaagtactctaattaatcctaaggttcaaaacagtaagggagtgattttaaaaaggggattcatgcatctttaggacataactacaacttatagtttttgaaagtttcgatagttagaaatacacgtgcaactttacaaacaaaacatttagcccgaaaacataggattcaatatgttcaaagtaagggaaaaacttgccttggttgacatatgacctccctaagattaattataattcatctccttcaccggtattgatttcatacttttaaagaaaataatggtaatgataaataccaaaacatgtaaaaattccaaatgctcgaagatgcatgatttgtgcacagttggtaggttctggtctaaaatgaatttaggtgaaataatttctattttatcactttttatttgggatttacgaattttagaagttacatcgatatagtgtagtattggcttaggtagcattatgaaatttttttccatgtgaattttattagatttaacttcacagaggtgtggtggtgttttttctaagactatacatttggttttacaatttttgaagttataatgattttcttatgaattttacaagttataatgtgttgtaggcatataatgttctacatgtacatgtcttggaagttgggagttttatatccagaacatgttacttattgattgagttgagtaaaaggaataatttggttaactaaaccatttttaattcataagtttatggtcttatcatggttcatactttataaactaggggtgctctagtctatgctagcaatacattatattaaccttgaaattattatataagctaagtgcattaagttttggtgggagaggttggagttatattttctctggtccatctaggatccatttggtttatttggagtttggatgtattttatataatttgcttaacttgtagtatgtgattagcatctagtttatcaatttaaagtttagagatatatttagtacggaaggtgccatattctattttactgggatgaagctcacttcttgctggttacatatatacttggttcactccatttggattaaatatgaattttctaaaaaattttacaagttaatgtgtgctctatgttgattatctcctcacattaaagtttaggagattttcatgtactgtgaatgtgtattcttaatttatatcattgaagtgcataatttttgtgattctacagaacttgagttcatctaaaaaggagttgagacaaattttatttgaatttctaatgttcagcttatccaaaactaatcattttgtagataatatttttgtaggcatttgatgtaaagtatgtatactattttattttactttatagaagaaaataagtcggtggatctgtagaaactgatttttattcattttgagttgtaatgaattttctatgcattttataaatttgtgcaagttttatgtgtgattttacttagatgaattttagaggaaacgtttgtacagtgagtgcaagtttttatgccataacattaaagttaatgatttgttgagttcacagaaatttgatttaatccaaaatgagttgttttcaatttgttatggattttgtaaatttacatgtctttctgttgaaaatataaagctttaggcatttcatttagatttttctagaaatatgcaaaaagacccctaaagttcgaagggaatagaccccgcggtcctgtgactgttctctgtgtgagcgaatgtttacaaaatagcacctagagttttgattcttctcagtagaggtccctgcgacctgtacaggggtggcatgaatggccggcggccatatttgggttcgccggtggcgaacggtggccgatatcgccatgtgtccaaaatagaaaatgtatctaaggtctagagcacccgtttgtagttgaatcacggctgatggtgaccaaatttgattgtagcggtggcgcaagcggcggcggctctcggggtgatggtgaatgtgaaggtagagcatcgatctagatgttttgctacatgcatgtgcctctatgggatcctaggatgcttaccgtgcgtccaatgaaacttggcgaggtgttggtagcggtgaccatgcgcagaacggttcggcgacggcggggagcttcgggtgaacggcgacgactcgatgccctcaaagaactgccatacaggt

SEQ ID NO: 60093 - DNA, 7043 bp, Oryza sativa
taaattatatcaaaattacagtgagttgtatgtgttgattagagcctatatgaattttcccaagattttatcttgcacgaattattttatataattagcaagaattatatatatatatatatatatatatatatatatatatatatataaacttacttttttccaatctttttcaaaaaatctattcatgctttttttatccagtttcgattattctcctcaaaggattctatcttaaaatatatatatatatatatatatatatatatatatatatatatatatatatatatatatatatatatatatatatatataaaagagagagaggacggctcttcagtacacctaggtgtatgtactcctcctttttaatggattatccattagcaaatcactgcatgcatgtgcacagttgctcaccggatttggtgcacatttgaacgagagcgttggcatgcaattgctttcacccctcccctagaataactattctacacccccctctccctcaactcccgatccagcccagcccacccctccttccccccagtccccacgcgcgcccccctccctcccggtgaccccaccctgtcctggcgcgcgtcccctcctccctccattagctccctcccggttcccagcgaccccacggccccacccactcccggcgcgcgcgccttacctccttcctctcgatctctcgcccgatctctccttcctctcgatctctccctgatctctccctcctttttttcttctccctcccttctcttatttttcctcctattcttttcttttcttcttctccctcccttctcttatttttcctcctattcttttcttttttagaaaaaataaaaataaattgctgaattcaagactagaacccatgatctcatggttcataacaaactctcctaatcaattcaccttacaacactttgtgatttaagatcattgttttctttctctatatatctactcaaattttatgaacacaaacccgttatgttattgtaggaaatcataccttgttattatgattcggtagtaacattattgtagaactgcagtaacacgatacattactgtgaaaattataggccgttactgcaaaattcataggtcgttactgcactttttgcagtaacatcatgatgaaattgcagtaacagagaacatatggtatactactacagtaccactacttgcgcatagctaaatttttaaatctcaatcttatacaaaatacaagtgctaaaaaagtgtatttgcatggtcacaagttaacacaagtgctaaaagtacttctctttatccatacaaagatacaaagatacgtagtagcaagcttagtacaagtgaacttttagaattgaagtctttaaacaataatatctctcacatcgtaaattattttttagaaccgttttcaccataatgctttaaaatgatgttacaacgagacaatagtcctattactacacgatgatcgagacaaaaatgcttttataacgttgttactacggaaagtagtcgtgttactgcatattgatcgtcgcgttactacgccgttccaacgagacgagaactgaaaaaaagtaaatctcaatctttaaatagcaatatctctcacgttatatagtatttttctaatccatctgcactatgatgttcgtaaaaaaatacttaacaaaactagatccatcatgactattttttgatgttgttactgcgagaaagttgtcctgttactgcatgatgaccgttatgttactgcggatttcctgcgagacgtgaacagcaaagtggtgggcgggggagggagtcaatgggcggtttgactcgggtttgaccgtcggaaggaggcattgaccagcctttgactgagatgggagggagatttgggccctacgaatggtgggggaggtgggattggctacacacaccgccgcgcgctagaaaactttgtagcgctactcacgatagtctccacatccggttttcccgttcctctctgctcccacgcgtgcccgatctcggtgaaaaaattactctcccctgtccccaccgagcgtgatttctgtttctgttttgacatgagattcaattccccaccgagcgtgatttccgtctgttttgacgtgagattcatcttcctgatccacacgtggcaccatggtccccacgtgtgctccccaaatttcttttttcatcattgttgcatggtcagtaaattaattcccagcaaaaatatacctcggtaaaattttcactccctatatattagctactcggtaaatctctctaaactcagtaaaatttttactctcatacagttctcagaaattcttctgctcacatatattttacgagttctcgtagtaatatttttactcggatatatttttctcgtagtaaaattttttctagtacatcctcgtagtaatatttttactcgtgttattgtagtaaaaattttactcttgtattttcattgttattacatcattaatcacagcaaatatttgaactaatactattttaccatacatatagttacatcgttacatcgtattagccactgtacgggtaaaaaaaaatgaagagagcaaacaagaaacacgttctgagcaagaggccatgaccagttcccccgccggtagccgatggacctcgtcgccatcgcctgaccaccaccggatatacggcagcgccacctctgccaccgtaccgcatgaccgcatccctcctacacaggcaccaaacgaccaagggcacgtggaaaacgaggagatcaccaccgttcaccaccagtccaccacgtccgccttctatccagggtctgaccgctgcctagctcctcccggccggtgctgctgcaggagatgcacgatggaggcatcggcattgtcgtgcttgtccccgaagcagaaattttccccggagcggcgattgtccccggatgccgccgatgccctgcccggcatggtggccctcctccccgaggtgtgacgctccgttgggtctgggcgccgctgtcggccaccacgccgcctccctcccacgggacacgcagaagatgaggagatcgccgccggctgccgactccacgccggatcctgccgcccaccaccccaacgccgatggacgcctcgtcccgcgtggtgcctctcctccgctgcccctctagatccggagaaatcggaggaggtgggtgaaatgttttggaatataccgtactgtacaaatgtgtgtatatataggcaggtatattagtgttaaaaaattactactaataagttggataacatcaaataaaaaatttactcagactatgggagtaaggggaggaggcgcacgggtgggatcgagattggtcatcggtgagttaaattttaactgcgcactatagatctagtggggagctgtatcaggtgccgtttaatatgtagcgaattagggtgatatatatatatatatctcccccccccctactaccaggtgtagctactccaatggtccgttcaatcgttaggatgtgcactgtttttttataataacgggtctaatcgagttcaatggtctaacccgattcatttaagcacgtctaattttctgaccaatcgtttaatatttatattattcgtggcatttgaaaattgaatgaacctatccgagtttgttagctttggagtaactaaccagatatttacccggcctcttcgaacgtattttggacgtaatttctagaatatgttctgctctttgaacgaattgttcttcagtagtttcgttacagagacaagacgagcaattgcacatcacaatcagttccaaggtatcagacagaaatcataccaattttattatactgaccaacaagcagatgatacatatgctctactcaaatctcactatctcagttgcctttcaatgacataatttaaaatatcctactacatacaactactcgaacactgaactacaaactataagcaggcattcagaaagaacgctactatttggaaattttcctttgattggctcggtgtctacatgggttcttcattggcaaatggtcatgtgctttaacgctacaccggatggaatcgcgcctagcaaaagacaccgcttgaaatacaaatatctagcaatgaacaccatgtccatctcttctcagccttacttgaatctgctgctatatatctgaacagcacgatcgatcatatctctcctgtaacaagttgccagaccaccagcagagaactatccctaagatttgaacagaacacgcttcgttacaaactgctgagagaactggaacaaaaaaattgacagactgaacgcatatccattggctcctctacgaccacatgcacctgcgtcaagaacctgctgccgtccctcacctggttctgctccaaagcagaaaccagcagaaaccaccgaatatgtttctgcttcctccttgcatggtttcttcaccatcgacttcagagcattctttttcgacgatattctgacagaaccaagaacaagaaatttaacagaacgtacacgtgccaaattggaacctccacgatcactatagcgcctgcgtcgagaaccttctgctgtccctcaccgccagccagagcagaaaccgttgtcgatgtttctgcttactcatcgagttgtttctgctccatcaacttcagaggaaaattagtgcttacccgacgatattctgacagaaccaacaacaaaacaattttgacagaacgtacacataccaaattggatcctctagcggctgcgtcgagaaccttctgctgtccctcgccgaaccaccggccacagcagaaactgccgacgatgtttctcctccgtcctccaacgggtttcgctccatcaatgcttgccgacgatactgtgccgcagaacgccagctgcttctgctctacacgactactcgccggcgatgttgtgccaccgcgcaccctctgtttctgcttctgctcttgtggtatgttgagtaccaacgatacctccgggtcaaacgggcttgcattcatgcagaaaatgcaccggataaagctcgtgcagttgattgattttttttttcaaaacttcaaatttaatattttattttaatttctgccgcctataggtcagtgaatactttctgcttttggtgagtgatacaggacccgaacccggtaagtgggacacgtgttggatgtctattgcaggagtagctactctcgggagtagtatataggcttcatatatatatatatatatatatatatatatatatatatatacacacactcaagggccacacccacctccccattcttttcaaggcccaaaaaccacctctcactgcggtcaaacgccggtcacagcccctcccgccggtcaaagctcagtcaaacccgcctactaactcccctcaccacccatctcttctcagctctcgtctcgcgaaactgtgcagtaacgcgacggtcaccgtgtagtaacactatgttttacgtgcagtaacaacgctcaaatatagttgaaatatagtcatgatggatctacttttgataagtatttttttctagcatcatggtgcaaacaattttaaaaaaccatacatgacatcaaagatattgttcttaaaagcttttctttttggaatttgactctccacaagtagtaatacaatagcattacttgttactactgtacgttactacagttctatcacaacgttactataagagtctagtaaagacaataagctttgcagtaacaaagtgtcttgcatttcttgaatagtattactacataaagtaggaattgaaacaaaaatatatgggttaaagcctcacatgctaaccatatatttgttactacacataagtagaagtgttactacataataggtgcatgttaccacttctaagtagctatgttactgcatgataaatgcagtgttactatgtcatttttacgagatgaagatcgaataggtgagccataggtaaagtttgtaggtggctttgagcaaggtctgattgatgtaggagtgttttgaacaattttatacatttggtaaaaccatgttactgcatgtatatacccttgttactataaattacacattctgttactgcatgtggagggctaaagttcaaaatgtcaatatttgaaaagcaatatctcacaagatatgtattattttttaaaaccgtttccaccatgatgctatagtgttactgcatatggaggattaaactttaaaatgcatctacgtactcccctcctcaagaaccgttcttcctccctcttctcaaaaaaattggtctcctccctccaatatagtgttactgcatgtatatgacgttattgcacttttgaccgtaatattgtggtgaattgcaataatttaggaattgaaacaaaaatatatgggttaaaagtcttagagctaaccatatacttgttactgcacaaaagtctgcacaaaagtaaaagtgttattgcacgacaattacacgttaccacgtgtttatgcagtaacactactcaaaaaatgtagttagacgctttgttactgcaaaacttatagtcttgtagtaacgttatcgacactatgttatgtgaaacttataatcgttactacatcttgtagtaatgacatgatgtgattgcagtaacgcaaaacaggcagtagtaaaacttttgatatagtattactactagtggagagttaaatcttcgaaaacaaatctttgaagggtaatatctctcacaccatgtactatttttaaaaactgtttgcaccatgatgttaaaaaaaatgtttaccaaaagtagatccatcatgagtatattatgactaaattttaattttgttactgcaagtaaaacattgtgttactacacgatgaacaacacgttactatgtcattccgagacgagagctaagaagagagagggtggtggggaaagtcaccgacgggtttcacactcatatggggcaccatcatggtgcccgggca

SEQ ID NO: 60094 - DNA, 2948 bp, Oryza sativa
  unsure (1)..(2948): unsure at all n locations
accccccctacccttctcattccgtatccctccctccctccttcagtcgctccccctccctccctcccgatcctctctctctctcttcccctccctcctcccgccctcccgatccccctcccgccttctctctcgatccccctcccgatctctctttctttttttcccttttttctgttttttttcttcctgaaacattttttctcttttctagaaaaataaaaaataaattgctaaattcaagacttgaacccatgaccttatagttcaaagcacattcttctaaccaattcatctaatgattctatttgtttcaagaattttgtgagaaagtaatatgattatcaattctaatatcttttactaccgaaactcataacatgttactatgctcgaatagtaatattgttataaaagtacagtaatacgtgacgttgttgtagaacacataggatattactgcacttttggcagtaacgtcgtagtaaaattgtagtagatcaggaatcgaaacaaaaatatatgggttataaccatatacttgttactgcacaaaagttgaagtgttactacataataggtgcatgttaccactttcaagtagttatgttactgcacggtagttttactatgtcagttttacgagatgaagatcgaataggtgggctataggtaaagtctataggtggctttgagtgaggtctgattgatgtaggagtgttttgaacaattttatacatttggtaaaactatgttactgcgtatatatacccatgttactgtaaattacatattctgttactgcatatggagtgttaaagttcaaaaatgccaatatttgaaaagcaatatctcacaagatatgtattattttttaaaaccgttttcacaatgatgctatagtattactgcatgtggaggatagaacttgaaaatgcatctacatatttccctcctcaagaaaccgttcttcctccctcttcttaagaaaaccggtcttctccctctaatatagttttactgcatgcatgtatatgacgttactgcacttttgacagtaaatcaggaattgaaacaaaaaatatatgggttcaaagtctcatatactaactatatacttgttactgcacaaaagtaaaagtgttactgcacggcatatacacgttaccacctgacagttacacattaccgcatgtttatgcagtaacactatccaagaactacagtaaagcactttgttactgtagaacatacagaacgttactgcatatttggcagtaacatcgtggtgaaattgtagtaaactagaaataaaaaaaaatatggattaaaacacacgagtaaaccgagccaattccccatattcttgtagtaatgttatcaagtaattgcagtaacacactatgttaatatgaaacttataatcattactacattttgtagtaacgacatgatgtgattgcagtaacgcaaaacatgcactagtaacacttttgatatactattattgtttgtggagagttaaaattttaaaaacaaatctttgaagggcaatatctctcatatcatgtactacttttaaaaaccgtttgcatcatgatgttcgaaaaaaagtgattatcaaaagtagatccatcatgactatattatgactgaatttcaattctgttactgcaagtaaaaacacggtgttactgcacgatgaacaagatgttactacgtcgttcccggacgagagctaagaagagagggggtggtggggaaagtcactgccggtttgaccgagatttgaccgacgtgggggacctttgactagcctttgactgaagtgggaggtgggttttgggcccttagaaggagatgaggtggtttagagggagggggggtatagaatagctattctatatccgggtgtagaatagtttatatatatataatgcacaaaattactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggctccatggctatccaccatccaaatgttttaagatccgtgcaacgcactagtggataacatattaatattagcgggtctaacccaataaaatattgcatgcacatactttacatatccatttttaaagtattgcgtgcatgtgtttgcaaatttagtatcctcaccaatcatgcgaggcactttccattttctatatccaatttttcgaaatattacgtgcaagtgtttccaaatttcgtgccctataatcatgcccaccaattataatgagcactttctattttctatcacattttccatacaatgtttgcatgcagatactacctattgaaacatgaaacatgattcttgaaaaatgatgacatctaatcatgtccgctaatttcaattattaccttccattttcatggttactttccattttctatatacatatataaccggcgacggtattccatattttgatttttcttggctacgctggtaggctcacggtcgaagagctatccaccaaacaccactgagctacctcgctgacgacatttgctcgcaagctctgtgatcttcatcgccacgctgtgaagagggcggacggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60095 - DNA, 1293 bp, Oryza sativa
taaaaattcaaacaatctcctatcgggctcatcttctccaattttctgagaacaaactacacataattttttagtgcaataaaataaaatggaaactatgtacattcacctacctccagtaaaatccacatgaatttatctacaccacaaattaatctatgaattaacaaatatggggaagagaaataatcctggaaataaatgaaaaacgtctttcactcatgttcctacccatctagggatgataattttacccatggcttcgggtatccgtggatacccgacccgatggtcatgggcgtgggtgtgacattttacccatggacacgcctgctcgagacccgaagacatcatgggtaatagccgggtttcattttttacccgtgggtaacccatgccccacccgatacatatgtattagctaattttgactcatttcttaactcttataccatttctcttggttcatttgagatgctaactgatactaagttgtgatgtaattcaaattattgttgataaacgataatttggtaaattattaattttatttctctttgttaaattacatatctttcaaattattattcatgtgagattcattgggtaccagccggacatacccgcgcccgccgggcatgggtacgggcacggagttttgcccgctaactctagtgggtagggtacgggcgggcaatgtcgggcattgggtcggccgacccgacccattgccatccctatacccatccctcacacccacacctagcaaccatcgccctggacccacctttcatcgtccctatgtcaccccatctctgtgtctattccccagccgaccaagatacaccgagggaaagagagagcgaggaggaagcggtgccgaccggcactggacgcgcgcgacgcatggcctcgacgtggcaacgccgagccgagtcttcatctcctcccagctgcatcgctcattcccattcctcactctagtgccgaccaaaccgagagcgaatgacctcagcctctccgacgccttatctccgctgccggctgcgaagaaagacgaccccgccaattgtcgtcatgccgtcgtcgttgctatattttccctgatccatgatctcctctcgacgccggttccatcccttctggcctagccctctatcgtgcagtgagcgcacgggaacgcggacctcgccgacaatgctctggagcacgcactggacgccgccatcgggacatcgtcttcgtcgacgtcgaaccggagcaagccgagctgagccaccgcgccataaacat

SEQ ID NO: 60096 - DNA, 915 bp, Oryza sativa
tttaaatagatggggtccctagagtggtgaagatggaccctagagtttttgaaatcaacccgcgcaagtgtggatttcagtttttttaagagtctcaaatttcaaggtatttgctgatagatccaggtcccagaacacatttacagtttgaaccttgcatgtttgaaacttttgctgagtgaaatccctgggtgctaatcatgagggtgaggtagaggctgggaacatagcattgccccgatgagtttctcgctggtgccgtcagggaaccatggctcagttgggagcgaccaaaagagaatttgtagaagggcctgcgacgaagctattattggttggcgcgatggctagggtggtcggaatgggtggtggcggcggtgcgagtggtgaagatcctcggggtggtgatgcatgtgaggctagagactgatttagcttaagagggtgcatgcatgtgggttcttgggtcctttgaaggctcaccgagcagttggggagaggtggcgaagcttggtcatcgatgtcggcttgcggaacatctcggtggcagcgcttcacttcgagatgttgggtcccaaaattaaagatttggtcttaactgatgcgtctaaactgtatcaagccctggattggtagattgatacaggttcaataatctggatcatcattgcatacatttgaacaaggctccaaaggagattttattacagaatataagggtatttacaaaactgtggctaattcctttgctagataacttaatcggctaggtctatacccactcgagaattgccgtcgtactcattcgttcttcacatgtacttggcaaaccctatgtcaatccaaaaagtactagcaacccggaaatctttctagcgtattgttccaatctaagttcattatattttatacaaa

SEQ ID NO: 60097 - DNA, 6762 bp, Oryza sativa
aatttaacttcaagcttttcatctggtagcaacacatgagtatattttcacaattacatcgcatagagtacaagataatacaattctgtgtcatgattcggatgtgttgtctgctcaattccactttttttaggtttatctactttaagaaaataaaaatttttccgttcatcacacaaatttcgatccgtcgtctcctgctcaaaagcaatcacgttgttcgctcatttgttcctcccatattctaaaactatcaggcctcgtgtcacaagcatcgtccacatcccgcaaaatataaggcagattaattgtccaagaacaaaaatgactttttggtcattatacacattgctgatgcctatgattatgcttgggtgtttcgataaataattgagatcaacttcagccacccatcattacccggtgcatcgcacaggcattttgctagtaaggaaaatactaaaatatactgtttatgggcccacatgttagttttctttttctctttcttctctcgtctttttcctctcaccttagtccatctcttccttctgccgagcaacataggggaggtatagaggagggcacctgtgctccggtggccggggattggtgacgtcggtggcggatgatgttcccgagcgacacgcatctagggagggtggtggctggtagagagagatggttggaaaggcgaggacaaagcttggtctggctaggagagaaacctccggtagggcttgatacgggatgaaagtgttgatgtgaaaacacgaggcctgggagatctgcttaactccagtgcaggtccaaaactcgcattcgggtatgttagcgtgccagttgatttgatcctgcaatcaacaagaaacaaagacaaagaaaccgcggttaaatccataaacgatagccgatcggctaggtgccgatgacatatcatttatctttgagccgatgtcatatatgcatcgatcagcaggcattaataaacaagacagaactaaatctactcgatcggctgtagatattaacgatatataatccttatatcgatatatacttaaatcaagtgattgggatatatcggtcgccatgccgagacaatataaatcacttagatcaaaatatatattaataatgagattatatatatttatagcgtagccgatcagatagatctagcatgtatcggctaatactccgataccactctatactaagatatcaaagcaagtaaaatatatcaaacaaaagcctaatatacttatatgcaacaagatcttaacataaagggcagatttaacatatcaacgaagcatataaggtaaatatagttaaatcaggtaagatcggctgaaaccctgatactaccctaatcggcaaccaagaagcaggctagagattgagattctaatcacgactcataagatcaaactcaactgatgcatcattaagtatgacaagaaggacaatatctagacaatcaagccgctgggagtttcatagagtggtagatatcttatataatctaaatcaacgtcaaaatctaacctaatcggctgccctctactaatagatgttagccgattgtaggttagatagcgatattgccagagattatgtaagatatatgataactcgacgaattacataaacaagattagagtatcataaagatggaagcactaatcccgagaacgcaagccgccataacaagttttacctcttgttgaagatcgaaaccgatgcagctcaacccgaaagcaagaactcgttgaaacaaaacaaaagcaaaaagggtggcgatgcgccgagattgtattgaacgtgtgttagtttgattacatggggctcggggtctatttatacccgagattacaaaacatgtccatatcggacacgactcctatctctaacaaactctaagataccataagtctttgcggcagacttttgcccaagcatatctctaaggaaattacataaaacatcctaattaatagatacaattgccttctcaggactctatccatacgtggcaatcctcatgaagcacatcaacccaacccaacaacatatgccgtgtcatattgtcagattcggctcaatcggctaaccttgtccaactcggactctgccgatcttggcaacagccgattcggacattaaccgatcctctctctgtttccggagcaatctctatctcgaactccgcttcaattccatcttcttctccgatacttggattaccaaatttggttgttaacagaaagagaagggtaaaagtagaaaaatgggttcgtcggagtagagatatgctaatggtgcgaggctttggtgtgaggggagccggtggaggagattggcatggccggcatgggaaagagaagaaagctcaaagagctcagttgtggataaaatatggggagctcgtgtcttatataggcggcggctaatggcggtttggaggagaagggcgacgaggacatgatagcgattggcgccgactcttgtccgtgattggctggcctgcccggccatggcggtttggcctggtggcaggcgtcggtgggagcagaacagcgggtggccggcagcacgcccatggcgcacggtggcggcacccactgggatgacgagcgtctgcctctactcggctaggctggctagctaggtcgacttgggccgaagggagacagggtggccggttagggttaggaaatgaagatgggccgagagaagagggaaaaggatttcggcccaaaggaattgttcgtgaatttgaataattttgatttgcataggatttgtatttgaagtgaatttgaataggagattttttaagggaatttatatttgggataattttcagaatgggtatttttcaactttatttgagtgcaacattttagaggtggaatttgagggaatttatttggaagcactcaaataagaaataggaatattttgcactatgagtagtagagctcctaatttggatatatttttgggaatgtggtagaaaatatatgaatgcagataaataggatttttcccccaaaaaataggtggcatggatttagagaaatattttgtggctaatatggatttagaaaaatttggagtttttggaagggatggattgaaagttattttcttaggacaagagctgaagagcaattattctaatatttataatattgctattcttgtgctggggagacttagtttctggaaattagaattggaggctagatcaaaataggagcttcacgaaagaatatatgatagaatattttagatggagaagaactaaggagtttcagcgatgggtctagatggagagtttgatcgaggattaattccagaaataattggcactgtgtcggtctagtttgaaaggtaatattagatgatttcttggaccataatcaataaagtaaaagaagttttcaaataaattgaataaagaaattttagtcgaaataaggtttaaaattcaaaaataaaatccaatctggaaatacctcaatttactaagatatatttttaaatgaaaaccacaaaaaaaattaaataccaaaaattttttgtgtaagttagttttaggaggttacctataattatattttcctaggtttaggaagttattaaaaaataagaatcaacatgatgcaggattagaaaatagttaattttcacgatgttacatgcgaacagcacgaacgggtcgacgatctgccaaagcgaggcatgtatgagggtggtgaggtcatagagacatcaaatgtacagggaatcaaacaatggctcaacggcatagacggaatcgatgatggaggtggcagccggtgacgaggaagacggtggctgatcaacgcatttacttgatctttggccgtggtccttggccaggacaatggatcaccggcatagactatcacgcccagaaattcacgaaccagaatttctgagctgaatgtgcattaaacccctgtccaggaccagcaagtgtacacaaacgataattgttgacatacagatccacgtcttacaagaatataaaagattacaaatgcagcggaaaaagtaaaagcgagctaagcctgaagacttgactcctgcagcgggcgactccattccacaggcaatccttgacagcagcaacaaaaccaacctcaacgagacagctccaactaggaagatcttcagctctggtgagggggaaaagagagcaagactgagtactacccactatactcagcaagtcataccggaagaggaggtatgatgcaggatatatccaagggaggctaaaggttcttttgcataaagctagcatttaaaagcagtagttgaaagcagtaaaacagttgtagtaattaatcaatattaaccaatcactgtccaacgctaccccacattgcaacaggcccaaccaatcacctgaactacaccagttcaattagctaactaggggtgagactaatcacggtgaatctggtcgaccgcccataaccgcgggcacggctattcgaatagttttactctgattagaggtgtacaactgtacccacaagacatgttcccgtgcgccgacatgccaccacgacataccggaaagaggccgtgacaggacccttcgcataaccccctctaaccgatcgcaccacaccacaaggttcgcccccgtcctcagcaggcaacgggcagcccccctctcgtgccacggtgaatccggaagccgatcaaccaaacaccccggccgacccaactccatcacgcccaccctaacctgggtacgtcggctagaggaaagctacacaacaagcccagccattgcccacgctggcttgtggtaagtacaataagttcttccagggcatcccgcgaaccggtccttaatcgccatgggcacgactagcaaaaccatgcacccacagcccaccatgtagtgtattttaattaactaacaccattgcggtggcactaatccaaagctatgccaataatcaaactctatgcattaatgtgttttcctcttttgtgtactagttgaactaagcatggctaagcatttcctaaaccaacatctaatcattttaatacccaagttatcaatggcatgaggtgaacaatatatggctgggtagtaggacccatcgcacatgatattgtaaaacaatgcaacatttaatagaaatgcgggacatttgtaaattgggaacaatatgatcaactgtaatgcatgacttgccttgttctcgcactgacgagatcacaacaacgtcttcgagggatcgcggatcgacaaaacggctgaaatctatgcgacaaacaaagcacacaagcaaaacaggctataagactactaaaaaaagaaaacaaaaccatttttaatggatttattctactttcacccctgctatcctagagaagtattcctgtcaaactcttcttgaccatggagcaacctctttttgagttgtctgctcctcggggcgaactctatgagccacctccttcatcggagtcaatttatacaactggctatgaaatttgtcctgaactaattagtatggttaggaaaaatcctttttctgtctttgatctagaaaatccctaccatcatctgtgagactttgaacaagtctgctcatgccttaagattcgtggcatgagacaagaaactatgtggtggaaattgttcccgttctctcttcaagagagagcaaagcaatggtacacctctaccgttggatgtgtaaacggtagctgggaaaagctgcgagaccaaccctgtccttacccgagtatgtgcttctccaacatttccatacgggtttggataaggagtctgcattccatctggacataaccgccggaggatcgttcatgcacaaaacaccttcagaaggaagaacaattttggatcgtattctagaaaatacttccttcatgacgcagtccaatgaaccccagcaggaggcatccgtgtccaagatagaggaacctctaatgatcgagccacccgctgaaccatccacttctgctagcttggttgatgagaaggttcctgagcagccgtccgtcgagaatgaagaaattcagactctagattgtgccgcaattatgtttagggacggttttgacgaagactacggcaataccctgaactattttagcaagaggaaaccacccgttcctttgtcacccccccgatcctatggaactcgggttactttgagaaactgttcgggagttgacatctgtaatgagcgatgaatggctaaggaaggcagagctttcatccgaagtaattcggataaataccgctccccgaatcattccttgccttccggaagggaacgacgtcggtattctctacagtccaactgtcggggccaacctcgtttctgagtcttttgcattcgcttatttaagcgataaggcagtgaccccgacaaacaaattcttcaacaaatggaaatatcatcgaaggatttgggattgtacaaaatgtacctgtctgctttaaagatagggaggtgatcttggatttccacgtctttgaaatccaagactttgacatcctaatcgggttgcccattgagcaacttcttatcaacacgcctcgattaggtagcctcaaaataacactaggagagaatgaattctcaattccattcttacgggcaaggatcacctttaccgaccctctcccagagattgagttagcggaagaggttaccgcagttcctc

SEQ ID NO: 60098 - DNA, 3949 bp, Oryza sativa
  unsure (1)..(3949): unsure at all n locations
acgatatgctttcctacataatgacagagaggcccgtatcataatcagtgacaagctctctgaagacgagactcaacgtcttctcaccgtgttggagaagcatcgttctattcttggctgctcgcttcaatatcttagggggattaatctcgcgctttgcacccatcgtattcctattgaccccgagagtactccctccagggaacctcaacgacggctcaataatgcaatgcgagaggttgtaaagaaagaggtcttgaaactcctgcgtgccgggattatttatcccgtaccatacagtgagtgggttagcccagtccaggttctgccgaagaagggaggaatgacggtcgttgcaaaaaacaatggaggacggaggatgtgcatcgattacaggaaacttaacaaggctacaaaaaaggatcatttcccgctacccttcattgatgaaatgttggaacggctggcaaaccattccattttatgtttccttgatgggtattctaggtatcatcaaattcctatccatccggaggaccaaagtaagactacgttcacatgtccgtatggtacctatgcataccgtaggatgtccttcggactgtgtaacgctcctgcatctttccaaagatgtatgatgtctattttctcggacatgatcgaagacatcatggaagtcttcatggatgacttctcggtctatggaaagactttcggtcattgtctgcggaatttagacaaagtcttacaatgatgccaagaaaatgacctggtgcttaattgggaaaaatgccatttcatggtccgtgaagggatagttcttgggcatcgagtgtctgaacgaggaatcgaggttgatcgtgctaaaatcgatgttatagatcagcttcctcctcctatgaacatcaaaggaatccacagcttcatgggtcatgctggctttcatcaaggacttctctacaattgccagacctctgaccaatttgctagccaaggacgcgccctttgagttcgatgacgcgttcctaaaatcttttgaaattctcaaaaaggcactcatctccgctccaatcatttaacctcctgattgggctctgcgcttcaagatcatgtgtgatgcaagtgactttgctgttggtgcagtcttgggccaaaccaaagataaaaagcatcatgcaatctgttacgctagcaaaactctaaccggagctcagctgaattatgcaactactgaaaaagagcttctcgcggttgtttttgctatcgataagtttagatcttacttagtgggagccaaggtgataatttatactgatcatgctgctttgaaatacctgctcactaagagagatgctaaacctctcctcttaagatggattttgcaacttcaagaatttgacttagaaattaaaggtaaaaagggagtagaaaattccgtagcagatcatttgttcaggctacagctcactaacatgcaggaacaaccgataaatgatttcttaagagatgacatgctgacgacggttcgcgactccaacccgtggtttgccaacatagtaaactacatggtatccaagtacataccactaggggaaaatcaacaaaaactgaagtatgaaagtcgccgtcatatatgggatgagccatacctatatcgggtttgctccgatggcttactacgaagatgtgcgccaactgaagaaggacttaagatcatagaacaatgtcatgcctcaccctatggtggccattacggtgcattccgcacccaggccaaaatctggcaaagtggtttcttctagccgacaatgtacgaagtctcaaaagaattcgtcagaagatgcacaagctgccagaggcaaggaggaatcactgctcgcgatgcaatgccccttacgtacaatttgcaagttgagatattcgatgtttgggatatagactttatgggaccttttcctaagtctcgcaactgcaagtacattctggtggcagtcgactatgtctcgaagtgggttgaggctatgccgtgcagcgccgcggatgtgagacatgccaagaatatgttcacagaaaccatcttcccaagatttggtactcccaggatggtcataagtgacggaggttctcatttcattgacaaaaccttccaagacctcctacgagagatgggagccaaacacattgtggccactccttaccatccacagaccagtggtcaagcagaaacatcgaacaaacaaatcaagaatattctgcaaaagacggtcgacaaaatgggaacatgatggaaggaaagattgccagacgcactgtgggcataccagacagcgtacaagacacccgttggaatgtccccatatcagatagtatacgggaaatcatgtcgattacccgtagaacttgagcacaacgcatactgngccatcaggaattggaacatggattttgagggagcagganaatggagaaaaatacagattgctgaatttgatgaatggagggagaaggcttaccacaacgcgaagatatacagagaatggacgaagcgctggcatgacaaaataatcaaaatcaagaaattcaagccaggagacaaagtactgatgttcaactccagggttaagcttttcggccacggaaaactgcgcagcaaatgggaaggaccgttcgacgtcatcgatacctcttcacacggggcaatcacactccgcgacgactcaggtaacatatttaaggtaaacgatcaacgcttaaaaattttccttgagccaaatgaaactgttgacgaagaagtggatgttattgaattaatcgattatgaaccatgatgatctcatctaatgcatgcttaaaaccctgcatagttgtcagttttgtgcttagaataggtttttgcgggcctagaaaaaattcggtggccagccggacctccctgatcgccgttgatcctggggtttggcgtggacgctccagacgttctcccaatgacggttgcggggcagttcggacatttccccttctcacaaccgtcataactgtcctataaaaggacctcacttcattcactctcacacacactttcaagcttgagttgaattataagaggctctattgtactatatttaatactagaataggaagagagtagagtagaagaagtcggaaggattccggagttgtcggtaatcttctcctatttcttttattctgtttattactatgaattcaatataatattcttcttgagtaatctagatttatcttgtgagaattatctgatgacgctctctctcctggcccgatcttctgatgaggggataactcttgctttgatcgagtgcgacgtttgcgacgtggctaccaaccagaacaagtccaggacgccatgcaatcgctacaccacaaacgatgtcgtaccaaccgtgacacgcggttgatgatccctgcaatgcaaacgagagaacactgcaagaacaagataagatgcaatctaaatattgcgaataggtgattaagcacaaagtaatagttgcgattgaagtggtagatccaatcgacccggcaaatcaacacaccaactatttggggctctgaatcaatagtccccgactaatcgagcgaggactagagacaaggtgaatggcacttggcaaaattcaactaagtaaaacccaaatggttttaggatgtacaaagctatttataaagaaaaataaagctagggttaattgctaattcgtggaggtggagggagacacttccgagatgggcctagtctattacaaggcccaaggcccaagttcggttttagcaacagcactgtcttattttggcgattcccgttgactcgagatgaatttggacatgagactggatgtgtttgaaaggtagcgagataagctttcaacgaagtccaagatcacccaaatcggattggcatgaaggcgct

SEQ ID NO: 60099 - DNA, 5394 bp, Oryza sativa
ggaaagggcatggaagggatccaaactaaaattgaggggtatgtaagagattgagcaaatttcaggggtatagaagggattatgtgaacttcaatgggtaattaattttatctactaattaggatgttttatgtaatttccttagagatatgtttgggcaaaagtctgccgcaaagacttatggtatcttaaagtttgttagagacaagagtcgtgtccgacaaggacatatattgtatctcgggtataaatatgacccaaactcatgtaatcaaacaacacacgttcaatacaatctcggcgcatcgccacccttttactttcgttttgtttcgacgagttcttgttttcgggttgagctgcatcggtttcgatcttcgactagagctaaaacttgttatggcggcttgcgttctcgggattagtgcttccatctttatgatactctaatcttgtttatgtaattcatcgagttatcatatatcttacataatctttggtaatattgttacttaacctccaatcggccaacatctatcattggaaggcagccgatcaggttaaatactaatgttgactcagattatgtaggatatcttccaccctatgaaacatccaacggcttgattgtccagatgttgttgttcttttcatacttatagctacatcagttgagtttgaccttataagtcgtgattagaatcttaatctctagcctatctttggttgccgattagggtagtatcggggttttagctgattttacctgatttagccttatatcttatatgctcagttgacatactagtgttgacgaaaaaatcgaacacaccggcctgggagatatgcttagctccagtgcaggtccaaatatgatgagatgcaggcgtgccaatcagtttgatcctgcaactgacaagatatgcaaatagtagatcaaaacagtcaatcggctgacaagccgatggagtagttctagccgatagccgataatagccgatgccaataccagccgatagcggtagggtttaagcaatcggctatatgtccaatgtaaataatgatatgaaggcaatcggctgatgatgatgtaataaaataacaatataatccagtagaaaccaatcggctagaaacaaaatataataagcactgattcgaaggttaaagcatacatcagctggaggtccgatgtcatgaaatccacaagattagattaaacagtgaaacctttgtcgtcatttcctaaatccaacttatatgtatatgcaatccttatgagccgatgcaacgtccagataactcaccggctgaaaccccgatgaaacccttattggcagtcaaaaagcaggctagagattatggttctaagcacgacttagtagatcaaacttaactgatgcagcactaagtataaaaagaaacataatatctagacaatcaagtcgttgactgagttttcagggtggtagatgtctaagctaatctaatctaacaacgcgatttagccgataccggcagaaaccctaaaacgagaagcagccgatagagctaaattgatatgctaagactagattaacatagacatatgataaataggtagggaaatatatcatccaaaccagagcaatccaagaggtcgaatgtactgatgcagccttgaacgacgccgatgtagatgagacaattgcctgggccgacggaacattggacttaccccttcgctggagatcaaacaccgatgcagccccgcgtcaggtgccaactcccgctggacgataaaataaagtagaaaaggtaaaaggtggcgatgcgccgaattgtattgatcgtagcgatagattacatagaccccgggtgtacatatttatacccatgggttgatacaagtccttgtcggacaagaaagaaactaacctaaagataaaaggaaaatataaagtccttatcggacactacacacactttcctaaagataaaaggaaactaacaaactattcctaattaatagataaactgccatgccgcatcgtctttaaactcggtcacttagggataagcttcctttagtagattgatttccttaactgaatatagtaggaatctgactattggcgacttgataactcccatcggctgattccgagatgctgcagctgataatgattctaagccgatgacgtctttgccgattaccaaatttcactgttaacacatctttgccgattaccaaatttcactgttaacaactagatctgccctttatattaagatcttgttgcatctaggtatattaagcttcctgtttgatatattttgcctgctttaatatcttaatatagagtagtatcggagtactagccaatatatgctagatctatctgattggctatgttatgaatgcttatggtccttttgttaatatatatttcgatctaactggtttatactgtctcggcatgacgaccgatctatgccaatcacttgatttaagtatatatcgatgaagggattatataccgttaatacctacagccgatcgaatagattaagttcttttcttgcttgttcatgattgccgatcgactcaaatatgacatcggctcaaagataaatgatatgtcatcggcgattgcccgatcgactatcatttatgggatttaaccacgaattctttgtctttgtttcttgttgattgcaggatcaaatcaactggcacgctcacaaacctaaagtcaagatttttggacttgcactgaagttaagcagatcttccaggcctcgtgtttttcgcatcaacatcgtgctagggtttaccaaaagtcgtatcctgattattttgacaatatcccatatcctcgtggttatggagttcccgaatttaccaagtttagtggtgaggatagtatgaccatatggcagcatgtaggtcaatttgtagctcaatgtggtgaggctagtagttcagatacatataaattgcgcttgttttctttatatttgtccggtactgcttttacatggtttacttatttaccagcaaattctattcagatacatataagtatagttttgacgtggccaagtgtgataaaatttttgattatcttttgcaagaaaagcaaattagattacctaaaggccatatcataccatctcaagaagaattaaaacgtcgagcttattgtaaatggcatgattctcattctcatagtactaatgattgcaatgtgtttcgacgacatgttcaatcggcgatagatgaaggacgattgaaatttaccgatggttccaagatgaatcttgatcgtgatcctttcccggtgaatgcaattgatttcaatgaaaataaggtgttgatttggtcggagcaagccgaatctactaaagggaaggaagtggtcattggagaacctaggcctaaaaatgatggtgccaaaaaatccggaggttggtgtttggaaggagaataggagtgaagcttcaagttccaaagccccaaagaagactaaggtgacttttaatatgcttttgtacaagtatgagaagcaaggtggtgagaaaaatcacaataagggcaaaagactaagatcacctcctagggagtgatttggtcattcaccaagacgagtggagtcacctttccctcatcatcctcaagccatgccttgtccaatgccgccgtcaggttatccttttctttacttcatgccatggggggcaccgccaccaatgtttaatcatatgcctccaatgcaattccatcaaggttggggaggaccgaggaggtcagcacatgagcgtttgtcttcaccaaacaatggcctgttttatgctaaaaatcaggtcaatgaagaaaagagggaaggaaagcgcgtcaaggtggaaacgagaacttcggaggtgattactatcaaggtggggtctcatgatgtgccaataccttctggagatgaagccggggagtcccaaggtaacaaatccgaagccgggatcaattcttcgtagactgccagtctgaccagcccctctggccggtctgactgcggccctacggccggtctgaccgatggcatcatgccggtcagaccggaccatcaggccggcctaaccgctggccacacgccggtctgaccaggccctctggccggtctgacaggtgctcttcattcggtctgataggacattcgcaaagggtagctcgggggcttcatcgtcttcgagtaaaatcaacaggggtcattatatacctcctggaacagagccaaaatcaaggcggatgcctaaagatttaacggctacccaacatggacatcaacatggtgtgtatgttgcctatggagttttgtgctatggatgaagccgaagttgctcaacattcactaggtcctaaagacgcagtttttgagaagcctaatgagtcaaaccgtcatatgaagcctctttatattaagggttatattgatgggaagccggtctctaggatgttggtagatggaggtgtcgccgtgaatttgatgccatactcgttgttcaagaagttggggcgtggagatgatgagttgaagaagaccaacatgattctcaatggcttcaatgatgaaccaacgaaggcgaatggtgtcttttcggtggagcataccgtggggaacaagacgttaccaactactttcctcatcatcgatgcgcaaggtaattatcatgttattttgggtcgttcttggatccataccaattgttgtgtgccttcaaccttgcaaagaccgatgcttcacttgagtggcgacattggaatattcaatgcttatcggggttagacctttctagctatgatatcatttgtgtttccaatggtgattttgtacctatttctataaagccggctagcatagcacggctagaccatattactttgtataatgagtaaagaagctaatttagagtggttgcaaaagagggtgcaagaatatcggtctacaaagaacgatattggagaaactattgaagactttgatggagtagaaaagcttggtcaagggtttacataggccgatcgtttggaggaagtagacataggtgatggaactaagccaaggctgacttttgtaaacaaaaatagaaagccgattgtaaggttaaaataatcgagttgcttaaagagtatgttgatagctacgcatgggagtaccatgagatgccgttcttagccgtgatcttgttgagcatcggcttccaattaaaccgggttttaggccttataaacaaccacctcgtcgttttaatcctttgctacacgatcgggtcaaagaggagatagaccagttattagaagcggggtttattaggccatgtcattatgcggagtgggtatctagcatagtctcggtggaaaag

SEQ ID NO: 60100 - DNA, 5420 bp, Oryza sativa
gtgttcccttgcgagtctacatgaatgagttcaagaactgatcccgtgcctgctgcatcatcgcgtcgaaatctttcttttgatcaggtgtgaatttttctggatcgatgggcacgacgtttccttcaatgacgtcggtcaatcctaacttctagatcttttccttaacagtgcctggactagctgaggatggcgacagcggtggtttctcggccatgaggaagaattgcttgctgacttcttatcggtcccactgggcgtgccaaaagcgtgttgacgtaaaacacgaggcctgggagatctgcttaactccagtgcaggtccaaagctcgccttcaggtgtgttagcgtgccagttgatttgatcctgcaatcaacaagaaatagaaacaaagaaaccgcggtttaacttataaatgatagccgatcggctaagtgccgatgacatatcatttatctttgagccgatgtcatatgtaaatcgatcggcggttataaatagataataaagaactaaacctactcgatcggctgtagatatcgacaatatatagttttatatcgatatatacttaaatcaagtgattgggatagatcagtcgccatgccgagacaatataaatcacttcgattgaaatatatactgataacagaactatatatgtttatagcatagccgatcagatagatctagcatgtatcggctagtactccgatacaactctatgttaagatattaaaacaagcagaatataccaaacagaagcttaatatacttaaatgcaataatatcctaacgtaaagggcagatttaacatgtcaatgaagcatgtaaagcaaatatagttaaatcagataagatcggctgaaactccgatactaccctaatcggcaactagaagggaggctagagattgatattctaagcacgacttaatagatcaaacttaactgatgcagcattaagtatgaaaagaagaataatatctagacaatcaagccgctgaaagtttcatagagtggtggatatcttatataatctaaatcaatgtcaaaacctaacctaatcggatgccctctattaatagatgttagccgattgtaagttagatagtgatatcgccaaagattatgtaagatatatcataagtcgacgaattacataaataagattagagtatcatgaagatggaagcactaatcccgagaacgcaagccgtcataacaagttttacctcttgttgaagatcgaaacagatgcagctcaacccgaaagcaagaactcgtcgaaataaaaactaaaggaaaagggtggcgatgcgccgaaattgtattgaacgtgtgtgttaaaaattacatagggctcggggtctatttatacttgagaattgccagatatgtccatatcggacatgactattatttgtaacaaactctaagataccataagtctttgcggcagacttttgcccatatttatctctaaggaatttacataaaatagcctaattaatagatacaattgccttcctaggactttatccatgtatggcaatcatcttgaagtgcgtcaactcaaacccgatatcggatacaagtcgtattatgagaatcagttgtatcacttaacccagtctgactcggacttagccgatcctattcatagccgacccgaacctcggccaattcttactctgtctccgcgataatcctcatcttcgattccgcttcaatccaaccttctttccgatgcagatattaccaaatttggtcgttaacacatgcccccaagtccggaatatttggtaatgtttcggatttgcttaacattgactccgagcaagtttcgcactttaccgttttctgaccattattcaagcgcttcaaatactaaccgttgcccccgagaaatctcacactgttactcccgttttcaccgcttaagcgaaactctaccttctctctctccggcgattcctccgacgcaaaaagcgatgtcgtcctccgccagcccgtctgctgcgccatcagctgagtatgcctaggtaagtccccatcagcaagatcccctttctcaatagcagatcgattttcctcgtctcatattgctctcttcttctcggttgctttggatttgcagcacctttccaaccaagttgcgattcctagcctatcgcatgaaaaccactattttctgggtctaataggcaatcttgaccccactgattatcattgttgaaaccaacaggatcccctttaggctagccaaccctaacctgagccactagaaaaatactttcaagtcttggccatctcttgagagaaccacccctgagaaaagttggatcacatggtaccaacgcgtatcagctagtaagaaagctcactgggatgagattggaatcggccaagcacttgacctaaccatagccaactcagctaatgacgagcccttaatggcagccgcctcttatttttggtccaacatcattaacaccttcttgttcaaccaagggccgatgactccaactttgatcgacattaccatgatcaccggtttagatgtaacctcatcggctaatcccatgagcatgaacaccaaaaatcagtttgatttcagaaccaaaagcataggtggctggtctggctatgtggcggcatatatgggtcaaggatctgttactcctcgagagcatgtagccttcttgctaatgtggctcgaaaaattcctcttttgtggatccagttgtggtcctacaaccaactggcaatttgtagccgaagccttagaatcaaagaaagaatttcccttaggcaagatcctcctcggctacttataccaaacattgaacaacgcatcggccaagatagccgttggctcagtagttgatgcaggtggaccatggtggctgctgcaaacctggttacacctgatggttaggaaagttgtcaatcggtcgtctgtgacagaagctgagttcccattgccagagccgattgtaggagacgatggagaagaacgcactcatcgcagatgcacatcatacggagaatatgcatccacaccaactgatgctggagcgaagctatcggctgagctgctcaaggactggttctgcagcttctatgaaggttttaagaaagatgcacaggtttggtttccttatgaagactcagcatatcttgaacttccatcagactttagatttgaagacattaatcatgaaaaattccaaaatccagagaagttctcacagctgcaatcagcccatgcatccttcctgtcggcattcaccaagggagaaacatccaagtctcttatgagtttatcacccaatgagctcggctggacaacttggattaggccaactcccaatcggcttattctttgccgacaagattcaatgctgaggagaaatcacatccactctaatgatggatcggctacttaacctaccaggaccccctctgggcagcattgataatattgagtttgcaggatttagaagcaaaaacttcgacagatggtggggtgaatggaagctgcacttgtttcatcaatcggcttcgatgtatatgacagatctattccctgatgtcatacctcaggtaaacctcaccattgttaacttgaataattgttagccgattcattacttgactaatttcttgttcttgttctgcagacaatcgactcttcccctccacaccaaagtaacagtggcaggcacattgaatatgccccaggtctaattccgaatggaggtggactatctctcccgttatcggctaccatgccactaagacttcaactctcctttacgacttaatcagggaactagccgatgcaggcaagaaaaggaaaaccagatcatcagccgtgagtactttggcctcatctcaaagaaaaaggccaaatccaagaaaactaagccgactgataagccaaccgatgatctgcctgctttggatccatccattaaacaagctctggatgaagaggagattggcgaagatgttgaccaggctgcagccgaagtgagtgacacagaaagaacaccattggcttcacccaagcaaacacctccaactccctctgcccccgttcatttcacaagagtaaatatctctcttcggcttcttttgtaattacctccctcttcagctaattactcatagattttgtggttgcagaagaagaaaactgctgtgaagaagaaaccagcagcgacagttatcaagtcggctccaccagtaagatatctttaattcttttacttaatcaatctcaaccgactctctataacacttgtctattctacagcctcctcctcctctttcccctcctgtacagcaatcgtcaagtaactagactccgtcggctgtggggagtcatcacatcgaggaggaagaacaaccagctgctcctactatcccagtaagtttccttttgattcaagaacttagatcggctatattgacttagctctcaaacttcttgaaactatacctgcaggttctagccgatctcttctcttttgacatcaaagattaccttgatgaggcagaagaagatacttcaagcaaagctctagctcctctatctgacgatgtgaaaagaacacttgaagatatctcacatcggctagaagcttcttctttagttgactgtggatcaattaggacacggctgcatgaagttcaagctctgattcctaaagaattggccgatgtcctaactctagccgcttatctcgagaaacatcagttcaagctagaaaaagccaagctaagactagccgaacgctgtgagcacaaggagattgaagccacaatctaggtcaatcgacagcttgtgcatgaagaaaaaatcaaactcgatcagctatctgagggtccgattaagtccaatattaatcagctcgaagctcgcaagattgatctcttggcacagcttgaagaatggaatgctcaactagatatggagcacaaaaagctagccgatctcccaaaatctgtcgaagaacagaaggcaaggctcaagtcggctatcaagaatgttgctgacctaaccaagtccctaaaggtcacttctggaactgatgctcaagatgcccaagccattgaagaagtcgaacaaattaggcaaagggctatttcggctatccagcagtacttatctcaataactcttgtgtaataggacttagataccttaataccccgctgttttaacaatcctttgtgccgattaatacaacttctaacttcgcccaaaattttattttttttgtacatatgtgcccccctaattttacaatcccaaaaacattgatgaaattataaaaaacaactaagggcgatataataatatcggccattgtatatcgacaattcacaaccgattacaaatagaagaaa

SEQ ID NO: 60101 - DNA, 764 bp, Oryza sativa
aatatggtgaagaattcaaccatttaaacccatgctatcggaaaactgaacaaactcatcggatatgaaaatcgagccttgatcggttgtaataatttgaggaataccaaaccggtagattatatactcttgaacaaattgaattgcatccccagaatcaactttcttcaaaggaatcacctctacccacttggtaaaataatcagtcgccactaatataaacttatgtcctttactcgatggtggatttatcataccgatcatatcaattccccaacctctaaatggccatggcttaatgataggattcatagccgacgccggtgctcgctgaattgctccaaacttctgacaatcttgacaccctttgtaatatctgaaacaatcttccaacattgtcggccaaaaataccctgcacgccgaagtaaccacttcatcttatgagccgactgatgagtaccacaaattccttcatgaactccaccgattgcaactttagcctgatcggcacttaaacacttaagcaacaccccatcaatcgtccgatagtaaagctcatcgtccaataaagtatacttcaatgccttatatctcaatttcctagaagccgattgagatggattctgtaaatactggtgcacatcatacctccaatcatcggctgtcatagctgcaatttcaatcttaacatctttgatcatcggcttataccccgatgccccctgggccaaatcattagcttcaatattttgttctcgagata

SEQ ID NO: 60102 - DNA, 1770 bp, Oryza sativa
  unsure (1)..(1770): unsure at all n locations
ttcctgcagccccaatgttattatgatctatttatattcatgtttaaaaatgctttacaaattccttttgcaaatggttgtgaaataaaacttccctttatgctaaaaagaaaactacaaccagcctccctttgattataagattcgcatgtagtatgttaggattgttctcgcttgctagtacattaagttgtttagtgtactgacattgttctttaggttgagtgtgcgggatcattgcttcttcaagaaggattctactagaggcctacccctagtcgcttgtttgtaggttatgggtaaacaagcttccataaatctctaattatttggctagttggcctatgtataattaaagtagttgtaatctgaattttaatctttatttatgccttattccatagtctcccatagtctctactcgatgctttggatttttggattttatattgtgtttcctatttggcttgttaggacagcgatgaggttagattgttactttttttatatgggttctattgagaccccatccaactaaatattttttgttatcacgcgaagtagcttatacaatatatagcacggatgtctcacaacacactactacaaatgtgattgttctgtacgagaccccatcatttttgcaaacgaaccataactagtggcgcttgcaaaaatcaagcggcattttcgcagacggctccttaagacgtccgtatggattttcccatacgggcctcttaagaggtccgcgtgcaaaaatggcctcattttttcatgcggctcacttaagcgcccgatggaaaaatcaatttgaaaatagaatttgaaaaaaatttgaaaaattgaaaattttgaaaaatttgaaaaaataaaattttaaactagtgtatctcactcatatgaactccaaattggatgattatttttcctaaaagtttctaaaatcatgctctatcatgtcattgtgttcttactgctattattttggccacttttgaaagagcatctatgcccctagtgggttttggtttattgatgacaaacgattaagggactgatgcacttattgagtgtataagcaagtgattagtccgatgaagaagctaggaaatggacttatcgatggatgagaattaaagagaagatatttaagatgtgagtatgaagtgactacctatggcaagacggtgaagcgcaagcgacgctcagctgcaatggaccatgcggtggtgaagggccagcaagaggcttggtgacgatgaaccgaaaccggtggtgaagggcgagtgaagactttgtcgtgatggaccgtgcaatgccatttgaagccatggattatccttatcaatcatttgagaaatggaagatgaaatgtcaaagatcaacaagatgatattttcccgatgatcaaatgaccttgacgccggtaatcctccaagtgaagaaagaaattggtgtgaaggtattcctattggtataactttcctttttacatttgagtttaggatgccgtactattaagggggataccacatacatataattggttgaatactagtgctcaaaataattcatctttgtgttggttgaaaaacctaagccaaatttcaactccgagttgttttacatgtcacaacacttgtaccgggtttctttgcaagtttttcaacatctcttgaaggttttggctcatgttttatggtggatttgatagcctatgaaannnnnnnnnnnnnnnnnnnnnnnnnnnnnnnnnnnnnnnnnnnn

SEQ ID NO: 60103 - DNA, 6115 bp, Oryza sativa
  unsure (1)..(6115): unsure at all n locations
cgcagtggcggatccggaggagccgtcctagggaaggccggatccgccgccctagggaggagcttggctctcggcggcgggcggcgggcacggcgacagcctgctccggcggatctggcgacgcgtcctcgggaaggccgaatccgccgccctaggggctctcggcggcaggcggcgggcacggcgacggcctgcggcggcggatccggtggcgccgtcgcagaggcggaggacagcggcgcgtcagaggcggaggacccatcggccaggccggcagcgagacggtggcggagctgcggaggcgggccggcgtggatggggtcggtggaggtggcggcgacctggtacggtggcgggagggagtcaatgcgagggggttcaggcgaggctagcggcgtggctcgcaccgcggcggctcctctcctccagcggcaaggtgctcggcgaggaggagaaggctgccgagaacatctacatcaaggtatatccaccctactcgcttccctaatcttccttccacctcgtgattgttgctgttcttgctgcggtagatgggctacagatgcaactagagatgtattggtgtgctgtgtagaggttttggatgtgctccaaattgaaatgaggctgtttttcgtgtgcgaattgctgagtttgcttcaactttcatccttcccatggtcacttttggtgagttcttatgagtcccatggtcacctttttttaaaaagttataagtgaaatcctattatgaatgtcatatctgatgactccctttatcttattcatgtnaaaannatggttgccaccatatgtggtgcttaggaatgtcaaaactgtaggggcatgtttcttcctaacatgtgaagtggttttttttggctatctagcaaacttgtggctgtgctttctcatgttatactatgctaggcagttgcattgcagtttaagatgtctcagtttatacccaatctttggaaatttgggagcatgatgtcagtcttttcgttttaaattaagggataacaggaagaaaccagggctggcagttctttttgttaccaatttttccaccgtgcaagtacaaaagcatttcagtgtcttttcagagttcacgaaagaactgggctatttatttggtagcaggacaggaagtagggttgttttttacacctgtaaatgttactttagtaaggaaatttgagggtgcctctccctcatgcgtgaaaaccattatttccatagtgaaaaggggtaaaaagggatttaccatatccacagtgtatatccacagtgtgctgtctgtaataatctccatgtcacattgaacgcgcgtgcacacacaccagtaagtgtctactcagcttccaggattgcaagcaacttaattttgcaagcaacgaaaatcagaaacctggtgcatacaaattctaagagtccctcttgtgcgattgaagaatatttattttcttaagtgattgcaaacatagtacttcacattacaacttgtgattcatgccctgtaatggaactgaattagcctcttttagaagaggatgaatgattaaaccattttttaatacattattataacttttattgctcttttgggtatgataaattgttgtggtttctaaacttattaggtgattttttatcttgcagtatttagggtcaatttcagatcatcatgttacatcggaattcaagttatgtaacagcttgtgctagaatgaaggttcttacgaactcaacacttaccaatataagtacatgttttgacttgtgatactatttaccaataacaaacggtagggcgccgcgaagcgcacctaaagttctagtataactttataggtggcatttagacacagccacagcacagtgtactgctctgaagattgcaatatatgttgtttgttgttgccgaaaaggagaaagtccttcacatctatcactgtctaactctccaccagaagcaatttgcattttttgcattcctcacctcacctcacctcacagtaacataattcttgacttgtaatcaaattgaaggtttgtttgttaatctcatcagaattcagaaaccatccaattcatctttcaaaagaaagtatatatatatcgttttgcctgatctctgagcatgcttagtttctttgttacaaaatgctaaactgagatgaactgaaaattttagaaatgtgcgatgcgcaggtggagataacatgcagagggagacagctcctcccgatcctgacattgcagcatgtccgtgacatcagtaactgcatgaatattttttattcatctattatactgcttgaacagtagaagaaactaggatgatatggtagttattgatgttttatcttgtgcatatgcagtgctgctaagctcacttggaagatcttggtcatgcgacatctggtgaaattttggttactgtgattgtatttggaatgtgactggatttggctgttaactgtgttgtaaattttgtgttgtattggatgtttgtcgagttgtgttggtttgaatctgagatggtatgagaaattggattgaatttggtgggctcaaatttaatgggcatgtttagtgggctttaatctgatagttggttgacaaaataggctagttttgaaatgggcctagttctgaaatgggcctattttaaaatgggccagttaaaaatttaatgggttgtttaaaaattaatgggccgtcaaaaaaataatgggccgtataaaaaaattgctgatgtcagcagccacgtcatcagtgacatgtcatcgcacaggtgtcaaaacaaaccatgtcagctgccacgtcatcagtgacacatcatcgcagacgtgtcgaaacaaccacgtcaactgccatgttggcctccatatggcaaccatccatgacgtttaatttcgtcacagaggttgggcttgggctagactacacgagcccataagcgttttatgacggttaaaaaacgtcatagattgtgctgatctgtgacgatttcggagaaaacgtcagcagatttaatctgtgacgctcaatagatgacgataagtataatcgtcacggacaaattcctatgacgaattttcagtgatacatgacgaatttttttcatcatagattaaatagattcttgtagtgtaatatagatcatagcatttggagagtgaaagagaaactacaaagttcattgccttggatggcagttcattgccgttgtgctctacacatacctactccaacaaattaatcttcaacctgtattagcacgcagggaatgtctaaaaaggaattcattgaaaatgtcataactcacaaggcactttaaaacatgattcatcaattcagaactgtattcttttaacagctaatttgaaatgttacagaaattaacaaaccattactaaggacaaacggtgataatccttgtggatcaaaggaaatgaaagtatagaaggttgcacatacctgaaagaagacaactggataatgtcacaccttattatgcctctcctgtataggacaggtatctcagtgatcatctcctgatgcccttgttcattaggaagacaagttggtccttaaccctagatttcttgcatggacagtaggagtatcatctgaaccagattatttgataattggagagcaagttgctgtctcgaaataatcagtggcaatagtaataggattagatgcttacttgcactgcatgtaaattcatacattaatattccctaacccagagcagttcaaggtagtttacaccatacaatttagacatgcaattatgtgagctagctaatatatgaattatccaattgcaatgatgagcaaaggttaattaaatcgtaccaaaccactggaattataagcataatgtacaaagctgaatcttgatgagtttccgaacagttaccaatgatccgaacaactgaacgaacataacacgatttacttgtactgcccatgagcctagtaggactaataaactcaaccatgagcctagtagggccaataaactcaaaggatcatgatcttcctgaaaaaaatgttaaatgaattagaaaatgaggcatgccaccgttgtatgttctctgaataaaacaaaacatatatcgagaactgatgcaaatgtagaaagtttaatgcaacatgattcaacggagaaataggtgcaccagaattccatctatgacttaatgcttgggctaggcattttgacaagaacctccagtgcataggactgtggcttacctctgggctgtggcagcatccacagatcttatgtgcaggtgtgctggcagaggggatcatgtacgtcttcgatgagcggcggacagcggacgacctggaagtggcggtgacttggcgacaggaattcggggcggcgcggggcgtggcggcgagcggcggacaacctggacccgacggagacctggcgacgggagttcgacgtggtggatgacccggcggcgggcttcggcggttgtgagattgaggggccatgggcgagaatctcgccgcgaggttggtgggggatgggagttatgggagagagagagggggaggcggggagggagactgatctagatcgttgtttctacagccatatgatttaggccgttggatgtgtgatatgatgaatgatgaataatgatgatgaatctaccctatagttgaacaaatggttttactcattcatcattgatcatatcacacatctaacggtgtaaaatcatctgatgagttaagatcgtacgtcccagatgcgcgcgtgtcgctcctcctcctctcccgcacccccctctctctctgccgcaatcgacgccgcatcggcgcgaccgcgcatcctctcccgcatctccctctcttccgcattcgtcgcgcctcctccgcatcccgtaccgcatccacgcctctctctcccctcccgctccgtcgtcaagtgcgccgccgccgccaccgaggccttcaatcctccatcgtcaagggcgccggctcgccatgctctccatcgccccgacacaggacgccctcatctctcccctgccgtcgcgccatcgccgattcacctccgccaggtcgccgcctatccccagcagccgccagtccacgctcgccctcgccgtcgcacagatcggcaccgccgccgacccgatgctcgccctcgcgcattcatcgccaccccatctggcccctctgcccatcgcgccaactcgccctagcaccgtctcgccgcctcgcgccatctctgccggtcgccatccgcatcaagcggtcgccgatcccatcgccgaccgctctccatcgggacttcatcaaatcgccgccgcgccgcctgaccactatccccgccagtctctgtagcgcgctcggtcctctccgggccctgacgtccggtttctagagctctacggcaagtttgattcttctccatcccagttcattatttttcttgtgcctatttgattttgactacgatgcaagagcaaactattagatgttagcgagcctgatctacctctgttagtccaccagctaatttgcgttcccttccagatttcgtagggatatgcctcacaacaatttggttacggtaaaataatttgattctattgttgtgctttcaaccataccattacggtttcaaccttatgattgatccaaggctaaccatttggaagcatcgaatcatatattattattatttttggatgggtccatgaccttctctcagttttttttttcttttgctgttctaacatcagttctgattggcaaaattgttttttacagaagctaggaggggagcaaaggaggtgctgggactgatggaaggggagctgttcaggtgcttgctcggtaatagttgggtttttttatgctctataagtacaagatatttctttttttatttgaatggaaacattctgcctgggtatccactttattaggtccatttcctgatttctgttggttatttaggtaatcattttctcaataaaaatagtttttctaatgattttgaggttttccattcgcgagttgtaaaatgtagctgctgcaataagataaaaatcaacaagttgct

SEQ ID NO: 60104 - DNA, 730 bp, Oryza sativa
atgttacatcctcacccccttaatagagattgacgcccccgtcgatcaaccccaggccaggaatgtcccctcttggccacgtccgtgtgtccagtgccagcacatgtagtcggctctgataccattttgtaacgtcctgcccgcctctgataccactttgtaacgtcctgcccgcctctcccaggccgggcccgcttacatctgatagctttcatagatcatagactaccctcacagaccaatacacgtcttttctgcacactttgtcctcactcgtgcgcacccgggaagtatttcctgatcggtcacccatcccgaaattgctccaggccaagcacgcttaacctcagagttctttcgagttggtttccagaaaagaagttgcaacttgttgatatgagtattctattaatcctattaagccgtgggccgggatgttatagaacccatgtgacctcaagctctacaggtcctaccgttgatggacatcatcggccctcttgtcgatcaccaggcttccgcctcccttaaggagaaagtcacggaagaggttgttgtcgcttccactgcccctatcgtcgcagggggcagtggaaccaagaggaaaatttgggccaagacaagtggcgatgccggatctcggcagaagtccagcagctctgaggtaagacttggcgttcccctttgtccggtttttccccctttcatgaggtgaacgaaatgaagacac

SEQ ID NO: 60105 - DNA, 2707 bp, Oryza sativa
taaacagctatggggactccactccacaagcaactcgacccgaacaaagcctaatcctcctgatcatcaccttcactgaagtactcctcctctgatgaatgaatattgtaagaatgagcatatgacatactcaataagccacacagcaaatatgcaagtgcacaggataacaaaggatggcataataaagctcatttgcataaacggcatttaataaacatttgagagaatagtaaaacagtggagtaatttaagcaatattaaataaacaccatacaacacacccgtgttgcataggcccaaccacatttgaacaaccaaccccggttgtacaaaccaaacctccataccaggaatataccattccaaaccaggagtcaatttaataatcacagtattatcattattaatgagtaatgtgagactaatcacgaaaaatattgttagacccacccttaaccacgggcacggctattcgaatagttctactttggccagagatgtaccactgtacccacaagacacaactccacaacatgtcaccatgcgcctcaggaattcttctatggcggcgacccacaatattctcgacataggattcggatacacaatgaaacctcacaaactagatgaacaacacattgcccgtgcaacgcaccttttcactacggattcacaaaaccacatgctttgataggttgatccacttgactacgcaaaagtggatctattgccccctcaattccctgcaaggaaaagcaagaacaatctatggcagaactcccaattcatctctctagtttggcggcagcaacacaaaacctaggagaagaacaagagcaatcatgctgcaattttcattagaataaacatggtctgaccttggcgggtcatgtacaaaggcatatataaccatttcatggattagaaactaactaggaatcaaatacaacatagtatggaaacttttctgcaacaccgtcagtttgtttcggctcttgcggtggaaccaaaaggtttttgtttccgtgggcctctccatcacatgggacatgacgttagctttctaacaagtgctcgcacatccaaaacggactccaaacgagagagaaacaagcattttagtccaggtatatccaggcggcccaaaccaagtccaaactgaatcttttcttccttatcttcaaactcctcatttcagaaggcttcaattcatggggaacttgtagatggattccatcccaacccaagatgggcattaggatagtagaactccatccaagcatttcgtgcaaggcccatgttcaacatcaatagagctgctcgtgcatcaatcagtctgcttgtgcaacatgccttcaacttgcaattgttggtgatagagaactctgaatgatgtgcctctacctccttctgaacccacatgcacgccaatggttcatatatctcatgtctgataaagtgacaaatattatgtagcatcaagttctcatatatttctcggatagacttatggagaaacgagttcaccttattttctaatccgcatgcacaagtaatccccgccatttatctttcacatattgtatactctccgtatatatccgcagcaacccacaggaaatctagttccttatatgattagacgcaaagaaaaaaactataacctataattatctgctttgggtattgcatccaagattagaatggccaggaacagccatcacacctacaattccaatcatttcaaactagtacctacacattccagaacaaactttgtatgtgcaagctataagactaaactgacaataaatccaaattgactccaaagtgtccatcctcaaatttatttttgataatgatctccatgacaaacttgatatgcgctccaagattcatagaaccctaaaaaggcagtcaatctcagacaaacaaccttgaaatttctaactttcactggtggaaaaaccatctttggtcggtgtaacgccccgattttcgttcggaataaaaatcaattaataatgcattttctagaaattaaataaaagttaaatcaacttaatcaagtgaattattgggagaattaaaattttccctttaaaaatcattggccgggaatattttgtaatattctttgtgccctaatgtactctccggaattttccgtgaattttcggagctcgagaaatagttttaatagcacaaagatcattgcatcaattaaaataaaaagaaaacaaataaaatcctccttcctctctttgggccattttcggcccaaatacctccccctccttcctctcccgcggcccgcgcgcctcctccctctctcgggccggctcccttctcccctggcccgctcgcaaaagtctattttgcgtccctccttctctcccttcgccgacaggtgggaccggcggtcccacccgtcagctcctcctcctacctctcgccggccaaccccaaccgccattgccgtccacgtcgccacaaaatccagtgccctcccgcacccgagctcgcatccaacgacgtgggcacgatcgcctccacgtcctccaccattttccccgctcgtcccacaaaaaccggcgccggccgagccgccatcaccccacgtcggcatcccacttccccggcggttgccgccccgactccgcctctcccgggctcgattcggccctccctcccctataaaaac

SEQ ID NO: 60106 - DNA, 5052 bp, Oryza sativa
  unsure (1)..(5052): unsure at all n locations
ctctaatccaccaccgagccgccctccccactacaaccagagccaccgtcgccatttccgcctccggccgcgccgcaccgcctcttcagtccgccccgtgttgtgccgtcgccctctgcggtaccgcagccatcattcgtggctcagcaatccctccgtgttcgccggtcgtcgccggactcatctccccgtgcctcccggtgagctccgtcgtcatttcggtcggcgtttcccgccacactgcaactccctaccctctcctaacctcttcatttccttccctaggtccctccaaccatcggccgccggttcctgctcacggaacgccgccgaaccgccgtcgccgttgcctccccgaggagcgccgccgcctcttcccgccgccggcgacctcccgctctgcctcgttggcccgcatgctcagtgagcccctcctcccgctccccttccctttcgcgtgcatcgccactgcccgtgagcgccgccgtcttccggctgctcgccgccgttcggcgccgccggctgctgcctccagaggccgcnnntgcccagcaccatggctcggccgtgtccatgccccagccgtgccgcctcgtggccgtccgatcggctttgggccgatccgggccgtcggttcccgtggaccggcggtggaccgcctcggtggtccctgtccacggtggaccggcgctcttatgccgctgaccggtgggccccgcatgtcggcgccggccgcccctttgctgacgtcagcgaggaccatttcctttgtaaaaataaataataattgcgcaataaatcgagtttaattctagaaattcatttaaacggctcaaaacttctaaaattcatatctaattcattcgaactccgaattgagccattcaacttgaaaaattcatctaaaattgagctctacatgtttgtttagtttttatgtactgtttccttggtttttattagagtttttcctcgttttgcgtgccagcgtgtagaatccgtcgtttcggaagtccgcggttgcgaggaaaagagttcggaagatcaaagtgaagaagcaaggcaagtcacacattccccttgagcatgttgatcccaatttataaatattttaccgtttacaaataaatatgcatgttttgctaattacattggatccgggtattacctatctgctcgcttgtgccatgtttacttgatatctgttccttgtcaaccttgggtaatgaatcgactagctcatgttacttatgtgacctagctagaactgtatgcttagccatgcttaatcaccactagctcagttgatggggtaattacagtattagacctttttagtatcagagtgagctgcgtgctcgagacatctggccatgcttcatggtcgtaattatccaactaaaatatgactgaatggtgggctgtgggtgcatgattttgctagtcgcacccatggcaattaaggaccggttcgcgggatgccctggaagaacttatcgtacttaccacaagccagcgtgggcaacggctgggcttgtagtgtagctttcctctagctgacgcatccaggcaagggtgggcgtgatggagcggggcgggccctgcgacggcctctgtcgcttccggattcacctaggcacgagaggggactgcccgttacctgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcaacccaatgcactgtagtccaggtgggttggttgggcctgttcaacgtggtgtagcgttgatcagtggagatttaatgttactttaattactcacagttttactgttttgctcaatgaaatgttttacaactgcctttatgcaaatagccacaaacccctccttgtatccccttgcacgtctgcatcgttggtgtggcttgctgagtacggtggttgtactcagtcttgctattatttcccccttttcagaagtgtagtgcttctgagctgaagatggaattagaggaccaaggctcagaccccagttgagttttgcctgtggagtggagctgaagccccgctaggatcgcctttttccgctgctgctgctttcgtttcggtgcgaggactaagtgcctcttttgtaagtattttacgctttatttacgtttggaactgtttattacttgtcgttttgtgtaccctggctggtcctggacagggatttaatgcacaaaatagtctggaaatttaggctaaatttctgggcgtgacagtcggtcgactagattttacaatagtcccagttgtattaaaaaccaggactaaaaatatctttagtcccggtttaaagatctatttgtagtcccggttgataaaacaaccaggaaaaaagatcgccatacgctttactcccggttggtgttaccaaccgggactaaagatctatttatagtcccggttggtaaaaccaaccgggaanaaagatcgacgcggagatcggagaggtgtgcgcgatcagatcgaggtatctcctcgtctcctcaaccttatctcctcctctcatttttaactcctctgctcaaccttatctattcttcttcttatctctattcctctccttctcctctctactgccaggccggcgcgaaggcggtggggtgtggagggccggccggcgcgggggcggcgcggagtgcggtgaggcggcggggtgcggagggctggccagccggccggcgcggcggcggcgcgcggcaaggcagcggctttctcttttttttttgagaatctgagattgttgtgtaatgtatttgattggatgtgagattgttgtgtgatgtatttgatttgtgtgtgatgtgaatatgtgatgaattttgtagaagttgcgatgtaatttttttaaagattttgtgatgtatttgagtatttgagatgatcgatttgtggatttggaggcaatttgaggatgattgatttgggattttggggacgggatggggtgaaatcaatatatttaaaaataataaagaaaagaaaaaaataaagaggaaccggtaagagcaaccggattagcctctttagtcccggttggtaacacaccaaccgggactaaagatgctttatctttagtcctaaaaatggatttttactcccagtttttcccggattcgtagtcccggttggaaaaccaggactacagggggttacgaaccgggagtaataaccctttctccaccagtgtttctatacacgtatgaatagaaacaatccaaaatataatactaatactcaccactttcaatcaatcgatttctgcaccttctcctagtaacatgaagaactcacatgactgctaataattgtcataggtagtggaccgagaggataggtcataaggatagggatagagatagagttggttggataagattagactgagtcctcccctctgtttatataaggacatattgtatcattattctaattagtcactgaatcagaattagtctttcccaacctaagttcccctctcatccctagcagccgtcgccgcccggctatcctcccggcggtgtttaccccctatgaacactaacccataacaacttggtatcagagccatggctagtgaagacatgatcgaagatcctgagacacctgcatccgggtcctcaaaaggatgcaggctgatctagtgatactagtagcctcaagaaaggcagagaaagcgccaaacgggaaggaagagagccacaccgagcaaaaggtggtcatgggctccctacccgtgacaccctcatctcttccctcgctgctggagatcgtctacttgaggaaggagacggcagtggcgcatctagcacaactgtcaccattggaggccatcacgcaacaccgtcgaccaccatccttgtgacgacctcggcgtgtcttcaaaaggcatagtggcggacccagaaaaattacactgggtgtgcccattctaacgatcacttcactatatatatattttttcaaaagaaaacacctatttctgatggaagaattttggcaaattttggtcggatttttcaatataatattcaaatgtggtccataattcatgaaaaatctataaaattcataacaatcaattccataacctaatctatttagctgttcttctttcccccccccccaccttttctcttcatctagtcctttcctcttcctcttatttgatttcttgacgattacaagattaagacaaatcgtgctcattgttatattctattttttgagaggatttcatttttatatccttttgattgcatactacatcctagtgtttttcttaaaaaaaaaaaaggtatgccggtgccaaccagcacacaccctaggtccacccctgaaaaggcacattaggagcaagtcgggacggagggtgagctcccagctacagccgaaggagaaggaagcagtacgttccccctgcgacgtcatcctccagtgcacgacggtgggatattccgctgcggacaaggccgctcctaggagacccacaacatcgctgctcgccctggcaacggcggcgtcgtcgccgtcctcagcggaagtgacaacctcgactgtcccagcgacttccggaggaagcggcgtggtacgcaaaagagacagcacggtgggaacgacgcaaggcggggaggcagcacgattttcgggagaagcagtttttcgctctctgacggcgacacaatttcagaaggcggagcattgcgcggaggcgtgggggcggcacggcagttgcgcgggccacgtccactcgcggcaaaagcgtggctccaactcctggcaacgtcgtgtgcagtggataaggatccacgtccctggttggatgag

SEQ ID NO: 60107 - DNA, 1716 bp, Oryza sativa
  unsure (1)..(1716): unsure at all n locations
attgatacattgtagttcacatgcaccgataaaaataaaagtattgtaatcgttgctttataattcatcaaataaacgtaaattggtattttattacattataacaaaacgcataatgtgtttttctgaattggtaattctagaaaattgttgtctaaaatccaaaattttctgaacctagacatccatgatccccaaatttatggatctgaaccatggtgtccatgtcgttgatagctataggttggcacctcctttcgatttgacattcaatattctgatgaacataaccatgccagctgcaatacagaactgggagtttacagaaaatgcaaaatgctaagaaggaaagtacatatatacagtaaaataagtttgcagttttgggattgtgctacctacttggctacttctctcttggaactggtcagatgagaagcacttatgcttgtttccatagagttgctaaactcatcagaaacaatccgtaagcttgcttcagaaatttttgtagctcgaacttttccataaaacattagaagtaactatctgtatcaccagtgaaaaagaacaatccatgaatggattatgctgctgatttgatacaaaagacaactgagacatgttaagagaacaattcgtcaagctatttattcagctcaatttgggaagcacagtggaatatccaagtattgaatacaataaagcaaacatctgtttgctgccatcttcttttttaatgcttcaacctgctgcacctagagttcaggtttattgtgtaaacaaagcaacggagttgtatatatcgataaaattttgccaaaccaagattatagcacttgtgcacgactcaccttttttcctaaaagcgagatttttatttactattcaccgtgtttcagttgcagccttgcttccttttgcacaagacacattgcggctgtcaggattaagctggaaatttaatcncaatctttgatatcaaaggaatgcatgcaataattctctatttctcttcctgaaatgattaaaaaatatatgttgatagggttgaccccctgagaacctggatgatctccaaggctggaaacaaaaggggatccattattatttaaacaactcctaataacaaagtgcatagctttttgacaacacagtgcataatttcctggcttactcaagctgaggactacataaaacagaagcaatgattcgccttcagatacaaaattcagaagcaagcatcagcagacacacaattcagaaacaaaattgagagtgaactgaaaggtgtacatttgagtcccagtaatacctatacaaagaatttgcacttttgaaatttaatggatggaaggttaggcacacataacaagaggaaaatgcacccagcagttgctaggaaactcaacaaatttctttgttcagagaccatagtactactatgcagtttcagttattaacttccctttttcccctttttagataaaaatccattaaacttctataagtggtgttagctgtgatcaatggtattagctgtgaactaatcaaatcatcaatctgaggaacttgcatctgacagcaattcaaaaatttccaagaccctagtcaataaatactctatatacagaattaggtgcagatgatatactccctcgataatggcaagatggaattaaggtactcgccacaaatgaaatggtgaggctgcat

SEQ ID NO: 60108 - DNA, 1751 bp, Oryza sativa
ggtgataacttgactgagaaggcaccgaatccgttgagaggtttactggtatataattaaagcgctcacacattagctaccgaggaagatattcctatgctctatcttatatcgattgattggttaaactattgcaattgcctcattcatcctattatcatattaacaaagtacggagattgaaaaaagattagccacctagtttttttggtcagaacgaaatgcagtcaactctggtgaaactcagaagtcggtaacatagctatgtgtggttttgttcactactagaaaaaccatttttccaggtgatgatatatttttgccaaacggataggcctctcggaaccaaatgatcgcctatgaaaatgtaaatgggggttgagactgtcatccgcctacgaaaatagatttttgcaggcggatgatataagctgccatctgcggtaatcattttcataggcggactagataaggcatccgctaatcgcagggcggatgccttatgttgtccgcctccgaaaatcgtgcctgtaactcaccctaaaataatatctaagtcatcttatcctttcctccaccatcatcctctccatcaccatcatcctctccaccactcatttctctccaccacccttctctctctcgcgcacggctcagagggcaaaggcggcgtcggcttcgaggaggagtggctgggggaggggcgccgttgacggtggctccgacgaacagtggcgacggcaacagcgacggcacggccagaggagggagggtggcagcgggtgagtggtgtttttttttgttcgccgataacattttcataggcgggtggctatagcgcatgcgaagatggagatgccgcctgcgaaaatcatttttgcaggcgggacaaatgtccgcctgcaaaaatcatgtattttcacaggccttgaagtgcgggggaagtagatggccacctggaaaattcgttttggcctgtttatgttttttctagtagtggttgtgggctaaatttctgaattggctgaatcttttgggagacctgaacttactagggacatcatgcttaaattttggcagaaaccagatgaccctaacctgaaggttaacgcactgatggtgattttgatgataacacccgctcaaggtggctggggttttgttgttagggatactgatggccaggtggttgaagcagatgctggaatggaagcttatcgcacggctcttttttatgcttccgaagttggcaggggcgtgttaccttaaggtaatggcctacaaagctctatgcttggggcgttatttagagaggctaaatatctcgtatcaacatgatttatagaagtataaaggcttcactcctaaagaactgatctttgatcggatgccaaaaatcatatttttagccacgattcaatagctgttagctcatgtcaggctatatttagtccaggttggtgttaccaacccggactaaagatgcctctagggttagtttaaaaagaaaacatcgccatctaagttagatgtgtgtagtaggtaggatggtaacgcacgtaagggttgagatgagagatctttagttcgaattctacatcccacacatttttttgacttaatatgcatctttagtcccgattatttcaaccgggactaaagatgggcggattatgcatccaaaaaacggttgcgaaccaggactaaagtccctttctccacagtgcttactgtaatgctagattatgttt

SEQ ID NO: 60109 - DNA, 1132 bp, Oryza sativa
ttgatgatgatgagaacagattacaaagagagtagtcgaaacagatggtgccgacgagatcatagtcgagggattcgacgagatctcccggcgagttgactccacgtactctggcttcgtaaattttggtgggtgtgttggcgattgaattggatgtctcgaacccctcccaaggggtccgttttataccgtggatcatcttgatccccaagaaaggtttgaggatatcggatctggtacggtataatagaaaccctatctcttccgagtaggactttggaaatcactttgactcgaagagatactttccacaacccgagtcggtttcctcgtgacattcataggaacaatccgtatacgtgaaggtatacctcatcaatatattccataagtcacaggataggaggtataccttatctataaccctgacagtagcccccgacttcaactcaaatgaattcatgttgtcgttcatgacttctctcatcagcgacttgtcgtactcactagatcgttctcggtatggaccgagaagacaaggagttattgaaaacactaacggaagtccgtctggctaatcatgaatttgaattgaagtctgaacaaccgcccttaatgggcctcaggattttcggcggcaatctctctccttcctcgaaattcgaaccattaggtagtgcgcttatataaagggattttgggatccatttcaggtccgtttgccaaaaaattctccaaccttccaacaatcttggacctttcgtctcccccagttccttaggttttttccgtcttgctctggcgatcttcctccgatggcggacctcggcatttccacctccgatctggcaacgctagcgaagctctccatcgagggggcccttcctccagagcaagacatggctagagaagaaggaggtactgccccctcccctgccctaggtcatatggtagtagtagaagatttcgttcgtagtgtctttctaccgctgccatcagaattccttttgttggtattgaacttctacggcctttctctcttgcacctcaaccccaactccatcgctttcttgagcatttttacccatttgtgcgaggcctacatcggggtagtgcccttcttgatcttttt

SEQ ID NO: 60110 - DNA, 734 bp, Oryza sativa
agacagtaaagagggtgggtgaaggaaaaaataattcttccgcctccatcaattctccattttctttgccaggcatagtctcagaatatttcgttatttttaaatggacaacaattgttaggaaagtatcttatttccggtcagcattatgctatatagtcacgcttctaaaatttttttaaaaaaagacctctgtggtactgatatatggtataaacaggcatataacacctgaataattgaggcgaggcaatcgtgggagagaggcaattctgtacccctgtgcccttatcgttttgaaaagaagcaatttttgtagggtggcaataacatacagcactcgttataactcagtgatacttcaggcaagaaaaccaataggagaaattgtacatcaagtaggagacattaactgtacaacaaattgtacaccagtaaagtatataaccaattgctaaagggacgttaaccgtataactaataggagaaattgtggttacctttggttcctgtccgaactgtttgggaggacccaaagggtaattgggatttgaagaatgaagcatggtgtcgaccaactctggaatttcagttgttcgctaatacttctgctaggtgatggcgatggtccataaaacaaatgctatgccacatacactcaaacaatattaccatttgacaccacttaagaaaaaaaaaacgaagggggaggagaactgcgtcttacactgagc

SEQ ID NO: 60111 - DNA, 720 bp, Oryza sativa
tttgaccgattagtctctcctgcatgcatgcatatatgtatgtatatactttatatacatacgtatgtatataaagtatatatgtgtatatataggtaaattaactggtgctacatagagtatgggttccaaaattcaaattgagaatatacctaatttgaatgagtatgaaagttttttaaatgtttagatatgaacattaacttctttactaacaagttttttagattttggttctaggtatataacatttaaacatataattcgttaggtatgtaataatgaattgtgaaataaagttgagtttgagttattttgttgttaggtatttgtatgaatcaaattcatatacctaatatacctaggtatatactcacaatttaaaaatttttaaaaatttgagagaatttgtgtgttttataccttggagcccgagcaccatggagtcccatatgggtatcatatatatatatatatatatatatatatatatatatatatatatatatatatatatatatatatatatatatatatatatatatatatatataaagtatatatatatgtgtgtgtatatatattgtatatatatatttttatgtaaaaaaatatgtacatatatacaaaattcaaaatatatatatacaaattttgtatatgtacatatgaaaaacacatatacaaactttgtatacgtgtatataaaggttttatacg

SEQ ID NO: 60112 - DNA, 1434 bp, Oryza sativa
aaaagactattgatttcaggtcactatgctgctccttaccatcatttttgctgtcgtccatagtggtatggcaagcttacgtgaaactggtgagaaaataataggggagagagcttaccgtgtaatgtttgctggaatctcactgcctttagcagttagtactgttgtaagtgcttggcatacctttttttggacagttggcatctcaatggctaagttcttctgtatcttagaacgttgtcctttcttgtaggtctactttataaatcatcggtatgatggcattcagctatggcaagttcagggtatttcaggcatccatgagcttgtttggctctcatctttcatctcattcttctttttgtatccatctactttcaatcttttagaagtggcagctgttgacaagccaaaattccacatgtgggaaactggaataatgcgcatcactagacatccacaggtaattccaggaggccattttaaagatacttgtcatggaattctttagtgatattagatataaacctatgttttttatctgttatctttccttgcatatgttttgactcataacatataatatggtttgctttatggtattctatagatggttggacaggtaatttggtgcttagcccacacgttatggattggcaattcagttgctgttgcggcatccgttggattaattggtcaccatctgtttggtgtttggaatggtgataggaggctggcatcacgctatggtgaagcctttgaagttctgaaaaagagaacaagtgttattccttttgctgcagttatcgatggaagacagaaactacccaaagattattacagggagttcatccggttaccatatctcgcaatcactgcattaactttgggagcatactttgttcatcccttaatgcaggcgtccagctaccaactcccttggtgattggtgtacataacaatgtccacaaagagaacacgatacagaaatagtgactttgtactttgatagacctgatagcctggccttgcattcgttattttaatactggcctgctcacacttgttgtaaaagaagactaacgaaagagtaccaggttgatgtagatgggagtattcaagacaaatggattgcacgttgccatgcttcctgaggacatctctatactcattagttgtgcatctataccaactagtgagcgtgcacatgcaaggcacgtcacggatagacatatataaccatataggcagagtaaaagtttttgttacgtagatcgtgcacaaaagtcatgttaagcattaggagtgccaattggtgtagcaaatccctttttatttgcctaatattttgtgtgttcatttgcctcttcaatggcatttttaatgtcatggacactcctatggaagaatcattattatccgtcgctattttaa

SEQ ID NO: 60113 - DNA, 2233 bp, Oryza sativa
aatttcctccaaaatccacatgcaatgtgccattccataggaatttcataggatttgaaaaacttcaatcctttgaatcaaagggccaaatagaaaaatttcctatagaatttgaatcctatgaaatttctacataaattctttgattcaaagaggccctcaatgccttaaccccgtgctattcctagcattgggtccttcgaacaaaactgtgggctgttttgctcctgctgcctcgattcaaaatcatgtagacaaaatgcagagtattaattacaaaatgatatcagcagcagttactcagtttagcataggatctaataaaataaaatgtttgacactttggataagcaaaagaaatcatgatatgtcttcctaggtagtgataaacagcaaagccaacatactcatttaactatttcctgagaaacaacaaaattggcaagttctaaaagacaagagaaaaaaaaatccaaaaatgactaccaaaatataccagtggagacgtacttaaattgtttatctggaaggtttaggggacataatggccatgaccggggtgtgggccgaacgcgatcacgatgcggaagggatctcaatatagataactatgctcacctgaacaatgcatgttcaggacatcatatcaagcagaagagagtcaactgaggcatgctacttctcataatttcatagcttccctgtaaagaaacaaacagaacaattaaattttacatgaaccaataaaaggtcaactgtattgtgtagaagaaattcttctaagtttaatatatacataacaccgaaggaatcaacacatgcatgggcccctttaaatcacaggattgagaaaacagaggaatagaaaaaacgtaggaattgaatgccacacttactgaattcctatgggattttgaaacacaggaaagtcttcgaactgtcgtttgattagcacacatgaaaaacgcaggaaccttagacacatgaagaggaaaacatgaggtgagacctcatgcttattttccttcaaaattgctctagtaaggttcattccataggaatttcaaaggaattgataggaaacaatcctttgtttcaaaggactctataggattatttcccataggataaaatcctctagaattcctatggtttttcctttgattcaaagggggcctaaaagtgcttgtatttatctattaaaaatgcttgtgaatcaggggagttcaggggaaatttagtgcactccgcacacatgtaagaattgtacatcagtatagaaacttgcagctaacaacgaattcatatggaacggcaaaaactcaaattattttgaggtgtacatcgaatgcagagctttctttcggccaattactttcttcttatttcactattctctcagaccatttgtggcaactttcgagcagattttgttcagaatcatcaaatattcgagaagaaattcaactttgcaagcaattaacttctgatgataaattgaagagaaaggggagatgatttaaaggattcactcagattggccatagaaattatgtagaaacctgtagtgagtaatagattggatttaaatatatctttgtgaggtatttaacttctaatgatgaattgaagagaatggcggtgatttaaagatttcactcggtgaaggttggtcttgcaaaattatgagataggcctgcaataagcaagagaacatttatttgggaagaaattcaactttgtaagtatttaacttctaatgacgaattgaagagaaaatggtggtgtgcttcactgagacgggccataaaaaaattactcctattcagagactgacggagcgtggggctcctcaccgggagaccgcgcaggcccccctttgccggttcggccgggggcgctaagcgagtttcttcgtcctcgatctgtggaatgttcgcgagagagcaaatgcacgagacacgggcgatgtagacaggttcgggccactgagaagcgtaataccctactcctgtgttctggtggatctgtgtgtgaaggagttacagagagccggagagcaagagagttcaggctctagaacccctcttcctctttctctcctctacgagctcaggtattctccgagttgtcttcttttttctttttctgctttggtgggcaaggtcctccttctatatctcaaggggataccacatgcaccacttctacctactcttcttttgggtggaga

SEQ ID NO: 60114 - DNA, 2537 bp, Oryza sativa
gagctcgaggcgcgggcgaaggagctagacgcaagagcgcatagcggcggggcggccgcgggcgacggcgacctagccgcccgcctcgcagccgccgaacacaccatcgccgagctgcagggcgcgctggactcgtccgccggggagagtcgaggccctccgcttggcgggcgaggtagggcccggcatgcttcgggacgccgtctcccgtctagaccgcgccgggcggcaggcgggcctctggggcgggcggtgcgcgaagtacgccgccaaccaggggggcctcgcccagctcctctcagagatggccgggaccctccagcgactccccgaggagctcgaggagacgatcaagtcatcctcgagagaactcgcccggggggcggtggagctcgtactggcaagttaccaggccagggaccctgacttctccccgtgggcagcgctggacgagttccctcccggaaccgaggacggcgcgcgcgcgcaggtccgggacgccgccgaccacatcgtccacagcttcgagggtacggcccctcggctcgcgttcgccctcgactccgacaaggagggcggtgacggtggtgcggacgacagcgacgacgaggctggcgacccgggcgcgtcgaagtgagcccccaggcccccgccaatcttaaatagctttttctttcttcttccgaggccttcgggcccccttcttgtatagactaatttaatctgcaatcaaataaagaggaaatttctgtgtcaattctatttgtcgtgtgtatgagacgaggatggtctgtgccgcggtccttctgtgtcttggcttgaacaagggctcgtgcccaggtcccagcctcaaatggcgcgggtcggggctagtgcctggggagatccacatgtcgagactggcaggccgggagcgcggtgaccgagggttatgggtgacccgattgtgggcctttgccgattcccccccggagttcaccatgccccggggcgcggctcgattctgggccccgtttggcgatttccgccggcccgggccaccgagggcagggtcgagcacgagcgtgctaattcaagccaagattcttcaaaaggaaacaatggcacagacacagtccttaggaaatcgaaaaagcttttattgaaatacggaagagaaaaaagataagtatatacatgtggtagcccccggccaaccctgcatgcccgggggggtgcggggttggcccgagcccgagacctgacacccgacccccactaggggtagaagcgacgaaggtgttcgatgttccacgggttaggcagctctgtgctgtcgcccgtggccagccgaacggagcccggccgggggacgccgatcactcgatacggaccctcccacattggtgagagcttgctcagtccagctcgcgtttggacgcggcgtaggacgaggttgtcgacgcagagtgatcgggcccggacgtggcgctgatggtagcgccgcaggctctgctggtagcgcgcggctcggagggccgcgcgccgccttcgctcttccaagtagtcgaggtcgtctctgcgaagctgatcttgatcagcctcgcaatacatggtggcccgaggggaccttagggtgagctcagatgggaggaccgcctccgcgccgtagatgaggaagaaagtcgtttccccggttgctcggcttggcgtggttcggttcgcccagagcaccgctggcagctccttgatccacgagtcgccgtgcttcttgaggatgttgaaggtcttggttttgaggcccttgaggatttccgcgttggcgcgctcgacttggccattgcttctggggtgggtgggggaggcgaagcagagcttgatgcccatgtcttcgcagtagtcaccgaagagcttactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctaaacggacccaggatatcgagcccccagacaacaaacggccacgaaagaggtatggtctgcagggcctgggccggctgatggggttgcctggcgtggaactggcacgccctgcaccgccggaccaggtcgaccgcatcgttgagagctgtcggccaatagaaaccctggcgaaaggccttgccaaccaaggtgcgtgaggcggagtgggctccacactcgccttcatggatatcggcaagaagctcgacgccttgttcccgaggaatgcacttcaggaggactccgttagccgcgcgccgatagagggtcccttccaccagcacgtagcgcttggagatgcgctggacgcgttcactcccttcgcggtcctcgggtagagtcttatctgcgaggtacacctggatctcagcgatccaagcaatcaatctaagggagctgggagcgctcccctcgggtcccg

SEQ ID NO: 60115 - DNA, 6196 bp, Oryza sativa
cctcgatatgaaccgacttagggcggccatgcagccggtgacgcattgcacatccctaagcttgctggggggggcgcatccgctctatagctcgtatcttctcggggatggcctcgatgccttgggcagagatcaagaacccgagatgcttgcccgcaggcacgccgaacacgcacttgtcggggttcagctttatgcgggcggagcggagactttcgaaagtttccgctagatctgagagtaaggtctcttggttgcgcgtcttcacaatcaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcaaatctgatgataaccagagtatgcatctagaaaacacaaaaggtcgcaccccgcggtggagtctacaatctgatctatgcgtggcagggggtaagggtccataggacatgccttgttaaggtcggtgtagtcgatgcacatccgaagcttgctgttcgccttgggaacgacgaccgggttcgccagccactccggatggatgacctcacggatgaatccggcctccagaagtcgcgccacctcctcgcggatgaaggcttgacgctccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgatcatccgctgcctcggggcggctagaacggaggtgctgagcctctcgtcgccacccgcgggcttggacaccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtttacccgctccgtgcggaagttggcggaaccaccgaaggtgatcgggaggtcgatatgacctagtggccaagtgtgccccggcgtcacaccgatgatcggctgggacggccggagcaccatccccggggccttgatggcgtcaaaggccgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctccccatcgacggtggcgacggtggccccaggctcctggaaccccaggtcatcgtcgccatcgtcgacgtcctcggcggtggccttctgcttggcctcacctcgccggttgccggcgggagccgccggggccttgccctcacggcgctcctgcctcctctcctcctcccacttcctcgtccgctcagccaaacttttgaccgcgcggcagtccgcgaggtcgtggagggaggtgttgtgtacggaacaccacttgccggtcgggcgcttcctgctgggagcgccggcctcctttttgtcgctcgcaggcctcccctttcaggtggcccgcgaagcgccctcgatggcgaggacatgaccctcattgtcggaatgggccgacctcttcttccttctcctgtcccgccgccctgaccgagcgacggacccgggggcggccggagctgccacaccggaaccggaggagttccaggtccaggcctcctccttgcgagccacacggtccgcgagctaaaaaagctccgcggtggtctggggctccttggaggcgatcttctcgagcatgcggttgtgccgcacgccccccctgaacgcgtagatcaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatgtgccctggaagttcatggtgaactgctggcacaaatcctcctaagggtggaccgacgcgggtggcaagttcattagccaaccccgcgcctgacctttcagggccatgggtaagaaattcgacatgaccctgtcgtcaccccccgcggcctcgatcccggtcgtgtagatctggagaaactcggcggggttgacgcttccgtcgtatttttcggtgatagtgggccggaaccttgggggccaacggacgttccgaaggctcgccacaaaggctcgacagccagcaccgccaaccggggactcggggggctggcccccgtgcccggaccgaagtggcgctctggacgaggaagcgccctccgttgcgtgggcagcacgacgaccattgcgccggcgctcgatattgaggcgggcatccggccccccacgcacatcttcttgggtcggaggcgttgatgagggaatggcggacgaacggcggataacggccgccgctcgccgcgccctccgcctcgacgacacggagtcggcggtagcagcgccagaggccttggtggcggaggaccgcccgccggcgcctagacgctgctgcgccgtcatgaccaagttggccacgtcatccagccaacgtcgagctggagtctctggatcggggacgacgggcgggtgacgcaggagcgcgcccgcagcttggagcgcgccctgaggcgtgctgccatcgccgtagacgaggaggcgacgctccccatctcgccgtccttctccatcgcccgcgggcgtcgaagtcgcggatctttcgacctcctcgagcgcctcctcccgcccaagacttcggcgagagggggacggtggagtacgagctcgacggcgcgggttctgctccccgtcgtcaccgctagcgctcggagagaggttgtgcgccactgcccgttcggccattgggctgagcgggagaagcttggcgcacacgaaagaggacgagggcttagaaagacacacgcgccctctacctggcgcgccagatgacagagcgtggggctcctcaccgggagaccgcgcaggcccccctttgccggttcggccgggggcgctaagcgagtttcttcgccctcgatctgtggaatgttcgcgagagagcaaatgcacgagacacgggcgatgtagacaggttcgggctactgagaagcgtaataccctactcctgtgttctggtggatctgtgtgtgaaggagttacagagagccggagagcaagagagttcaggctctagaacccctcttcctctttctctcctctacgagctcaggtattctccgagttgtcttcttttttctttttttgctttggtgggcaaggtcctccttctatatctcaaggggataccacatgcaccacttctacctactcttcttttgggtggggacccaccctatcttgaccaaaacttggcttgcgccttcccctggaagctaaatcacagcttgtccttgagtgaggcccagcgccgtcactcgcctgacacaggggatatccctgtcattccttcattaatgtgtggagatttgcaatggccgctgtcccaatgaccctccgatgggatgggtcatacctacctccactccgccggaagcagatgcaacgtgggagcacggttgtctgccgatgacgtgaccggcgtcagaccagtcacagatcgatcattcttgtccaccacgcgtcagtttagcatgccgcacgtctgcccttcttcatacaatgacttccttgcaatggttgcgatgaagcctggcatgaatctggcggggactgacgtgttaactccaggagttagcacgccggctccggcttagagacgagtgcctggaggctctcatcattccgacgggacagggcgaggcgtgtgacaagccgcctgttgccacctaacccgtgatctgaccggtctgtgaccggtcacacactgcgaccggtcacggaccggataagcgtgcgctgcgctgcattaaatgcggcgtggcgcgctcgtccaacccgcaataaatgcggttaggtgagccccgctgtgctcacctaacccatacacgtggcgccaaaatcatagggggtcggggcaccccagccctcggggccaaaacgggagcggcccgacccctcggggagacagagggaggggtggcctcgtcaccctcgggcccgacccccccgagggggtcaggccacgtgggtgacagcggctgcccaagcctctagtcatgatacctccggtcccatgtcaccgacaaagacctacagagagcaagaatattattttggaagaaagtagcctaagtacagaaaacatgaattaaagactgagtgcatagggataaagcctgtcttgagctcgtagaccgaggcaggtttgggttgcaaattccatctttgttatgtgctatctcaagaactaagaattactgacgaaaaacatggaaaatttgattaaggggaattgttgatcacacaaaaagaactgccagcggcctgtatgtatgattccaattcatgcagcaaataggactcaccatgagatgcaactccaacaattctgaagaacaaccaacggcccaaatcagacttttcaggcataaatcaaatcgcgcgcccggggggggggggtcagaatccaaacaaagcattgctattccatctgacaatctctcgtacatctatctcgaaaccacttagaaatctgcacattttgaggatctgaccaaaggaaatccagtgagggttgtcacggcaccacaaactttcgtgtcagaataatttcaaaaccatcatgaactaatcaaaagaaccatgaaccataacaagcaaacctccaccaccccgattcatcatgaatataactaataatcaaagcaaccatgaacctggaccataataatcaaacctccatcaattcggttcatctcaacaggcactctccttcctgcatcatctagaggagcacaaacacataccacaagccagatcagcggttacaaataacaatcaacccagggtatcgaatcacctcgtgtaaggactgatagaaaccgatgatcatccatccatcgattgaaggttgtaatcaaccactcaaatctgaaatcaatcaccgaacccaagtgactaaatcaaacgaccggactgtagacgggaaactgacctcttccttgagacctcgacttgggaacttccaatcaaatccgctccagcaacaaccgaacacggcgaaaggacgaccacgggaaacaacatatagaacacaaaaaaaaacaaaaccaacaaaggatcggattgaatttgaatcaaatcaccggggacaaaaaaaatcaaacacgtcacaagcgggcggatgcaggtgaaattcagggcgacgaaggatccatggctccgatggcggcggttgcaggcggagtagggtaccggccggcggcgaggagttgaggaggcggcggggggaagtgcggctcagcggtgaggtgaggcgggcggcgcggcggcgtggcttcggtggtgtggggaggtccgtggagatggcggcgtgggggagggcggcggcggtgagttcaggcgggcggagcagtggcgtccggcggccggcgcggcgtgggttaggtccggcgggcgtacgcgttatttgtttttcgcagcgtttccttttttttttggggtgcgagcggtgcggtttctttattaaggatgacaggtgggtcccacgcaatagtggacctgatgaattgcaggattagagatgaactcgtactttttatattagtatagatataaaatacaccaattcatcaaactccttagatct

SEQ ID NO: 60116 - DNA, 1331 bp, Oryza sativa
agctcatggaggaggtgtactgtacgatgagaaaaccgagacctatttctggtatggggagaataaggatggcaaaacatacaaagctcacagcaagggagctgatcgggtaggttgaaaattttcttatgctttccatattttgacatcatttatgtgtgcaagagcttttgacatgagttagataggagtagtcacttgggtagcacttctcacagaacctaaatctaatacatgtagtatgcatgtttctttggagtagtgtgtgctaatggatggaccaagttttcctgcccttttacattctgttggtgacaccccattgatagtggacatgttacaattatgttatgttggggaggtacggaaaagcctggcttgtgtcaaggcaggccactaggaatttagtctaatatacatagattgcagagatgaaaagaatagataaagagcttcaaagtgacttcaatagtgccatggcatctgatattgttaactaaccagcatgattggaaattatgtctctgggttttagaaatgagcaaaagggctggttctgaaaaatgggtttttatctgttcagtaaggattccctatgtagtgctttacttggttgtcctgatatgcggagcactgtctctagatagatagggaacaatcatcattttctgtctcagggtgtgtttagttcacgccaaaattggaagtttggttgaaattggaacgatgtgacggaaaagttggaagtttgtgtgtgtagaaaagttttgatgtgatggaaaagttcgaagtttgaagaaaaaatttggaactaaactcggcctcaagagcaaaatgcaccatcctgcagagacacgtagtatttcagagtcaaagtgacatctgtagcgtgtcagagctagtggtgtcagagttagtgactgtcattgtaattaattgtgatattctgttatactgttctgtatagatttctgtgcgtccctatgtcattcctaaccatgataacctttttcaggttgacattgtgggagtaagttgctattcatcaaaggacctgtggacgtggagaaatgaagtagttgttctacgaggtgagaaaaagaatgtgacacatgatctccataaatccagatgtactggagagacccaaagttatatataatgatcggtgtggcaaatatgttatgtggatgcacatagacgatacaaattactccaaagcatcagttggtgtggccatcagtgactctcccacaggcccattcagttacctgtacagcaagcagccacatgactgtgaaagtagagacatgaccatcttcaaggatgac

SEQ ID NO: 60117 - DNA, 778 bp, Oryza sativa
cgtatggcagcttaaatgcatcaaattagatatttagaagctacctaaatgagtgtacaaagtacaaacaactctccaccaggaatttgatatagttaaatgagtgactaaagaatccaaattctttgtatgtttgcccaatttagttttggggccacttcaaatttcacaatctttccaagcaacattatcttgcaattttcagattaacatcattatgaacaatgatgcaatcaatgaccataaacattgagtggtctctttacaatttctgtaacatatggagtggttgattcttaacccaaaaaattcagcagctgagaatttagaaagaaagataaaaaggaaaagacaaattaggtctattcaagatatatacacattacaaatatcagccaaatttccgggacctaatatggccggttttcgaagctaggggtgaaaaaaaaccggtattgtatttcaggggtgaaaaaaaaaactttgagcaaagttcaaggatcaaaaagactttacccaaacaaataatacatgatgcacaagtaacattaccagttttctatttggggggtgattgaatttgcaggtcatcccaaacctacatagtccagtcctcatataataactgcagtctggctctcctatccgctcagggtatggagtggactccatagactctcctcctcctaaagtcatttgccacattgcttctgcaatatcattgagaaacattgttaacaatcacttggcatgactggtatactagagacaaagagca

SEQ ID NO: 60118 - DNA, 1308 bp, Oryza sativa
  unsure (1)..(1308): unsure at all n locations
tattaatatctggtccctatcatacacacattacgtcctagagtctgtgctgcagctggctatagatctatagctcgttgctcttctctcttcctttatctcgtaaaatatctttatagctggctatagcctgctattgtacctgctctaagggcttcttcgaattgtaggaactttagaggatccatttcctataggatttaagtatttttcacttattcggtttggaggaattgggcatgtgaaaaattggaggatttttccttcgcctgtgatttcatataattccatagggaactgaatgttggacgtccttttcattttcctatgtgccgaacaatatgttgtggagatgcatttgatagtgcaaacaatatgttgtggagatgcatttgatagtgcagtgatgtgcggtttaacccggaggtctctattcaatcccctaacacccctataatttcttcttagaaattgtttggagagatgtctctctctccaatctcttttttttttggaataatgtgttgcgtatttttcatgtgttttnnatcctatatttaccatatgtaccctagcctatttctacctattcctatgatttttgcattcctatgttccaaataagccctaagactgtaagtggggtgggccacgccgctaacccgctgggctaacccgccccaccaacccgctagcctacttaggctagcccgctgaagctgatgtgggtttatgcagcaaacccacaccgtccagtgacgctgcaaccaaggtgcatgactgatgcacgcaaaaaaaaatttcatcccgattagtttgttgcttccatggcatccaccatgaagacgtcgagccggccggtcttcgccaggtgccaccgctaatcactgcaaaggtacacgcccatcgtcctattccccaatggcaggttgtggcaccttgcgccgtccacaacctgctcggcacatgcgtcgctggcgaagcagtggacgataaagcttcctctaacacagttgacatcgtcgacgacgtcgaggaccacggcgaatgttggagcaggaacaaacctcgacccctaagcagtatgtcttcaagctaataagaggcttcccgccatggcaccgttgtaggccatcatgatcaattcattatggcgtgatgtgggctaacgtgcgatcaaatgcgaggactaggtgagcagccgagcagccatggcattgaccgatcgtcatacatgatgcagactaacttgtgggtttcaacgggaatccacaataacccagcggttcatacgtgggttcatgcatt

SEQ ID NO: 60119 - DNA, 1111 bp, Oryza sativa
ttgatatggatttggttttccgcacgctttttactgttttccatgagtgatgtattaattatgataacataaagtcacccttaaatatataattttattacaataccgtatgattttttattttcaagatatgccggcttatccattaaagatgtatatcttagaaactatacggtatgcgtatatgtgtttaaggggtgagtatatgtgttatgattgttcgtgtttgtagcatatttctaaaataatacacccatttttcaataatcaaataatataaaaataagatcacacgactaaaacatttgaccatttaaattttctggagaagatgggacgtctgatttgaagtttcttccattttcgtcacttcccaaatcccccgaaaaaaaaatctccagctgccaaagtcctccgtcactggatcgcatgactcgcgtctcgtcgccccttccttccgcttcagagttgggctgtgtttagttctacactaaaattataagtttgaagaaattgaaatgatatgatagaaaagttgaaagtttgtgtgcaggaaaatttgatgtgacgaaaaagttagaagtttgtgtaggaaagttagaatctacacagggcaggcacacacaacccacatcaaacacggcggccacctgctgccgcacaagaccacaaagcccccaaccacgacaccgcaccacatccccgccgcacaccgccagtacaggtgtccggtggtgtcccctccctcctccggtcagccatccccccacgcacgcacccgccaactacttgacggcttgacgcccgacctttcccccacaacgaccaactactttgcagccttgcaggcagcgcgagggagggaggagaggcgggggccattgccagccgctccagcaacggcgggcgccaccacaatctccctgtccctgcagggggtagggggggtttggatcacagcgaggataatcggagggtgtcggggcctgatccgtttgctgccgagatctcacaagagcagcgagaaacaccccatggtgagcctcctcacctgattctttttaaattggtttgttcgatgggggaaggcttttcatttgtcctagtgctg

SEQ ID NO: 60120 - DNA, 1338 bp, Oryza sativa
gaaagtgcatgattttcacacgagaggcacacaccgttactccctattattcctgaatggcaacggaggcatgcatgctgcacgcacggagtttatactaggccggttgtctaaatggtggagggacacgtggcagtaaataaacaggtaaaagatggaccaagctggcaaggagattagccagctttagatatataaactagaaaacacagcgcggcaaaagccgcgccttacggtgattgttctatttatttgaacattttctcatggccaacaggtggaaacagagatatatagtttagggaagttgaacaaggcacttgacaaaaaatatataaacattattgtcactaaagaagaaaaaaaattcaacacactccaaatttgtttggtactttttatttcaaattccaaacatacgtaatttttggaggcacgcgtagcatatattcagtaaagaaagtttcatataaactaactattcaataaaattcaagggtctatgcattttctttcttgccttctttgctggcaagagttttctgctaggaacttgatacatattggaccagtttagctagagatctggtgtgctctcaataacactaagcccaacttccttaacatcaacaacattatagcgatcctctttgcagagaaacttaagagcaacctggtagccatcccagaaagaaaaatccttcactttctctcacctctccaagatattcagcaattataggctttggatttatcttcattgactttagcctgacagagtttcggagaatataaagtgccagctccagttgatctttctgaccataaaatcctgtaatgtagatcattttaagatgggaatgagggtgtgaaggaagactcctcaactcagcatgatcctcactataaaaagatccagtaagagtcacccaaagaaaaacaatagtcccacgtttgctatcatttgatagaactttcacatctctgaaaacaaagaatggacttcggcagccattgatcatttctattttgcaaattaatgttaaaccaagtgatggtgcatgctagtctgattattaaatctttattctttgatgtttgcaatatggtagttaggaatggaactaaagacttagaatataggtggcggcatagtgatgactgatattgcaataaaatcatatgatcagccttgagcagctctcaatgttgacattgaccaaaattaacttattttattatcataaggatccaaagaagaatgacaatatggcatggcatacaaagggattctagtgaaggccaatcgacgatattgactaagatgatatgatacaa

SEQ ID NO: 60121 - DNA, 1230 bp, Oryza sativa
tccaacagattctagtacataacaacataacacttgtgcagcacctctcagtaaaaacctgatattgtaaaacggcaaatttaagtagagataaaagtcaaaaactaatttgtaaccacaacacttcacacatgagctgacacatacaatgcaagaactgtcaaggaagatggataaacaacagaatataattaggatatggtctcgattctgttggcatttaactactatccacagattatacagcaaagaaggcatatacacattatgtgttgatctgttactctcttagcattaaaaataaaccactacacatgcattaaaatgtgacatgcatatacctggtttgaagaacacggatagaccaaaatatattgcgtctatatcatcatctcctttttagctcgctgtaatgcccttctcctgaacgccaccaccgacctcctcgctcccatccaacgacgaggaggaggggccagcggcagggacgaagctaagtagtgttatggggttcctaggcacccggttgcaaaagaaaaattagtgcttaataccccttagtaaccatatgtgcaccccctcagctaagcttggtgtacccccacgctagaaatcaggccattgaagcacgaacagcctacaaccataaccacgataggagcccagttcagtcctgcttgcctcatcagcgtgaggacgtacgcacacgcacgcctcttctctttttttttctttctggcgactcgctcttcctctttgtccctaccagtgccgacgcctcttgccgctaatgccacaattaatcctcgcctcttaccgccaatgccataattaatcctggatgactaattaatcgacgcctcagcaagatgatgggatgtcaccgaggctgggcacaggcaattccttgcctcctctatcttctgttctatttgctaattctttaccagtcaatggattcatttgaatagctccttcacttttcaattacgcgataatagctatctttttttccagatcgaatggttatggttagtgcagttttttatctctgcttctttgttagtgcattccactgttattgctgatgataacaacacgcaaaaaaattataatttactataatattgttttaaaaaatatataaattactccctccgtttaaaaatataaaaagttttagagttggacacgattattaagaaagtttggatgagtagtgaatgtagg

SEQ ID NO: 60122 - DNA, 1794 bp, Oryza sativa
  unsure (1)..(1794): unsure at all n locations
ctagcagcaaaaatttaaagcaattgttccaaatttaaaataccctcattaaagtacatccaatcattaacatttaaaaaaaatagggcgagggggcgaagcatctagtccctattattaattttggtaattaatgataagtgctaattatagactaactattctatttgagtgatataattgagttagaaccacatgatgtatatgccaatgatgtatatgccaaggatgattaccatggattaaaatttatggcacaaagaaattaatggaataaggtggtaaatctagcctgattattttaatcgatcgaggcgttgggcgattgaatttttgctaagtttatttctaactttgacatactatcaagaggggtagtgactttggtaaataagtgatcaaaataacacagtaggtcatttgcatgagggcttggttcgataattttattcatcttattttttgtccaaggtcggtttgaccatgggctccagggcagtctgactggcgtgccctagtctttctgaccaggctgggctcggtctaaccgggcacctggcaagttggttggatggccacgtcttggggatccaaagtcaccagagccgatggcagtctgaccgagccggggccagtcagattggagccaccaacagtctgaccggcaagtattcccacgtgcattcaatgcacaacaacggctagttttctaggcgttgccctagaggccaatctgaccgatcaccccttggcagtctcactggcaggcatctgagagttagggtattggctccaacgactagttttgatgggtggggtataaatactcccccaccagcaacgaggggcctctcttggcacactattcacttgcatatactcaatacattcactctttgaccaaattcgttgtgattgtttgagagtagtttgattcaagacaagtgcattgcattattgtttaagctaatgtgatacttgatcatctctaagccgggttgttattacttttggaggttgccgcctcctagacgatgttggtatttgctacggtcacaggtacatccgcaagtgcacggatacgctatagcatgctatccatgagcatttccaagggtatatatttatatttccgaagagaaagcggcgacgcaaaaatatagtttatacatcattaatcaatttataattaactcatcatagtctaaacatgggttagaataaatatgattgagtgtattatgtattatgccttgtaagtaaatacataagagaattacgatacaatgtctagtatacacttaatacataatacataagtcttacaaggcntaaagggtccttgggacagacctccacgaggtcagtaaaattcactcataccctctattttttgcctttttcaccctatacttgtaggattaggtaaccaattgtggtgcaatgtctctcgtatgaatcctgtctctagttagttgcttgtcaatctcttccttgatgcacaacgtactcttgatcaagtgacccacatgatagtacaagatttatttttcatcataagattttaatgcaaaagtaattagtcagtatgcccccagcgttttttatacaactaaaataataaaaatgattaatcctattgaagtataaaaataagtaacccatagtacgctcacgataagatgaacatacatggttgtcttataaccacacttccgaaagaacatacgcgtggtcataaacatggttgcttaaggtaaaagtataactgaccgctgcacagggctgcaggaa

SEQ ID NO: 60123 - DNA, 2117 bp, Oryza sativa
agtgtgtcatgcttctaagagtaaaacaaaattgaaaaggatgaatttacagtgagatatggtcattattcattgtatacaattaaaagtatacccttgcacaatagaatatctcctagacgatagatatctttagctatgtgttgttgatataccatccatgagtattctctattgaaaaaaaggctgtctaagacggtttatccaataaaactttcttcacaaaacataagcctaatgtaccattgatacactgcccaacagaatctgattctccttattggcagcttcatcagtattcttccaatcatttagtttttgtagggaccttttagcatcataaacaccataaactttataataccacaccatccttgatacatcatcctgcggtgaatttatctccttccttttgattgtcttatgaagttcacagaagaattttggatcttgcagtttaatatactcacgcaatacaagctcgtggtgaggcacccagtttctagggaaaggtgtgtagtcacacgatggaattgatgacatgcgtgcaaattgtacaccctcaataatatcaactagtcccattctcaagagatcagagtattctggtgcatcattccttgtgctctctctcaatgggcggctaaggtcacgtgaggcaatctttgtaaactttagctcgagacttgagtctataccttgccgcataaagctttgccaaggaactcctaatgacatatgcacagaaccctacaatcttcttccggttgtctgcatatctgtaccaatcagccatggtctcaagaaatttgttcatctgagagttagtgtgcgcctgcccagagtacagcattggtgaacatggcaatggctcaggatccgatccccctttacaagttcaagcttcctgaaatgccttatgcacctctgaaggcttgctgttactgataataatgtcccaatacctttctcactcacaatgttccctccactagcggtatatcttaaggttgggtagatgacccggcgggtgatcacatgatccaagaactcaatccctcttgtgatgtgctcaatctctaccatcgaattctcaggcctcaaaccaaacgtgctctcgcagaactccatcagttgtctccttatctcaactgcgtcctcccttggtcccctgatcccaataagaacatgggagccaaatctaaggtaatccatcttccttgtcttctccttcccacttgatgggacaaactcaggccaggcaggattatggcatccttcatcacccgcctccttccaaatcgaatcatggcttgacgggcggaagtactcatgaattctctcctcgagccaccaatccagttcgttaaggcacacattggcaagcaaagggctaatatcccacaatgcccataattcggtgcatggcacgcctgttctggggcaaacccgaagaataacctcaaccaatacggatcaggcttgggctcgttctcattgagcaccttcttcttcctgcttttcctgagaaccttcctcttcagcctcttcttagctaggccatcaagctccttctcccgtggtggcacagacccaggccggacaggggcattgagcgccgacttcagcaaagataagaccttgcggtcagagacggccttctggacgcaggagagtatggtataaggcgagagtgcgtcgaccaccccggtgaggtccgcggagatgaaccagaggtaggcggcgaagtgggagcggacggagcggatggcggtgtggggcccgcggccggggcggaaggcgtgggacttcggagagaaacggggctcgaagacgggctcgaggagcaggaggaggagctcctggacgacgcggtcctggaacgggggcggcgcgttggcgaggcgggcttcgagcttgcggcgggagatggtgacggtggaaggggggtcggccggggagcggatgaggaggtgcgtggaggcgccccaggggaaggcggggtggcggcggagggcggcggcgcggaggcggaggagggagtggagggtggggagctggacggcgtggcgtggcgggaaggagcccgtggcgtgggcgcaggctcgctggtaaga

SEQ ID NO: 60124 - DNA, 2643 bp, Oryza sativa
  unsure (1)..(2643): unsure at all n locations
tttaaaaattcgatctttagaatctcaaaactgatctcggtctccaacaaaacttaagaccgagcaattcggtcttcggttagttcggttcggtctcggttatagacctaactaaccataacaaaagtttgaacaacaaaaaaacaaattaaataatcagtaagatcgatgaatcaagcaattaggccgcagatgacacactacaaattggtgtcactagcaaatcgagcacgatttagaaaaaaaaaagcaaatcgagccgatttagaaaaaaaaaagcaaattgatactgtcaatctgccatgacttaaatccattgacttgaatctgcaatctactcatggctgtcctcttcccatcaccgagctcatagctcacagcgaatcggcgatggaggttggctggaggcggaccctacttgcaaggtctctcaaaccattgggggaaaagtgtagttctacaaaattggtagtccttatttaaagaagtgcaattttgtaccaattttggcaatataagtgaatgcttgcacaaagatttattaacacataatcttgctcctcaagttcaggtaggaattgcaagtgcaaatcaaaatgtactgcatatgcataccagagcaggaatttgggcaactcaaagtgcttgcaggtttgcaaacacacaaaaaccatcccaccatctaggcattcgttctccggatccacagttacataggagtaccaaattgaatggaaataaaacaacatcatctgtgtagtgtgtaggtgctgtctagcctttaaatttttcctaccctattcaatgaaacaacgcattttctggtgcattcgttcaaagaaaaacatctcccaagaatctcccaagtaattcctttcaagacacattacaagaatcgacaaaatttctgaaatactcccaagatcatgtattcatgttacttccactcatcttgcactgaatttacatgatgaaagaaagcgagacgagaacaaattgcagagaagaagcacaattgttatgcctgcaaatttacaggatgcaaacgagaaaacaaatcggagcatttcaccaaattaataccacgaattatatgattatgcaagcgctaaacctgattagagatgcaattggaagaaccgtgcgagccgttgtctcctactgccgccgccgccgttgtcgtcgtctctactgctgctggcgcggtggcggaccgttggcatggccgtcgagcttggccctgagctccttggcgccctggcgaactctggcaactcggcctccccgacctcgcccacgtcgacgtcccaccagaaccgcccctcggccttcgcctgcaagatcttcgccgtgatgccgcgcatccgcgccttctccgccgcgacctccgccctggtctcccccaccgcctacctcagcatctcgaggtcgacgtccttgcctaacccgccgctgtggacgggtgcgggctcagcatcctccccggggacggggccgtaggagaggaggacggcgtcgacggatgggtcaccgaaggcgtaggcaaggttggtctcggagaagacgacgacggcgatgctcgcgccggcgagcagggcgagctccgacgccttcttgannnnnngccccgccgcttggtgaaggtgacctgccgcctttccttgttgtcgatgtgctgcctccccttactagtcctcccgagcggacgcatcgtcctcgtcgatcaagagacgcggatgagggcgacggcggctctgcttcttggtttcttgggtgctctggttcttgcaagtgctgcttctccaaaatgaaaaacaatgcgatgatatcccactacaaaatggagatcgaaattttgggggcttcggttgcccacatttcctaaatattgaggtgggataaacggggaagtgtgctagaagaatatgtgcggagaaaataaaaaaaattcactaaatcgcaattggaactgggaaaattgttagaagaataggtgtggagaaattttttgttaagtaaatgaaaattgtcaaaagaatgctacatacatgtatatatttgttaagtgaagatgtttaataaggcctaaagattacacggagaagacataaaaatccgagaaatgaatcaaaggggaaaacaaagaataatcaatcacaaatcaagtttacaatacaaagatagcatgtctcatgcccacatcgtgtctttacgtcgcatcctaatcagtgtttaatttggtaaaattggctatgacatgcccttttggtcttgttttgcatgcattagacaacttcatacaccaaagcaaacattttaaattcatgtactaaaaagcattcacctaacaagtttgtacatcatcaatacaatctactcaaaattagaatttcatttttctagttgcactctcatggatcattcaaaattagaatttcatttttccagttgcactctcatggatcattgacaagtgatggatccaccggtgggtcgtagagacagctattattcttagactattactatagccctcatttcaaatataagtcatcttagtgttatatacaggattaagaaaaaaatatacaataatcatagaaataagtttaaattccctaggatcacaattcgcgtgtttcg

SEQ ID NO: 60125 - DNA, 1341 bp, Oryza sativa
ccatggcgcgagcctcaagggcctcttagcgctgccgggacgccgcctcgttttccgccgcccgccgttcccgtgcagcggcggcgtcaaggactccccgggcggcgtcgagccaatcgctcttccagtcgtcccacttcttgcggagaacgcagggaatgtagcggtgtagcacctgcccccgcggctggaagtagcaaccaccaactaccgtcggcggcgacaccggctgtacggtgaagaaccactggaacagccggagagatgggcgcaccccgataaacatctcgcacaggtgcgcgaagatggccaacgtcattattgcgttaggggtgaggtgcgccatctggagatcataaaactccagaatatccatgaaaaaagaagagaatggcgggaccagccctgccattgcgaaagagaggaagaagacggaccgccccgggtagtgtggcgccgggcgtccctcgcccagctcgaccacctcccggccggtggcagattccggcatgaatcggcgcggagcccggcctgcctctcgctcacgatgcgggaaggcggcagcacgctaccgtcgagcggtgtggagccccgtgccatgacgccggcggaggaggagcttgagagcgagcgagtacggcgagggtagggcacaggaaacgaagagttagagcgcaagtggcgaaggcaaggggaatagtggcgagaggaaggaaacgaatctcttcctcggcgtctttatacccttgccaacgctattcccggctcctcgtttcccgcgcccactacctcgcccctcgtttctcgcgcccacgcctccactaatcccactcgcccgtttgcggcgcacgcggcagatgtgcggccgtggcagttgagatgggacagatcgtgctcgcgttaactacgctcgccgaccgaagcgccatcatcatgtctccaggcgaaacgaaccggctcgtcccgattcgcacgctactcgagtaatgtagcggtcttaaagagaccgctcattattgacggtcgtttttcccttgccgatgtgcgcgatttgcgaccactgggtttctgcccgcctgtagagaccggccccacctgtcaccaggcctaaggagtggcgtcacacccgagcgcttccctcgaggggggcgatcgccctggcgtaacgccgggggctactgtcggtgacatgggaccgggggtatcgtgactagaggcttgggcagccgctgtcacccacgtggcctgaccccctcgggggggtcaggcctgagggtgacgaggccacccctccctctgtctccccgaggggtcgggccgctcccgttttggccccgaggg

SEQ ID NO: 60126 - DNA, 1422 bp, Oryza sativa
acatgggcagagctacattagattaggcgggtgctcaggaacctggtcaagcaattgttttagctataatctgtctattttcaccatatgtgcaccccctcggttcaaattcaggcacccgcatcagcctaaactcggtccaaagtagagcaaaacaagcgagtggcatccctgccatttagttctagctccgcccagtaggtgggacaaaaacctaggcagaagtatcttgcatagtaagcaagcccccccataagcctttctttagtactagtatgtattcaatttctctgtaatattcaggatcaaaccagttatttctctaacttcaatttagtggagtttaactactacagctttttgttgattgattgagagctggagttatttgagttgaaaattggatatctataccgagtaacttcattgtgtaaggtatttggtgcatatttcccttcctagtgtggtagtacagattatgaaaagtttcttttagtactaggttgacaagctcacttgcaaattccattactttctgctttatcaagttttggtacgaggaactggatttctgattattgttttttgtggttcatgcctgttagtagttccaataaattataatacttgagtaatctgtaatttggtactttttgcctatcgggggatgctaccctaacatctatctctttcctgctaacagggagaacctgtctgcacattctattctcgttacgggatctgcaagtttggtcctaattgcaaatttgaccatcctatgggaacccttatgtatggaagtgcaacatcaccaagaggtgatgtgtcatctatgcattatcagttgtcaccctcaccagggcatccaggaatattgcttgatggaggctctggaaggtctcaccgggttcctcagtctgattcccagcaaataccctctggcgatgggaatgccgagagagaggcatcataagccctcctcggcctttcctcatgctacctcccattcttgactcttcagtaattatctccaacaaattcaaagagctgaagctgtacaggtccttgtccatcctttttctgcttctctgaatcaccacacaccggtgcttcatcatgtatcacattcaggcaggaaaatgttcttgcttgcccctccccgccccaattcctgcatgccccgtgaaaataaatggggcaaccattcttatttatccctaccatatatacacacacaagatacactcacctcctgacactcggttcggcgaatgatgtgccttgatccctctgttgtagttatacaggtggcctgcagtggacaaagcttaccaaactgactgtattggggattctgtttcgttttgctcttcttcctttctaggcattggggagtaagcgcaagacttgctgcttgtgcaa

SEQ ID NO: 60127 - DNA, 999 bp, Oryza sativa
acaccaccctccaaatccccacgccgaccgcatcctcctcccgaagatgccgctccaccactctgacgtctataacccccctcccaccaccaccaccaccaccaccaccaccacgcacctctcccctccccgccgccgccgatggcctcccatctcctcctccgccttcccgcccctcccccgcttctcctacacttcccgcagcggcgagtgaccctgccacagagccgggtgtcccccacggcgccgctgctcggggcccgcctcgtcttctccccagcctccgccgtccgtccggcccgggcgagggggtcctcgatcggcggcgcgggggaggacgactcagacggcgaggtggacggggccccgcgcctcgtcggggaggactcggcggcgttccggctgggcgaccagcgggtggcgtcgtgggtctacttcggcgggatactcgccgtggtgctgtgggggctcaacgtgctgtggatcgacccggccaccggggtcgggaccaggttcctcgaggccgtcgccgccgtctccgacaaccacgaggtgcgccggtagatatcgttttcccttccagaaaattgcttttcgcttctcttgtgttaattagtgtactttgagaggagagcctctttactttttttttttggccaaacctaatatttctgcgttttatatactgaattaataattcagtatggactaaatatgcatgcttttagtcaacctgtactgactagtgaaatgacaaaccagtgcagattccattttgatgctctgtggcatgtaggtagttcaacgctttttagtttggactgccaatgaagcaattgaatgtgatattgatttcttgtgtgcttctagtttcggtaattcaaacataaattggaccaaataagacagatcaggcttgatgcttgtgaaactgaacattccctccctatatttacatgaaagctataaactgggtatatggcaaactcctatttatga

SEQ ID NO: 60128 - DNA, 713 bp, Oryza sativa
tgtgaggcttgcgaggttgcttcgattacacacaactgtggcacttagaacctttgacaatggaaaacttaggaattaaatacatgctggaaagccgagacatcaagccaaaattaatatgacataaacgtgagtgccaaacattagcctcatcatccacactaccacaaatatggttcacagacttattgcagaaatcagaaagggaaaaacggaacaggcctctagacacaactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacctagcccattaggacggtggaaccccgtgcgacctgataagaagaaagcaatgagatgtcagcacaaacatgtacattggccccagtatcaacccaccaattagtagactgattaactgaaaaaacagtaggtaaattaccatacccgcttccatctccagtgttgccaatggtcacattagcagacttagaagtctgccctacaggtgccttcatccccttgcgttgtggacacttcctagccagatgaccaggttgcccacacacaaagcaagtcctctcatcctggttaggattgttgttgttctt

SEQ ID NO: 60129 - DNA, 715 bp, Oryza sativa
ccaccttgcttattctaggagagggtgacctccttaaaagggaggatgccctcctagccacttgaagcatgtgtggtggagagaagaggggaaacacacgcacgcgctcgatggcctgccctggcagggcagggcaggcggcaccgtgcacgacgtacgcgttgaatggtccacaaaattggctcctcacccttgcgcagatgcagcttccttttgtagttttgttttgctgcgggaaattcggatttgttttgttttggaaacattccgaaaaatccggtgcgtgaaaacggcatggagttcggataggttacgcacgacttatccggttcggtttacgcgggcgccctgatcaggcgatctatctctatataaaccgagccgccgccttcacgcaacacacgcgaaaccaatctagggtttgcctcctactctgtactgcgccgtcgctcgtagactactccatcccgctcaccggcgtgcaccggcgatcgggagagcaggtctccgaaacctctaccttcgacgtcctacaccgggagaaggcggcaataaggtttttgggaagcgcttcgcgcgactgctccctgtttgtccgcgacggctcgccttcctctccgctcgcgtgcttcgcgtcttcgtcgacgctcgcaaccgcgagtagttcctgccgagcaaccggtctttccaccacctcggtacgtgttcgacatgt

SEQ ID NO: 60130 - DNA, 3783 bp, Oryza sativa
ttctccttcccgaatcattcacagttactgcatataacaaattctactgctccgaaattagagcaatattggcaaaaattacagcaatgcacacttcaggaaaatattatagcataattgtcctgcttcagttattaatgggcgaaatttatttatgaacaatctttcttcagtggcctgtttgttgatgacctgggaaccaattttcttgccagaaactctatactatagttttgcaaggtagcataaggaaaaatttagaagcttcacatactggatggatttttttagtagttagcattttggttattggcagtcaaattttttttagtagaatggtaggaggatgggcttatatttggcacaattaattattcagaagatgttgtctcaatcttccattttactctactaaacttattccatatgttttcttaaatgttaaatacttaaaatgggactgcagtgggtctctgatggttgcttgatagccataaggaaaagagagacaaaaataatgaattcatgcagaggtttcagtcaattgcaaataatatgagattggtcgacttaaaattgaggatggtgtgatatgacgagcctctggtgatatgatcattttcctttttcatgtcaggattgacatctttggattgcataccagaattttccatgttcttcagctcgcaataattcatcttcaggtaatatgatggtagtctaggtttttagatgatttgcagcaaggagtgaaaataaattgatcagcactgcaacattgattttcttatggtttgtcgctttagcaaccactctccttatttgcaagctcatgatgtgttgtaagatctagagttgtctagcgaaatcaaacctaacctcccccagtttactgttcgatgtggctgctacaattcttttactaaaagtatgtcaatttatttgttctatatcaggcttgtgtcgaggagaaagggaagcgaggaaaatttgtaggtgaagaaattgacagattgcaatgggcaccagttgtgctggtaattttcttgaaacctgacactataatttcaggttacactcttaatccaagccacaacaaatgtgagtggttttatatgttgaccatctgttatgagctctagaattttttttcatactgcacaggaatggatatcatgcttaatgaatactactgtgctgcagttttcctttctgttttggtgaatttagtaccatatatgcagcaggtcgtgatcagtttttgctacttttgcttgcagtcggtggaactgaacctggctctttctattcagatacagcggttcctgcgtgatcaatatctcaaatctcaatgaagataggcagattgctattccaggttggttctctgaatgtgtgcaagtttgcaatttgtatatcattggctgtatacggttgatataaatttgcagatcactggctgtatatggttgattacttgatatgagggtaactgggaaatccgtgataaggtgtgaaacatcccttttgatgcatttctgtagcactattgaagtaccaaggagtttttgtggccatatttatttatcaccattcaatgaataataactcttcctaatcagcgctaaattttttaacaaaatctgtaacagaattgttctgatttgaaacttagtaatctggtgtgatgcatattatatactaatgtaatgctgctggcggcgtgatgcccactcagtgtaggagttggagggtgtaggactggggttcgcattgccaatgagaggaggaagaccgcctccaagagccttgtccccatcctgtacatggccgtgatgatcgttgacatcgaccaggatctcttcagggtaagtagaacgacactaaaattaggattaacatttctaaacaccatgttatttcagaaattgattagttggaatcttgtattcattttgctagcctaagtgcctactgcctaacttaatggaaatatattggaaaagtttctccatggcagatcgaggctgctatttcctgtagatttaggtttcgctgtaaatactgaacaattgatgcaattttctatttgtattgagtacttgggtggttctttctatcaaccaaatcaatttttctaccctatatctaccctatagttcaacaaatagtttcactcatcactcattctttcattcctcgtgtaacggttcagaatatctgcgtgaaatccaacactcacaatcgtctccgcctcgcgttttcctccccaatcgctccccctcccgacctcccacaataggcgcctagattgctcccccgttcccctgccgctgccaccttctcctctctcctctaccgccacaagcaccgcccctaccaccctggtgaaaccctaatcgccggcgccacctcctctcttcccgttggggctgatcccccaccgccaactcgtcgtcgcgccgatctccctcccctgccaaactctaattgccgttgccactccctcctctctccgttgtctccctactccgatctctctccgttgtctccccatcgtcccctcctctctctctcgcaccgagacgccgccaacgcgtcgcgccgcccctccgtgattcctcctctccgcacgggcatggccctctcctgctttccacgcctcccctccctgcttgactccatcccgtcaaacgccgacctcgctgcacagcaccgcacccccatcccgtcggccgttctctccctcaggcgccgtcgtggatctcccgccatgctcgcaccagcattcagatcgacgccacctcgccgatctcctctgtgccgccgccacgatccgccatcacacacaaatcatcgtcgaagattcgctgcccgtcgtcgacgacttcatcgctgccatctccgacttctttgccctcgacctccgtcactgggcgccatccactggtatccagattgccgtgtgtagtcttcgctccggtatgtctatgttaaatagtcagattcatgtctatttgctatttttgttgttcgcggctgtttgttctaatcatttttttttggggaacgggtttacaaattgcagcagctaggctattcatcaatagtaaaatgttaactgtgcatatctgtcattttgtaatatgataacttgtgtgtgatggctcgcggataacgtatgagaatttctatagatttttgtttacagcatgaactaactatttttttttgaggagaacgacggcaggagatctgccggaatttaattagaaggaagaaaaaaacagtacaaaaccagttcagtcccgaaaataaaaagaaaatagtacaacaatacacggcacaaaacaaaagaaactatggaggcctaaaagccgagcaacggagatcaagatcttgttttactatatatgccactgctctctctaagattgaaatgttgttgaaaattctcctgtttctttctaaccaaacattccaccaagtggtaagcagagctcctcttatcgccttcttttgctccttcgatcccatacaatcaatttgggcccaccaatcggaggttccgacagagaggccaacattgtttgtagataaatgttgccaggaagtaactagagaccaaacttccttgaagaaggggcattcactaaacagatgattagtgtcttcaaaggcgcttgtgcataaactacaaatccaattgcacggccagtgtcttctcaacaagttttgagccgtaagagttttctggtggaggactagtcagccaaaaaattt

SEQ ID NO: 60131 - DNA, 1802 bp, Oryza sativa
gaagagaaatctaaggaaacaaaagatccttgatattggaaaagataagcactcttacttgtgtaaactttggatccattccagttccaagagatgtcatcaggacgcggggtaagcatgactccctgaagcatgctcccaaggtgaacaagttcgtggatttcttctattgatgttatttgcctgaaagagatcaaccagttattgttatggagctcttgatggacgcctttttgctttctttttgccaacttgaaacacagtggtgcaatgtcttttgggcagctgttttgtagccaattgtcatgccaaaagtttatttttgcgccattacctagctcaattgtcgttgctgcctgaaataaccttttatctgtatcatcacagggaacgctcatgccagcccatggtttgttttcatccttccaaccgagccaaagccaacgaagacgatgggctcgcgaaaacctctctaaaaccaactatgaacaattgcaatcttacgtgttgatgatcatgggtgaagttcacatgtcttttctctaggattggtcactatatgccattacagtacacctgtgagtttaatgttttttaaactacgtataacgctcacattgcagctggtttattccataataaacagtttttttcacaaggttatcagtgattagattctttgagcgtaggaaaagacaaagtttgatttttcttttttgcatgtttggatgggtattttggtttaatctagcgatagggtggttaatagatcaatctccttcaaagcacattatagctttcacatccagtagcgacttatatgaagcacattttcttgccttttttggcacttaacttttaccatccagaggtgacaaaattgttggtagaatttctttttccccttcaacaactgctaataaattgttgcaattcagaaagacagaaaaaaatgactttaatatgacatagctcaactagaagcgaaaattgttagcacgacaacacatggttcaaataatgaaagggtagaagcagaagcatattccaaataaggccactcccgatcataaagaacggattcagggaacacgtatctgatattctgatctcatctcagaaaagtgatgtacaatcatgcatcatggtgctacgaaactacaaatattaccgtgtggatttaaagagttccatattcaaatatctatgttatatcaaaaagagaaccttgacaaatgatatgttcaatctgtcagaatagttatatagtcaatcaacatcctaccatattaatgatcaaaattctgaaatatctactgcacaatcccatatagtcaatcaacatcctaacatattaatggtcaaaattgtgaaagatctactgcacaatcccatagcaacctacaatcgacgaacaaacaggaaaaacaatctacctaaggattaatatcattatagagaaaattatacgacccttcctctataacatatagactcaaactttaaattcgcattagcactcaatgcatactttctggttgccatccttgtttaactcaaaacatttcatcattcatgttaaatatttgcatcattgtactcagacaacacaaacatagtgaccaactgaccatcatactgtgatgtacatcaaggaaacatatctgccatgggcaacaatagactaatatttattgaatatcaatttgttcaacaaggctgaggccgcatggcttgataagggcctcatgtgctctatatgtgtgaaacatcatatagactgcaagaaagaattttggcga

SEQ ID NO: 60132 - DNA, 2323 bp, Oryza sativa
attctgcaaggcaggaacagaaggaggctagttgcagtattgtcattatagcatgtccaggtaatttcttagccagataaaaatgcaaaaacagatcttggcaacaaagaaaaaagagcaaaacggatagatgtcatgtctaatggaaatgctatctaaaaggcatagtacatgattttatgtcaatttttttgtgtacacaaacaactcataatcagttctatgtgtgtcggccatagttacataccacgaaatatatggcgaaatttccattcattatcatgcaaatctcttgcaatcagctcctgtgccggaggctgctgtgaaaaatcctacagagaactaaaggagtcaatttgaagaacacatagcaaatgaacatttcctaccaaaaaaaagactgagcttaaaggcatactagtggagggaagactttctcagctgcccggcggggaacagagaaaccaccatgagtgctcgtgtcacttgcagtcaatgtcttgcagaagtaattagtgggttgcttgctagcagcacccaactccattggaaggaaaggctccttttgctcttcctgtcaacaggattacatgacaaatacataatccttgtaacatctttgcccttttaaaagaaataaggctagaagtgcaaagcagtggtcaaataccgggctcaatggttgcaatgtcatctgagcataaacttcatctgtctctgcatcagcctgcaaaagcaccaggtgaattatcataagctgcttattaagaagctacatgatggtttctttaagagtgaactcacatgcatggtgacattatgaagctggcagattaactgaggaggtaagtttggataatttgggatttgagcatcaacttccttattagttgatgccgcaacctgcacagaactaaaattactttagacagtacagtttcagttcattcttctgccatattaagtttaatgatgcactgagcaaacaataaagacaatcctctgccctattatgtactgatgcacaaatgcaaaagcagagctgttctaccttcttttataaattctagtaaattcgagtcaacaaaatccggccatgcctagcataatgaaagagatgtgcacagactacaaaccaagtgactgacctgctcgctatggccctgtggaaagtagacgaccctgctcctgaccactggcaaagacacaaggggcccagcgcatgcatgccacagctccgagttcagacatctttgttcccctgcaacatgccaaacacacatgagctgaacagcaaaccaccagaaagttaagttcatgtgaagctactatttgtacttgcccacagacagtaggaggttcagtcagtatcaaataatgttataacatgagggcaatgaacagagccaagtaatgtaggagtagttctttttttttctttcttttttctttgtgtgtgtatgtgcggagtgtgtgcaaggcagcaatggagactcatttatgcattatgtaatcatgcacaaacaactcaaagtgcagaatcacaaagctccatgatccataatccactttacaatgcaggcatcaacacaagctgagaaagtgcagaactgaaacaatgtcgaaattgtgagcaaggatatataccgtcgttctccggcaaggcctgcggcatatccgccgacgccggcggagagagcttcatctccaatcaccagtgcacccgtcgccaaagagcacgaaactccgccgcaccaggataccggagaagctgctggtcagcttcccatcatgctcccagcagcagcagcaaacacctgccttcctctcttgcgcccagaaatatcttccatttttttctccctcaacaactaaccaaaacctggaccgtcgcagcaaatcctccccttcatctccccgaaaaaattccacacaaactctttaaatcaatcaaacttggaaaccaatcacccccctcagagctcgagtattttcacccaaaactgatgaaaaacacccaggcgaccgcaactcgatccgaagaaccggattttcgccaacggcgggagcaagtgagcggagaaaccgaagaacgccgccgaccccgagttcatcagatcaacacgcagctcatcccaagcactcaaaacacagcaccttcactctcggcgacggctaacccaaaccgccgccctcaaatcgccaccgacactagcccgcagccgccgccgccgcggacgagtccagccttcctctcaggcgccgccgccgcaaccgcgcaccccccggagctcacgagatcgcggaatcaggcgacgacgac

SEQ ID NO: 60133 - DNA, 4185 bp, Oryza sativa
agtttggtgtggcaaactgaggccaccaacaaacagccccgtaggtcatgcgtcgtttaaattatgtgtggagtgaattcataggaaattttaaaattattgtttgattacactaatataaaaactagacaacgataaaatcttactactcaccctgtttcaagttataagacattttgactttgattaaagttaaattgttttaagtttgactaaatttatagacaaatatagtactccctccgtattgtaatgtatgacgccgttaactttttgaccaatgtttgaccattcgttttattcaaaattcttgtgcaaatataaaaatatttctgtcatgcttaaagaacatttgataacgaatcaagtcataataaaataaatgataattatataatttttttataagacgaatggttaaatgttggaaaaaaagtcaacggcgttatacattaaaatatggatgtagtaatatttataataccaaattagtttcatcaaatcaataattgaatatattttcataataattttgttatgggttaaaaatgttactattttttctataaatttagtcaaatttaaagcaattttgtaatctgaaacgaagggaatacttgctaattttccgctaaccaaggacatgtccatcgggagatgatgggtcaatgattttatatgtttatgggtcaatggtgctcaaagtgttttttagtttttctctatgggtacttttttgtttttttcggggagagaggttgacgaatgggagggacggacggctaaaatttgcataggaattttaaaatatttagtaaaagtcacttgacccattcatgtactatttcaattctccaagatttctctaattatcctatattccaaaacagatgaaactagcatgcggtgcaattggccaaggggtactttgcttcaaatgttaattctgaaagaaattgagatagtgtcaactaatactctagacacgatttgttatcacatgttttttacttgaagtatcatctgtgctaacggaggtcctaccgccacagttttaaaattaacacaacaattttacaacgagtagtttgtttcgacaaaacataggacctcatcgtttgccctatggcttataagacgttgccaaaatttgatttggacaattgattctggagttgattttaatgttctgtagtataattttgttcaacattggtttttaagtcactcgggatatatacacaaaaaattttatctaccgcttgaaaaatttaaaaaattcactcgagtgcttctctactaccatagcgaaattaatgttctgtagtactgtttagagtaacaagtcatagtttatttggtagagctccaactcctaaatttgctttaggagttaggtctagagtgaagttgtgagctgtataaatccagctccacctctatagttcattttgtgagagagcttcacccagccccactttcattttaggtgaagctgaaattgtttggctgagctgaagctgtgccaaacatgccctcgatgtgtgcgaggtatccaaggactcattcgcaaataaaaaacctacctaagatgcaagccaaagaacccaccacacgccacgctcctcctgtacaagtgacgttgaagtagtactccaccaaattaccaccccacccttgggcggcagtctcgacgctccgcctcgagatccgtggaaccaacaccaccgcagtacaatcggacggcccagacggctcgagccatcccgaggcccaagctggcggggtgggcacgtgcaggggcagcagggtcttttcccccacccccgtgcgtttctcggcgtacgaggattcgtccctttctttccccaccggagtgtggggcccaccaccatgccgcgcgtggaccacgatttaatgcggtcctcgcgcccgtgtctcggggagtatgccgaccgtccgatcgggagatggacggcgtggatcgcctctgtagctctgcgcaacaggtgcgagctttctactccgtgcagttcgcttgtggtgtctgatttcaattttcagctgttcatacttctgattacgcttaaaaaacaacttacgattacatacgttgataaaattatatctaaatacaaagttaaaaattgatatattttaaaacggaggtagtttatatatatatatatatgtatatatatatatatgtatatgtatatatatatatatgtacatatacatgtgtatacatgtatatatgtatatatacatgtatatatatatatacatgtatatatatatatacatgtatatatatatatatatatacatgtatatatatatatatatatatatgtgcagttagtacttaccgttttcaaacataaacgttgcccctaaacgaaatcagccttgtgcctttgatttacgttggtctattttattttgattaacatatatttctagcatgcttttcaaactgatattttatgtaaaactttttgtacagaagttgttttaaaaaaaacagataattctatttctcaagtaaataataattaaaacttaattaattttatactaatattttttaaatttgctttaactttatcttcattttcattttcagtataaacgaataacaccattgttcaaatgttgtacacaccatggcttatcatcaaacgatcaagtcaaacttgcattagacctctccatgcaagtttcacgctttggacgatcgaggacgtcctgccacagtataaccccctattcgcaaatactaatgagtactgtacagtgcacaccatatggaaggtttgttgcgtcctcccaaatctcaccatttaattacctcgaaaagacagttcttcaatgtcactaatgacaaggacttcttgtgttattgatttcctcaactgttcctgccaaatccttcgactgtatagtactcccaaggcctgggtttagatctcaattttttcttcaaacttttaacttttttattacatcaaaatttttctacacacgtaaactttcaacttttccgttatattatttcaatttctatcaaacttttaattttaatgtgaactaaacacatctaagtatgtaggagtagtcatgactagtgctactacattttgtactccgaagtacagtagtaatcctatttgtactgagcagcagcagtgcagccagtcactctctaggcttatctttcaattagttgcgctgtctcgtttacctatcactgtttaccatcgatatcttaaccttactcattagtaggagtaacttttatacgattaatttgttattgttgacaaaagttgtatttatgacatgacacatattgctaatatgtaacaaccttttaagtatatactatttcttttttaaaaaaggacgagcagtcaaaactaaaagaacttattactattgattgatctacatcataagtcatggaaagataaagtaaacacataaaataatttggcaaaatttgtcagggaacacttagaaatactgattttgttaggagacatcacaacaacagtgtcttcgggtaaattcatgttggtgcagtgtctcttaacaaagaccgtacatttaagtgccacgtagtaaattttaccaaaatagattataggcaaacttttatatgcgtagcatgttctcttagcagttattactacggaaaagctaatgcaagaaaataatctataataaaacctcatcattaaatttgaaatttaaatttaaattttgggctgtagctaataaaatcaagcagatgattagaggccgagcactccaatttaagagcagaggtagtcaaaatcttcagctggcacctgatagcaaaatgctctgaactacagtacactcctcccagtacaaccagcccatgcatgcatggctgttcagttttttcggccttttgtctttttttcctaataagccaaaacaacttattagaaaataaacatagatttataggtaaaatttttatatatgtgttattgtgacttaaaagctaaagctaaaaaaaagaaactacgttgaaaatatctcaaaattaatcttaaaattaagtttgaaaatttaaatttgtctttttcttttggctgattaggatgggagccttttatcttttaggccttgttgactaatgggttagaa

SEQ ID NO: 60134 - DNA, 2739 bp, Oryza sativa
aggggtggggcccttcttcgcatgtgtggtccgggctggaagtatcggtgggcccggcccaagcgtggcctttctggtgctctgatgaggtggaacagcgatgcgtgatgagagcaggtacaatagtaggctataagctagctgtaaatatatttttaatgagataaataaggagagagaatgatagcgagctatagatttatagccagctgtagcatgaactccaagacgcagtatgtgtataataggtggggccaagtatcaatagtgcagtatataactattgtatgaatgaactattagattggctatagatgaattggagccaatagttggctatactattaaacttgctctgatgagagggaaggcaactgccagttgtcgtggacacgtggctggatcccatttgctggctaggaaaggacaaggtcgcaaattgcaattcatactactatcaccgtatcatcagtattttctttaagcccccttttgaatcaaagaaaaaccataggaattctagaagattttagagcccctttgaattgcagggtagaaaaaatggaggagtaggaaaaacacaggattctgacaggaattgaagtgtaaaacagaggattgcaaaacataggaaaaacacaggaatggtcgttttattggagtgcaggaaaaacgcaggaatcggatgagagagatagactcaaaggaaattttccaagaggttggagctcttgctaaatttcctccaaaatccatatgcaatgtgccattccatagaaatttcataggatttggaaaacttcaatcctttgaatcaaatggccaaataggaaaatttcctataggatttgaatcctatgaaattcccacataaattctttgattcaaaggggcccgcaatgtgccattccataggaatttcataggatttggaaagcttcaatcctttgaatcaaagggccaaataggaaaatttcctatagtatttgaattctatgaaattcctacataaatcttttgattcaaaggggccttatcctatgggaaataattctatagagtcctttgaaacaaaggattgtttcctatcaatttctttgaaattcctatggaatgaaccttactagagcaattttggaggaaaaaaagcacgaggtctcacctcatgttttccttttcatgtgtctaaggttcctgcgtttttcctgtgtgctaatcaaacgacagtttgaagactttcctgtgtttcaaaatcccataggaattcaattcctacgtttttcctattcctctattttctcaatcctgcgattcaaaggggccctaattagttcacgtaacacactcacacaaccattaatactacctccgtaccaaaacgttgctatctagatgagattttacatgctgtcctagatatcaacattttgagacagaggaagtacatccttaactcgtgtttagagagcccggcaggtggacactaatgacatcatcttctatagttcaactaaaaaaacacgttttcatgtatacaatctttcaaatgcaattcgatcactagttttcgctgcaagaaatttaagctggctgtggctaccgcgacagtacaagcagcacaaattatgctgcatgtttgtttgtagttgtttgctgctatgcaatcacaaaattctgttcccagtaattaacagtgaatgcattattgaatttatacttagtcatttatatagtttaggactcgtttgattaattaaataaacggcattctgcacttttgatccacatgatggtccaacttgtatttattttattttccaactggattgatattgtactttgcacgcgagtgatgtttttctttctaatttttcttgaagaattcatgcccatgtctatttcattttaataatccctataaagtataaacttcacagtatagatatgtatataaattccacatgaattcttgcaaacatttgaaagaaaaaaaatcaccgtctcaaacctagcaaagttcgaacaagtttgatgtagggcaagagccaaccatcaacttgtttatatcttacttcatccgtaccaaaaatataataatagtgtagtattagattgcgaccaacggagtattgggctgctatattttagacatagaaaatacttttgactcattttgtgtaattttatattgtttgaatgaaaaaaaacactaacatcttagtttctgaaattgggaataagtttgggaaaagttggtagtttggaaaaaaagttaggagtttaaatgagtaggaacgttttagatgtgattagatgtgatgaaaagttaagagtttagaggaagtttggtgtaaattaaatagggcctataataacattgaaagtaatgacatatgaactcattacttaaataaactttaaattgatcagagtaacatcaaaagacatcactactagcagcattaataacggtagcactagtagtaacatccaaactactccactttactaaaaaagcagagataactccaaacacaagcataactgcattaaccacacgagcaattaacatcttagatcacccaaaatgataaagtaaggtgctatctataaaacatgtacatctcagcaatagactaaattaatagtaaaccatctcaatagtatgtctacatgggtatctatagctctctaatatattgtctcgtttttctctatagactatcttcaggttagtag

SEQ ID NO: 60135 - DNA, 1345 bp, Oryza sativa
gcagtttcatggttgatggtttcttttgtgcaaatctgacccaaaataatgctgtcttctagttaaaacactgccgattccttgcctgtatttatgtttgatctcccttaactttgtagtggatggattaattaaatgtgagaaatgggatcggagagacagtgttgattcaaaagaaacaaagacaggctcatggttgaacaggttcatcggccgagcaaagaaaccagaaatgagatggccatacccattttcagaggggaagatgtttgttcttaccatccaagctggtatcgaaggatatcacgttagcgtgggaggccgtcatgttgcctcatttcctcataggatggtaaattttctgttactttggccaatattatgttaccttgtacagaactctagcttcttcgagtgaaaatactgagtaactactgtcttgattacaaatgtttatcagggattctctcttgaagatgccacaggtttagctgtgacaggcggcgtagacgttcactctatatatgcaacctctcttccaaaggtccatcctagtttctctctccagcaggtcttggaaatgtctgataggtggaaggctcgcccagtaccagaggaaccaattcaggtttttattggcataatctctgctacaaaccattttgctgagcgcatggctataagaaaaagctggatgcagttccctgccatccaactgggaaatgtggttgctcggttctttgttgcactggtaagataactttcatgatttggcaatggtttttggtcgcatttgttaatgtatggtatgtcgtgctacattgtaaatttgtaatcctccacatgtttactattacatgaggacttaggagtagttggggccttgggggcaatggtttgttttacactcatctttcactctagtagatcttttgtggctagatatatgcagacatatgtgttctttacaaggtgttttgtatgacattgcatgcgcttcacgtgtatatgtagctgggtggttggtttatcgcatgcagcaatatatacaattttagatttgaggataattgctatttttgcatttttttaacttaagattatagtacattttattagaattagattagatttgtatagtctaagtatctctcgtatatgtatatatatcttatttaagagtttgttgtaatctctattgtatttagctatataaatataatcgcccccccacgttgggtggtgtggcgtctcataattttctacacatttattaggtatttgctgcaaatgctgttatacataatttctgcatatctcattcaaaagggctgcaggaattaga

SEQ ID NO: 60136 - DNA, 4138 bp, Oryza sativa
tggagcaaggatgcagcagagcaatgcctgcgacgactattctgcaagccacaacatgcagaatatcgccggaaacattgcatctgtagcgcctctggactactgagatgtagaccagaatccaaactaagcacccttaagactgcagggtcaccattcgtgatcgcctgcattccatgcgatcttcactagtcctgtccgaatcagtagcaactcagtcaataatatagctagatgatccgttgtattccatctgatcatggacatgctgtatgatagctgctttagctctattaaatctctaatggcaggcaactaggcaagaacagttctatgatgaatgatggcagtcgctgtagaattgaccttattctgtagctataatatgatgtctagaactgatgattccaatttccaaatggagcccggaacatattaaaatcaatcatttgtcgccttcttcatgtttttgccataaattgtggctagatgatcttgtttcatgctactgagtcaacattttgtcctggtttgtaggctctgacctgcctgcctacttatatgccattgtgcatgattcacgcaggatcaattttgctggacaaaatcatgattccatgctgcaaatttccaaagtgtggtctatatagttgataggaggaacttttagaggaatcctagtagctccatgtggtgacattaatactgttggactccctacttattacatacttattcaaagatttcaccatgccatgaactttaagacataattatgcctgtttttaacagaatggtctaaaattttccttttgggtttcttggaggctttcctgtgccagccaagcataaaaagggggcctgaagctttgttcttttcgtaacaatgcaactgactaaaaatctctcctctcttgaaatgttcatcagttaaaaagacaagtaggattttcaagtcagcagagcaaggttgctgcaaatccaggtgatcaatgtcaaatactaccagacccaaattcagatcacacaaggcaagcagcagctaaacatcaacaattctagtctacagcacatttgctccaaacaaaccattgcagcttagttccatttcatatacagagctcccatggcattttgagtgacagcatgatgatcatgatcatgatccatcttgagaattctttctttcttttttgtttttcttcagatgttcagaggaacagccagctgcagcagcggcggaggcgcgactgcgcggcgccggtctcccggatgcggtgcacctggcgggccagccgcgccgcctgccggctccggcgagcctccaccctcgcctgcttcccctccgccttgtggctcaacgccgacagcctcctgctcagcttctgcttcgccctcgccttcatctgctctgcctgcacctgatgataacatacaggcatctgtatcattcattcattctctaaagaattctatccaaacttggtttttagataatagatttataaaacccagcctctacatcaaatcagaagtacacgggcaaacctaaacttgtcgtccctcagttccataatataagggataatgggtggatgtaacacattctagtataatgaatttgaacagacggtctaagtttatatataggtttgggtttagccatacttctaactaatgattcaacaaattagccataattgcttgagggatgaataaacattatgcatactccctccgggttgataatacttgtcgttttggacaaaggtacggtttcccaaaagtaactttaacaactattttctattataatatatatgaaaataccaaaaaatatatggttttattgaagtatattttaaggcgaatctacacatatggtttttatatttttaagataaatattttagaaattatttgtagtcaaagattttaaagtttgactttacccttgtccaaaacgactaatattatcagcccggagggattactatattatagggctaaaaatagcttagaaaagatatctaagcatgtatagaaagtttttatttttaatttatgaaaaaccatacttttagaagcatggcacgaataatctgtattctcatagctgattagaacgcccaataataaaggtttaagtttttgaattcgatgtaagtttacctctgcgtgcctcatcttggcttcgaatttggccttctggcagctctcccattcctgaatcttcacctccttcctctgaaacctgacgaattctcgtccaaattttcgattcaataatcaaattccagaccaaaaaaacaacaaaaaaacaaaagttcagagaaccaaaaaaagaaaaagagagtgatatttgctgcacctcaacgcgagcttgcacttgtgcgtctcctgccacgccatggcgcgcgcctcgaactccctcttcttggcctcgccgccgccgtcgccggagtgaggtctcggtctcggtctcggtctcttctccggcgaggcgcgggggagctcgtcgtcgtcgtccttgctggcccacgacgcgatgttcatcttgcccagctgcagcccgagcgcggcgatctcgcggcgcgtcctgatctggagctcccgctccgacgacgccgacgacgcggacgcggcgcccctcgggctcgtcggcaccgagcagagcggactcagcgacggcgtggcggcgccggcgggcgtgccgctccgcgactgctccttgctcgccatcggcgtcatctccgtccccacgtcccgcatcgacaccgccgccgcctccgacgacacgcggagcctcttctgctggcgctgcctgctcgccaccgacggcggcgacgacgacgccgaggcctccggcgcaacgcggccggacacggccgctgctgcggcggcggccttcttggagaagattgggttggagtgcacgacgtgtctcccggcgagccacttctcggcgtcgttccactttgacggcacctgcctgaagaacgtcccgccgaccaccgccaccgccgccggcggcggtggcggcggcctctcctccctgtagaactcgaagccgccgctgtcgtagccattgccagctctcccatggctcgcgtcggagcgcgagcgagaagaatccgactggtccttgggataatctgacgaagaaatcaccggaatcaaacacacatcaccattgccattgcaagctccacaatggaatcgaagaggaagcgaaccttcgtcgagttcttggggcaggaggctgttcttggggtggtcgtcgtcgtcctcgtcggcgtcgagcctcgccggcgacgctcgcggcgacttctttgcctcgtcaaccctgccgatgctgccgccatgggatcccagcagcttcatcctcagcttggttggagacatcactcccatctgcattgcaacaaaattatcactaaatacatagtaaaccttaaccaatttgatggtttccaatgaaaatcaatcacccaagattcaggacaaatttcaaactgtcattactagtatccaagattcaggagtagtactagtttaattaatggcttggtaaattggggcaaaaaatttactacaagaattgactctggcttcctgctgcaaagaagagagagatttttaactgctcatactgcagttgccattggagagcagccacagctttgaatagagcagccatgaatgttggctactttgagcttgagagagcaaggtagaatccacaaccaaaaagtccaagagagagagagagagagagagagagagagagagagatgtataggaaccctgttgtggtagtagcaataataaatcaaaagcaccataaatggacatggctagagagttcaatattggaaagtaaagtaattagtggcactatgccactactatcttgacccaccaaaaatgttcatgatagatgagaaaggggagtagtcacattgcattatagcagtacttagcttcaagaaggggttaaaaaagagagatggatcaagcatagtagtacatggatattggatgatacatgaaaaatgaaaatgacatacctacagacatgagcatgaacttaattctacaaaccaaacacaacctaaacaaactaaggttgaaattg

SEQ ID NO: 60137 - DNA, 2686 bp, Oryza sativa
caaggtgcaagatgctaacaattccagtttcgtcttcacaccatggcgtaagtatttttttttcgccttcggctatttgcggctacatcaactaccgcgactacggctactacatgatcggctacatcgacgaacgtctataacaagaatcatctacggcaactccagttaaaacgtccgtgtcatcgctatcgtccatgacactcccgctatgactgcgggaggaaatagaggagagtcaactgacggcagcaggagagctcggtgaagaccatcggcacggaggactcggcacgggatggcgcatggccagcactttgattggtttaaacgatctgtacgtgcatgtgcgcgtgtacagtatgcatgcatgtatgcctccttgtcaccgtgctgaggctggtcatcccggccgggaactgtcaggccgcaagctccttcctgagtagatgcgtcctggtgttgccgtcgctcgggcttcaatacaaggacttggacggtggtgccgtacgcgacggcctcgtcttctgcttgatgatgctggtgagcgacgacaaaatcgtcgtcgtgtttatttggtgtatctaatagaagaatcgatctatggataatctgtagtggctaattgatgcggcgccccagggaaattataggattgatatcatctccccagggcgacgcggggatcgaacgacgttggtctctaaggctctgataccatatggaaaatctaatatgttatattttggtattttctccatgtattgcatcgaccctctcatgtggtatatataggagtatatagggatagagacttggagtacaatacaagtaatagtagatttatctctaggattctatctttaggactctatcttatctctaggattctatctctaagatatatcttatctctatatttgtatttgactcttatctctaactaacatattatacttctaacaatcaatatgtgatatattattctataaacatacaagttcaaatgtgacttatacaattagaacaacaataaaaaaaagactgcaaattacgtgttctattcatattcatattcttattttttatttgtataagttaaatttaaacatatatatttgtggagtgacattaatctatcttgctattttttttaaaataaaaggtgatgttttaagtaagtaaaaacaatgcataggatatctccataagggatgaacagagtttcactaagttaacaagatatagtttcttaaacacatatgattttaaccggagaaagcacacgcaggataacatatcttgtgtgagcctggtacgtagaaatagttcagttaatttcctgggaaaattggagcttcaagcctttatttggtgatgagcttgtccagctcggacagcggcagccgcttgtagccgtcagcctcctcctccatctccggccacttgttcttcttctccggcgccacctcgccgccgtcatggggcgccgcgaaggcttgcccgtcgtcgtcgcacaggcgcctgaacaggtgcaggtactgttccaggctgtgcgacgccgacagcgacatggcgacggcggcgtcgtcgacgacgagctcgacgactttctcggtgacctgcacgtaccggtggcccggcggcagccgcggcaccaagtcctgcttgacgacgagggacaccacgtcgacgtggcggcccttgatcagggcgtcgcggaacgccccgtcgccgacgcgcggcgcgccgaaggtcacggcgcggacggggacgtcgtcgtcggccagcgccgccgcgacgtcgtgcgcggccatcagggcgagcgcgccgccgaggctgtgccccgccatggtcacgcggacgccgacgccgggatcttctcgccggaaatggccgaccaatcgcctcacctcctcgacgacctgctcctgtgcgctgagctcgccgcgctgacccttcccggccttgtccttggacgcgtacaccttgtggaagccttctccacctcgccggcggcagcggcggcggcggcgccgcatccgatccccttatccttcgacgtgtacggcttgaacggcacgagggggaactggatgttcatcgaccagtcggcgacgttcacggagccgcgccacgggacgacgacgtcccagtagccgccgcgccacgcggcggcgacgtaaccgaaccagtagggattgtcgacgccgcggaggacggggagcgccgcctcgagcggcgccgggacggcgtcgatggtggcgtagaggttggtggtggccaagtacaagtagccgccgccgccgtagtagtgaacctccttctcgtcgtcgtcgccggcgaaggccttgtaggcggcctccaccatgtccccgtacatgaggatgtcggctttgtggtcgggatggttgtgatcgatcggcagctgatagtcctcgccaccgccgccgccgccacagatgagctggaggaaggtggcgaagccggcgaggaggctacccttgtcgccggcggccatgtcgtcgtcgatgcttaagagtgtaagatgactcggtacacccatactccaccatgcatatatagggctcgacgtcgtctcttctctggcagtagatgcaggtgcatgtggggagtggattttgatcctcgagagtagtgtttgcaagtcgtttgaatagtaata

SEQ ID NO: 60138 - DNA, 1770 bp, Oryza sativa
ctagctctatcatcactgttgcccctcgttcgatcatccgttctcgtcgccaactgttggggattaattacatgccatacaaatgtatgaaacgaatgtttctttattttttttctctattataagtgatttagaatatattgaagttatctaaaatttatatttgaaagtttattgggatagttttgaaatttttttggtatgatttcgctgtcattttatgattatcttttaaatttcagtgaaacattgtaatacaacctttttcaacaaaaaatttaagaactctactcaaactttgaaattttcaactcaaatacccatttattgttttactatagaaagtgatgaacatatatataattaatcgtgacactaagcgcgtccgcgagcatgcgcaaactaacccaaaaggactgattcgcgaacgttcgcacacggcgaactcgcaagaataccctacactttccttttttttttggcactgcttggtaagtttacatactgaaagtttatacgtgatagtaattcagattcagattttcttatgtaaagtatataaagtttttatatataaagttttatgtataaagtttctacgtagaagtataatctttggagaccatcgtctcatggtggaccaaacgtgttcacgcaggatgcacgtggacattcacccattaaacttacccaaagtagccttctccaggattttgggcttccaaaatattaggccctaagagatgaggcccaagaggccgtgaacatgcttgggccttgaaaatccatggcttgtcgagtaggattactctacaaggcccataggttcccagcgtccaaagtttttaacccttggagacttttagaccaatgtactgtgttcatctctttgagtacagtatctgataaataattaaattttaccatctcaggaatcattgtatggccgaaatcctggtcaatccagagttaggattttaattcaatttcatggtttatttctttaaaccgggattaggatccaaagaagctgattttttttatttatcgactctcttggaaattgaattgatttactaattactgatcaagtactagcaagcatccacgcatccatgtttctcgccgtcgaatgctgcaattttttgacagtgcacacctagctacgtgcctgtctcaaattaataaacactcagcttagtactccacctctttaattaaattaaattaataatgccctctagctagtactgcatcactcttaacataacataatcacggccataatgtggccactaatgcaacatcatccttctctgaatattataagaatattcagtaatctatacacattttttatattgtactatagtatattttcagtgtactagtgttccagccatgcatgcaaccattgtttacatttatattttcaaaagaaacagcacattgttatataggctcatgtgaaaaattaaacataaataaacaatactataatccatataggagtacttgccctaactaatattagtgtcacccatgtgagcatgtcaatagctggccaggcaagcaagcaagctcgctctgaatgtgtcctgaaacacccagattaattaattaatctaatcaaacaaaagcacagcaaaagaggagaaagctcaagctgagcaacacaagattcgttccttaattagggttccagttcagctcgagacaatggcgatgctttgctagcggctgtagggttcttaggtgatacggcctctg

SEQ ID NO: 60139 - DNA, 1480 bp, Oryza sativa
atctgatatcacaatcgtaagtatgaattcaagtattttaccagcttatatgtactttgtgcaggctaacaacagggcaaaagcaagccactaacaaccaacccgttccaaaaagaaaagaaaaaaaaaacaaaggtcctggattttgttatatcaaccgacagaaaatgaacacattcttagatatgttaattagttagcgagtactatattgttattagcttgtttgcctagtgggaaccgaaggtgcactcgtagaccagcatgatatacgtcgcataatcatcttcagctcaggaggaaactaggcgtctagaccgtcccaagcaaatcaccagtcgataacatcccttccctcactgttttttgcggtttctttattcttttttttttggctatttggaatagctgccacgttttttttggcaacagtgctccttgattggacgagcgaactggctgcacgagagtccacggtaatattgctgttcacctgataccaattgttgctgtatgttagaaaggttttcactgtggaagaatggaagtgtttagagagtgagaaagagaaaagatgcctcacttcatgaccgcagaaaccatatatattaagcactacaattccaacttgggggtacgtaacgtattattggcacaaagctatgaccctttcttcctaagcccaaaatccttggacagaagaacgatgagcccaaatatacttcggtgcagtacttgtttttagagtgggctacaatacattgtcaaattactgttatacaatttaaatttaaaatgtgttttgtacaaagggaaatgccacttatgagccattttcagtgggtcaatagtaaagcggtccaaaaaactgtttaaactaataatggatctgacgaaatagttcaagggtgactagaaaattctctatgtttgtgttagcccatagcatacatgtccagtgagatcacaagtgaatgcttgttactaaattgaaaataaaaggagaaaataataatggaaaagtatggttcatgtgtgtcaataaggtgtcaacggccttgtgctcggtcggaagagcatacaaaggggatatgcatgggatggaggtgaaattccatgctcacctaatcactttttggtggtcggttcgaatccggcaggccgtcatatgcatgcctatatttatgtcattgctaattctgatttgttattattttttcaaagttatccgtaggttatagttaggtcaatagcattcggatagctcattttttattctttttggcgacaaaggacatgtgtaagtaggagtattactcatttcatcccaagatataagatattttgattggatataatacatgatagtactacgaatcttcacagaaatcgaaccaaaatctcttatgttttgaaaggatggactagtcaatagtcgtcgttattgtttcaacaaaaaagaagtctatataattcatgc

SEQ ID NO: 60140 - DNA, 1953 bp, Oryza sativa
cagacgaagattcctgaccgttggatctgaatcgacggccgagattcccgcaggtaaccccccccccctactcatcagctatatatacgcacactcgcagccgcgatctcgctggctaaacctagtcgcaggcgcgcagctaccttcctctgaaatggcagccatggcggaggcggcggccggcggcgaggtgcggcggcgaggggggtgctgcggcggcgggggaggcggcggggggttgttcccggaggagtcgttcgcgagctggggcgcgtacgggagggcgctgatggagacggggccgcggctggtggagcggccgacggcgaggtcggcggcggcggtggaggtgaacgaggtgagggggcggagcggcgcggagatgaagaggaacctgacgtggtgggacctcgcctggttcggcgtcggcgccgtcatcggcgccggcatcttcgtgctcacggggcaggaggccagggacgccgccggccccgccgtcgtgctctcctacgccgtctccggcgtctccgccatgctctccgtcttgtgctacaccgagttcgccatcgagatccccgtcgccggtcagtgatatgatcatctccgcctctgcatgcaatgacgtcaccttttctggatgattatgccttaattatacgacgttgattaatacactatgtaatatccgatttattattcatgtttaatctggtcaggaatacgtcctggtggtggtgaatattcaaacagaataaaggagattgatgaattaattagggcctttttagaacgtgatcgatactctctcacacatgcactgcttctgtaggccattaattaatcgaattaattctcatcaaactttctaattatcagattttttttttgtgttttatccttggagagataaggaaattatgataatactatatattttaaggcggcatgcatctgagtataaaaaagaatgctagatcacaagtaaacactgaaacatttttttatataaagaacaatttttttatgtgagaaactaaattaattatgttactccatccatctcaaaatataagcattttgggactttaacacaattttcgagataatattttgaccaacaatatctataaaaacaagggtgaatagctaatttagtccctcaagttttaccgaaggctcaatttagtccttcacgtttcattttgtaaatcatccttggacccacttaatatgccttatagctatttctagtcaatatttctattagaaaatgtcccttttgcccttaatttgtatacaactataaacccaagatgaataaacaacattacaaatgtacttttcattatttcaacatgtgcacatgaaacataagcaattgctatcgtatacacttgctagtacataatttatttttgttttatataatttactatgcattatctataaaaaaaatttaagcatgcaattttatcttatatatgtgaatgatgagggggtataagtgtcatttatcgagagaattgttggttattgataagtttgaactaaaataaaaacttgaaggactaatatggatagattgaaacatcagggactaaaccgagcctcagataatacttggaggaccaccttagctattcgccctaaaaataatatgttttagatgaaaatggttgcacagtatgatatttttttagtgataaatttagtaacatcaattttacatgattaatctttttttattattaatagttaaagttaaaaatatttgacttagcattatcctaataacgcttatattttggaaatggatggagtaatttattgacacacgatgtgtgtatattatatcactgtgtcacatacgtttgacaggtgggtcgttcgcttacctgcgagtggagctgggcgacttcgtggcgttcatcgccgcggcaacatcctcctcga

SEQ ID NO: 60141 - DNA, 1121 bp, Oryza sativa
tagtttaataatagtaatttatgtcatcatgtggcaaattgtggagtgatttatccttttcctttagtttatgttcataagtaatttcatccaaattaaatatcctggtctaaaagctgtgttcggcaatactatcacattgagtagaaagctcactcgttatctgcacgtacgcttcctaacttttaaatggtaaaattattttaaaaaacatattaattaattattcaaatttaaagtaattaatacttaattaataataagctaatgcctagcttatccagttttacatatcttctcctttctcctcttactctaacgtaggcacgtagcactgtagcagaagaattcgcattggtcacatttaggggggaatcgcgagacgaatcttctgagcctaattagtccatgattagttataagtgctatagtaacccatatatgctaatgacggattaattaggctcaaaatattcgactcgtgcttttcaggcgagttatgaaattagttttttcattcgtatccgaaaagccattccgatatacggtcaaatatccgatgtgacacctaaaaattctcttttcgtgaactaaacaggccataaatgaaaaggagaaatttgtgctattggaatttggacctgacgagatcacgagatgaagaaactggacttttgttgtgatagcctatttgaccacattttcctctgatgtgccgtagcgtggaccaaattttgttattgggcctccaggttaggttttgatcctgccggggcctcaatgatgggccatacagttcatgggctcgttataatgggccaagatgtttgtagacagatgctgagcttgaactgttcctttcttcttctttttattttttattttttaaaaacagcttgaactgtttcaggcttgtggtttgtttgatactctttttctggcagaagctttatttccaactagttgtttaccactttacccacgcgctttgcggctggttaaattgaagatagtcgcaataatattatgttgcagctttaataataataataataataataataataataataataataataataataatattattattattattattattattattatta

SEQ ID NO: 60142 - DNA, 983 bp, Oryza sativa
cggaaaaattgacggaagtgctaaaaatgggaatagggtgaactttgatgctactaaagtgaaccggtaactttcggtgctataaaaccaaaaacgtgaactttcgatgctatataaccaattttgccaaaaaaaaaatatgtacggaatagaagtgagtagtgaatagtgagtagtgagaagtgaatatatatttgcttctgatctttgttagaagtatacaagtgaagggaaaaaaaatcaaaggaagatattcatcacagaagtcatgcccaacttcagagttcagactaatgtactaggacagtagcacaatgcaaagtataagaatttcatacagcttcaaatagctagatggataacttctctcttctttttcttttttacttttcgagatcaattcattcctgacaaaatttttattcttccatatgtttgtttgtttgcttggatcaacttgttttctcatgatttttcatataataaatgattgtattagaaaactatcaagaaacgatatacatagtatcaataaaactatcacttattcaaacgataacatatttatgcattatgaatctatggtgcttcagatcgaacaaattgatcatacaaggatcagatcatgttacaaagattaaggcttcatcataacattgttaatatgaaaagcttaaacagttagcacccccatcaagttctgtttgaatccacagtggaggttttaccttaaaacatatcaacttgctgcaagtaacttgacactttcagtttgctgcagctgatgcaatgcctctttcaagaacacccaacacattctgtagcagttgtgcttgccacagctgatccaaattaacaattctcacactatcacattcaaagatagcaacattgaccatggatcggtagcgcaggtttgaattgaatttcttctcctacatgtcactgaaaaaatatttagttcctgcaacgaaacaaaaacg

SEQ ID NO: 60143 - DNA, 751 bp, Oryza sativa
agcgaagtcctggtcacggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgtgagcaaccagtcctcaacaaaagtcgccaacttggcgggccagtcgccagctgactgctgacccttgcgcgagtacctgcgaattaatgtgtaatattagtgtgaaacgacagatgttacaaattattgtgaacaggcagattttaatgcaacaacggaaagcatagtgcaagatcttaccggtgaatagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgctgcactgtagggctcccacacgacgtcagtcggcagaaggcggtcgaactccataacaaactcaggatacgaccgcctaacttggacgtgagcccatcggcgctgcaatacgagacgatcgatgtgatgtacaatgaacttagcaattaacttaacaatacgataagatcgatgcaacggggctgcaggaatta

SEQ ID NO: 60144 - DNA, 1037 bp, Oryza sativa
attcctgcagccccaaaaacattttaacagagagtggaagtagcatacaaagacccagaattacgtaattgtttttttttgtccggatgcgacggatcaggttataaaaggctatgagatactggcctaccctccccacgcaaagtacatgcagctataataatttgtacatgagagcttaccataggctgtccaccataagctgcataaaggcttccgtaatatggatcaatatttgcgtaagcaatttggccctgctgaaaaaaaatgcagaattagacaataaacattacaaatggaatttggcgttatgcatgaactgtgatcaggaaatccaagcaaagaagcaactcatggtgcaaccaccaacgctctctttggttaaggttagtaacaaagaaatttggctatctgtggtcgtgtggagacttgtgttatggactggtgaacatttgttgacaacgtatcaaggaaacgtggcatagcagtataaatgggatatggtataactgtcatggaagtcatgtgcacctgtttgacaatcaaggtgtgatgcatggttttcataagagggtcacctcaaaaggaagtaaattggtcctccactatgcaagagtttttctctctgtatatctgttagttttagtatgaagaggtggttatcagcccaagaatccaaatccaaattcaaacttgaatctccatagtgattctacaagcctgccatgtttctcccatatttcactatgatcagttggctaaatatccttagactagggctcaaactgaaagaacagaagttatactacttgctcataactaaaaaagggaaaaaatacatgtaatgtaccattgcatgggccatatcgtgatgggcatagggtgtcgcataatctgttgaaggtgttgctaccattgtatggctatctgtactagtaactgaggcttcttgctggtcctcaggttcaccttgcctttgctgtttttgccgctcatcagcttcatggttgcctacataggaaagaaaacaaaaatga

SEQ ID NO: 60145 - DNA, 1264 bp, Oryza sativa
taagataggttcaccactcggttattgtcaagaacagttgaaatttctacatattactagctaaatgcccgtgtgacgtgtgttgtaacagagttctaaaagagaacatctttctaaaatcattccccattgtctactcccgagactatacttgcatcaatcaaattctattggttagctggcatcatgtacaaaatgatttctaatcatgatcataatctaaggtgatattaatttttcttatggattttttttactttcatagcctagctatatttacataaatacgaaaaggacatgtaaaatatctaagtaatttttcttaaaaatcaaacgttaatctaataaagttgtgcagatacgactgttgctcctaatgaagaatggacaaagatcaaagaacatctttttaccagctagtccaaacaaatttttctttattttgtcctttattataagaccattgactgtatgtgggcccatataacagtgggtaggtgccaccaccaccattggtgtcttttataggagtatagatatggtcagtgcaacgcaaaagaaatgtacattaccttagcccaatatgagttatcctgaagcctatcatcagcaaatttaacatcctctagtttcacccgttgaaatgcattcacagttttgggctgcagtggacagagatggcatggacaatcagattacaagcatttcccagacatcaaagatatccataaccgagacatctataaaactattatcagaagtgaatgctaaatagtaagatcaaaatgatgttattgttagtcaatatacaagacatggaaatgataaaccaccttaatgtcagggcatcaccagaacgtatgaggaaatcaccatcgcaatgatagtaacaaactaactacaaatatccactgtccgatacaacattatttggttattctgaaatactagtaaatgtcagaaaagaaagaagttgatccatgactaacacaaaacatatacttactgatcatgtcatagtttgcctaaaatttctagatgacaggctttgtggttcataaacataacaggaacaaattgcactaaagtaggaaataacacaaggcaacgaaagaaacagactataacatacttcagatgattttttctgccttttattcggtttggcaccatcatcctctgaagaaccattgctgagcttctggctagctgtgttatcttctttagcagggaggttgcttccttcgacttcttctagtttccg

SEQ ID NO: 60146 - DNA, 1634 bp, Oryza sativa
atcccctcctagtttgattctttttgggacggagggagtagatccatatattagcttatgctgatgatgcttatcagcataagcagcctgatgcttatcagcataagcatttccatcaggtgtagaaaggtgtccggaaagattgtgtccactaccaatggctaatgcttattcagcccaacaagctaattgatgggcttttgctgaaaatagcctcagcaacagcaaatcggtgaggctgacaaggatgacagttaaagtattctcatgtccgatcaggacttttatcaacccgagggtataaatatatatttcccgggatatttgtaatctatctttcgactaatacataactttcggtacatcgctaccatctattccggagagttcatagtttcgagcgacgctgcattagttaagttcgatcttcggcgagaattaagttccgctaacttcgcttgtattagcgtggctagaactttatcagtgaattccaatattctattcaagttaatgcatgggttgtctatctaatatatagattttgtccttaactgcatcattgtttagagtcgtattagcttagttacgactttctcggttaggtttgctatcctgactaagtgatatttctataaatcacattattgttttagactgaccgatatatctatcacgtttgtgtagatctatcggctaaataggtttttcctattatcttcaatcatatattgtcacagttgatctattagatcatgtataataatattgattcagtcggcaacaagaatcactgcatgggtattgtcatacgtggaggatggaggaaacatgagaaataacagagcaagtgattctgcaagtgccggacgatgatacggtaaactaggcaagatgaaatattttagtttagtttagttgatcttttgtacatatgcatactgtgtggctccatgcacggattattttcatgcttaggcaggatgggccacttagatggagtctagttttgatcacatatgcatgcaacaattaaacccattcatgcttccctaaagccaatatttcgtactacttactttcgctattgactttgctcttagattgttactaaaaagtttatttatatgctgttagttgtaggatcgaactaatgggcacgctcgattgataggaactttattggagctccacgaatctcccaggccttcgcgtgaacgacgaatttcacgtcaacaagttgtatagtctaaaatgttcgatcaaatacttaaacaatgtctgcccgaagccattttgaacccaagaattggaatttcatatggctgttttaaactttaagtgaacttcatattcaattgctatgtttagatagcatattcaatagaatggcccccactgtttggtatattggagaaaaaaccgtaatgtcaattttgcaaatgaaatattctatgaataaaagttttatatacgtattcttaacgttataaacgtactgactgaaaaataaactacggtgaattttttttccaaaatcacctctaaatttaaaagttgaaaaatttaaatttggatgataattataatcgaaaagatgaggaggacggaggacggctggccatcggcgtggg

SEQ ID NO: 60147 - DNA, 1369 bp, Oryza sativa
gttctatttcaatatagctgagtttcacttgatctaatttgctgttcgacctccttaacctttgtaggagcaatactggcctcctgctgattttgatcatgtcctgtcttcaaaactgaatgatctgacagcatctgggaaattgataaaggttataatcccttctgtttgggcatgttttattatgcatttcgagtaatggcagctgatacaattttcatgcaaagaggtgaaccaggatgttgtgctctgatacggtagcaaattcagtaaaatgttaccaattatcattgctatgacatgttaaacttttgttgtgtactaaaatataatgcgccctccaactaacacattctagcaggctagcagcaattcctccttcattcattctttcagtgttgtaacatatctactgcacctgtggatgcagcagttgaatccaaaatgccatcccatattttgtagaaaaatattcttttgtacttgttaagttgttgttagtcctttttggtgtctcatggcgtattctcaatccttaaattcttgtcttgtccgccttcaaattccccggcttacaggctttgttctaaatgaaaactgtagaaaaaagtattatggattttgttggcatgtaagggccaagatggataatctttctttattatttaagcattgacacgtatagctaggcgctaggatcttaggactaccattacacacatcatgactttatagcattatggcacgcaactcattactcatgttcaactattttaggtgaatcgaaagtacaggatagcccctagttcatctttgtcagaagggcgaagctccaaagtagtgctgctcgaagatataaaaaaagaaccaacaaagttagatagggaagatgttgcagtcctcactaaatctcaaatcgatgctgaattagctcggatgagaaccatgactgcagaagaggctgctgctgctgctgctcgtgcagttgcagaggcagaagctatcatggctgaagccgaagctgcagtaagagaagcagaggctgcagaagctgatgctgtagctgcacaagctttcgcggaggcagcaatggcaacatttaaaaacagaagttcagcaaaattggtaattgctctaagtacctcagttctagtttcaaatggttcaaacgttttacttttgcatatttgcactttaaattccttgcttcctcattttgtatatttcaaactcaacaagtcattcactttgaccgtacactgtctatacctgccttaaagatccctctacaaatagttagtccttcatactatgaaaggtatagatgtacatagactatgagcattccaggtagacacttctcatcaag

SEQ ID NO: 60148 - DNA, 1490 bp, Oryza sativa
  unsure (1)..(1490): unsure at all n locations
gataccatatacataatagtagtcgactaaatctcggcaggacccactacataccatgtcttatacgaatacaaccttcggatataggaggagttccgcataaggaaggatgaatagggttctacatggaaaccacaaggactactcggattgtatccatattagtttctctagttctacttggacaaaaggacatatgggtataaatacaagactccataggaggagaggggacacggaacaatagatcaagacacaagatcaacatacaagccaacatacgccaagacaagacgccggatatcgacttcagagatagactagccagtcccctatggtgcctacggataccgtcaggagagatatagcgctagcgctgtctctgatctcgccggatgcggattcgaggaggaaggctaccctgttgtcgactacgagtcagaccttcagaccgccatgtcgacaacagttagataggctaccccaaatattgtactggtgtgattatgatgaacaagagcaacgaccggcttcggccaacaggttgtatacacatgcatagctaaactttattgacaatgcctaaaaaaaatactcgatccaaagtgaaaatattcatttataaaaaagtgaaaatattagttaaatgatagttgacagtaaaatttagtctttttttttaaaaaaaaagacgaagaagagaagaaataggtggcgatgggtatcgtccggctctgcgacggcactgaggttctggaatttcctctttttttttgtctttctttccaacggaaacttctttgctgtctctgaaatggtgtggtataacatattaaataatttccagaattctgtatcattttctttccgaggaatntttcgtatcttctcccgacggtacatatcgtcatgaacgtgccgattatagacggacaaatatatacaagtagttgattaaacatatatgagttggtcttatatanattagtaaaaaacaaaattatttggaagtaagtacatatattgttgcagtgattgattgagaagatttgttttcttcataaaatcagaggcggatacacgaactcgcgtgccccatatcagtgtgtttagattaagggttatatattttgcacattgcagtgtgcacaattttttaaagatcgatagggagatgcaataaatcaaagaaaacaaccaaacaaccacattgtttctgttcggatgttctggataaatatgtgagttggtctaaattcagaaagggaaaatatatatttgcatcaagttaaaagaaaaaaaaaggcaaaattggttatatagcatcnaaagttcacgcttttggttttatagcaccgaaagttaccggttcattttatagcacccaaagttcaccatgttcccatttttaacacttccgtcaattctcgatcgttttccgtccgtcttgatccagccacacacacgatatgacgtttctacccctcaca

SEQ ID NO: 60149 - DNA, 1977 bp, Oryza sativa
aagggaaccgtgagccactatgtgactggtgctactcctattgtgagagcatcaacagcacatctgatggggcgccatgtgcagggatgggctgctgcgaggccgccataccgactgacctcaccgcctggggggcgatgtttgagatgaaccagagcaaggtatggagcttcaacccgtgtttctatgccatggtcagtgaggttgggtggtacagcttccagcagaaggaccttgttggccaccttgggttcatagatgacagagctcagaggggagcacctgttgtggctgattgggccattaggaatggctcatgcccggaagaggggaaaggcatacctggtgattatgcgtgcatcagcgcaaacagctactgcatggacgcgaacaatggtccagggtacttatgccagtgctccaaagggtatgagggcaacccttatcttctgaacggctgccaaggttaggttcatacttaaactggtagaattctataccatgcacagtgttaattcaggtagagtttgtaagctatacttctacaaaatcatatgaacattcatcaatagacagcaattctacatggtttccaccataattcagcatgggactggaaaaagaaacagtcagcttcatttgtggggtagatttttaattacaaagtgaaaaggtcattttggaacaagtattgaaaggggagttatagcattcttaagtaaattggctggttgactttagcttacctatgataacgaaattaatatagattatatagttcatacaaatttggtctgaattttatgaatggatgtttttgttgctatcttcagacgtggatgagtgcgcattgcgtaagcaagatcccaagtatgaggatatgtatccatgcagaaaaggaatctgccacaacacaccaggaggatacttatgcaaatgcaagttagggaaaagatctgatggtacaaattatggatgccggcctctgcgcactacagccgagaaagtggttattggtaaggtcacatctgcagattttacttctgtttcacctacattaggatgttcttctactcaaagtaacactaatactatggcaagaagaatactaattttgaacactacctagaattgtcaataaaaaataaatttaagaagttagtagcagaaaattattagtatcaatattctgacagagataattttaaaggcaccagtgtttcggccattgcgctaatgtctttggcatgcgtgttggccatgcaagtacaaaggaaaaggcataagaaggacaaagatgagtacttcaagcaaaatggaggtctaaagctatatgatgagatgagatcaaggaaggtagacacaatccgcatactcactgaaaaagatataaaaaaggccactgacaactacagtgaagatcgagttcttggaattggaggtcacggaatggtctacagaggaattttggatgacaacaaagaggtagccataaagaagtccaaagtaattaacgacgaatggagggaagaatttgtcaatgagataataatcttgtcacagatcaaccacagaaacattgtgaggttgataggatgttgcctggatgtacatgtccccatgttggtctatgagtttgtatccaatgggaccttgtctgagttcctccatggcactgatcgtagatcatcaatccccttggacattcgcctgaaaatagccacacaatcagcagaagctctagcatacctgcattcatcaacgtctcgcgcgatccttcatggagatttcaaatcggccaatattcttttggacgatcagcacaatgcaaaggttgcagattttggggcatcagcactgaagtccatgaacgaaagtgagttcatcatgtttgtccaaggaactttgggttaccttgacccggagagcttcattagccaccgtctaactgacaaaagcgacgtctacagttttggg

SEQ ID NO: 60150 - DNA, 1295 bp, Oryza sativa
ttgaaacgtccagattggttgatgatcttgtgagatgatgaagaagcttgtaccagcacgttaattcttgtgttggcgaatgccatagtaaatactacttggtttagccaactgctgtaattattgtttaagcaatttgttccttgtttgtggcaataatgatctcttctattctgaataaatattcaattgtatacagccaagttgatcagatttcagaagcaaagttacctgaaaaataaaatgcttcgatttgctccccttagcctgcagccacgatgctttgatcttgtaagataatgaagacgaataactaatcttggggatcatgaattgatgccattctgaatagaacgaataaataaataaaaatattcagttgtgcagtccgatttgattcagaactagagtagagttacctgataacctcgcctgaggtcgcaatgctttggagctggagcgccccgtgtcctctcccaccccatgacgcggcggcgtctcttcctcccgccgccgattcaaactgcgaccgccgccaccaatcccgactgccaagaaatgctagtcctccggcgatctccgccgccgccacctgaggcacgccaccggacccatgtccgtggcttcgtcttggaagggccggaccggggggccgctttccgccggcggcgactccgcctctccacgccgccgcggtgtgtggccggcgatgtgggcgagagactccattccgtcacccgagcggattacgagaatagcctgggcgtattctagttttcaaaacgtaatctaatttgacgctttcaacaggcccaacgaaaatgggcctcaatgacgagccatgggcaatttggggcctcatcggttactaacggtttatttattagcgataaaaataatttatacgaaaatttttatatacatgtattcttagcgaattaaagtcaataaaaaactatgttaaaatattttaaaatcatcttctaaattgaattttaaaatataaatttggcataatttgtcttaattctttttaggtgttgttcttttttcttgaagatgaagttttttatgcaaaacgaggtggtataaacgtatgattgattaagttttaattattacaaacttgaaaaatagattaatataatattttagagcaactttcatatagaaaattttcgcacaaaacgaaccgtttagcagtttaaaaagtgtgccacgaaaatcttaatattcatccagcccttgttagagaaagaacgggaccttagtacaaccgatggggctcctgaagt

SEQ ID NO: 60151 - DNA, 6206 bp, Oryza sativa
tttcttgctctatggaaaaccaagccaagttcttttcggaatcagtcttttatgaacataaaagaagaataggtggaaaacaaaactcctgtatttcaaaggagttggcatcgtgcgtagtggtatgtgcgcgtgtcccacccatgtaatattccatgaacaactctagaaaacacatatgagtaaggaaacaacattacatggggtccgaggccgtgcaatattctgtcacaggtgaaggcagcacaattgagcaagttgtcgcctgtggtaccgaacaagcgtccgatctgcatgaaaacagtacacgcactacactctttgcaaacgatggctgaacatgcaaggtttcttggaagaaattcggagaaaactttggtcttgtgcggcaatccacagatctaggatggtgacattgtctcatgtagatgatgcatctccatgacaaaaacaaaatgcactagtgtggcttgcacagtagtggtggactggtggtagagtactcatgtgacaaggccaagaaattccacaagaattgaactatttatgtcagataaatttatatcaccacagcaacattaattcttatttatctggtttgtatagttgaggggataaaatgtctggttttcaaattcaggagagtaatttaatttaattgatcacgatagttgagggggtaattcgtatttttttccttaactcaatgttactactactttttgaagcatttgttgaagtttgttcagtgcactcgtgctcgtcgcgtgtttttggtggcttatcaacagtaaccaagatttgaattttgaaaagtagaattgattcaggagctttttttatcgtagtctattatctagccttggcttttgaatgcttgtaaacttcgacaatggattaaaaacttttgaagcacaaattatataaaactgataataaattttaaaaaaacgaatgatgtaataaattttttttttgttacaatggatgtttttcttcagattgttagccgtgagcccgtgactcaacttatatcgaagcatatgtcaggtgagaccaaaggataggtcagatttgatcaaactaagcaaatatgttcgaacggatctgaacgtgaaccccatcaaactattgaaattcataaattcagctcgaatttatcgaattttcaattatactatcgatttaaactaagtaatgggaattgatgggtagaagcacgagacaacattggagtagaggagaaaagagaccgtagcgtccaacagggcacttttgcctccagtgagcagcagtaaaacccaaaagttactgtcctctcttttttcaccctgatgtcacagccacagcagcagtagtacaaaagttgcagtaaaaaaaaaagtctacggcgccgtagaatgacggatctacccctacccaaccaggagacaagctcacgagcctatgcggatcccgcacacgcctcctccccccgccacacactatttacgattctgccactcatccccgccacgtggcaccgccacgtgtcagatgacgtggcctctccccgccggtataaatcgcccgggaaaccgctcctgccacttcaccaccgcacagcgagctcgccgcggagagctttcgccggagaggtagacgacgacggcgacgacagtgtcacgtgctcacgttcatggtggcggcggtgcgcgcgccggtgaagccggagatggtggagctctcgccggcggcgatggagaggtactcctccgacgccgacacgacggcgccgaactcgagccttagctcggcggcgagcagcacggggagcctcgcgcggtgctcgagcctgtcgcgcctgtcgttcgactgctcgccgtcggccgccgtggcggcggcggcgacgtcgtgctcgccgccgcgggcgtcggtgctgttgcggccgcacaggtccggcgacgtcgcgtgggcggccatccgcgcggcttcgacgacctccgcggcgccgctaggcccgcgggacttcaagctcgtgcggcgcatcggcggcggcgacatcgggacggtgtacctgtgccgcctccggagctcgccggagagggagagcccgtgcatgtacgcgatgaaggtggtggaccggagggcggtggcgaggaagcagaagctggggcgcgcggcggcggagaagcggatcctgcggcagctggaccaccccttcctccccaccctcttcgccgacttcgacgccacgccgcacttctcctgcgccgtcatggagttctgccccggcggcgacctccactccctccgccaccgcatgccgtcccgccgcttcccgctcccctccgcccgcttctacgccgccgaggtgctcctcgccatcgagtacctccacatgatgggcatcgtctaccgcgacctcaagcccgagaacgtcctcatccgcgccgacggccacatcatgctcaccgacttcgacctctcgctgcagtccaccacctcgccgtctctcgacggcgacaccgacaccgacgacgaggccagcggtggcgcgtcctgcttcccggaccacctcctccggttcaagcggcggcggaacgccgtggcggcgccgcgtccgcggttcgtggcggagccggtggatgcgaggtcgtgctcgttcgtggggacgcacgagtacgtggcccccgaggtggcgagcggcggcgcgcatggcgcggccgtggactggtgggcgtacggggtgttcctctacgagctcatctacggccgtacgccgttcgccggcgctacaaacgaggcgacgctccgcaacatcgtccgccgcccgctcgccttcccctccggctccggctcgtgcggtcccgccgacgccgacgcgcgcgacctcatcgcccgcctcctcgccaaggaccccgccgcccgcctcggctcccgccgcggcgccgccgacgtcaagtcccaccccttcttcaagtccctcaacctcgccctcctccgttcgtcgcgcccgcccgtcgtccccggcgccggcgccggcgccgcgccgctacaccggtcgcagtcgtgcaaggcggcgccgacaacgccgccgccgccgacgacgacgaagccggcgaacgccaccgcgcggttcgacctcttctgagcatattgaccgttgctgtctgctactacctacccgcgtcgtcgccgacatcgccggcgggagacacgctccggccaccgtgacattaatttctcgttgacccttagctaccgcgttgaatgtacacactgttaattaattactactcctagttaatcactgctaatcaccttgctgttagtactactaaactaatataatctagtggcttaattaatcagcttgctttgagtgatatgatcactggtgatgattgcaactgtttctgaatcaactgagcatccattttctaccacttcttcggtcctaaatactacgaatctggatacgatgtttatttaaatttataatattatatattctattcaactaaaattttttatatttttaattgaagggagtaacaaacataggagtaaatagaagtaattaaataattatgggggtgggtaatgttggtcgggtggtaattaagcaggggatcacatggatgctggaattgggtgggatgcaggttagcgcggttcatggattagggggttatggttggtgattacattaatggtcggagttgacctgtctcgtctccttgtctgctctgctctcatcttctcgtcttcttttcttccaaatagtggagtggttttggttgctgggaagagaggtgacattccagccaggttgatgtccattttaatatttatttttggatgcattgcattttgcaaacaatagcgtagggtgaggataaaaacggtcggaagagatgtatggtactagtatttcttttatatttcttatcacagaaatgtagaaatgtttttggtatggtaggatatttttttataatttttgaatttaactatttagtggtggcattgatacgacgctgacatgacagaaattaagataaactgaattttatatacagctaggaacgaaaagggcagaaacgatatactagtaaattttgttctactttaggggggaaacggatcgatacaatcgggaaattgattaaaaatgtttaaaagttctttgaaaaaaaaaactccaacgttgttattctttacacaaacctgcatcgtttatgagattttgaagcacaccccgtaataatccattagcaagttaagtagtataaccgctgaacacatgtgtataatgtttcatttggaaaatatctgacacgtgtatatctgctacgaacatttatgttgtgttctttattccttctgaactcatacaccctcgttttctgaatcactaaacggtatatatatttttaaaaatatttagagtttgctttataaattatattaatatatttttctagttttttaatctaacatttaactaagaatatgctaatccctccttccaaactcaatcttactctctctgtagttgtcccataaaaaattaacctaataccagatgttatacatcttactactatgaatttggatatacatatgttcagattccagattcgtagtattagaatatattctattcggttttaaatttattttccatgggacagggagtatttgtttacacttgatgcacggaagacgtgcagtatataaaagtactgcttgaactctcaatagagtatgcccttttataatttcgaacatttcaatgtagggtatgcccttttaaaagcagaaccgcaaaattaagattcaaaacatctccttgcattgcatggcattgcattgctgggacacgaaatcatgatgatgaaggtgtcgagctttggtgtttgaccaggaggtcccacaaggcaggcagagatcgatcgagacggtggctgccatgggttgggccatgcacgcgtgctgctgtttctttgttcgttcgttgtcgttgctctccatcaccttccttctcgtagattagattggtagctagccttgctatggatcggggatcatggctggaggagcatgcaaactcacgggatcgccagctactctagctttaacttggaccagccagtgtctttcaagtttaattgtttagttgaccccagagtttacattaccggttgaccactaaatttcgagtcctatcattatcacggttttcgataaattttgacttaattttgatcaaatctattgtttaaccttcgaaattccaatcgaaacttaatcccaagccgtgtcaaaacattgaaatttcacgaaattcgaccagtttttatcgaaattgtgaaccctgttgacccaatgacaaagctagaattttttttgggccgaacaaacttcaatataattagtagtatttgttatagaaattttatcaccaattcataaatgtcgagctcgggtggtggctccgctactaagctgaccttaaactttgcaatttgagaagatatactacaatacgtacaccatgtgtgtacgaaacctggtttatttttcctatatacctatacaattcatccccgctaactctaattctctcatctcacagcttgccacgtcactctaaattagtctgaccattagatttgcaatggatgtcttagattttcactgattaggatctgcagcaaaaacatctagctctacttgagtacctccacgtctcccaagcgctttatctttcgaaactgccaattttattacccactatgattacttcttaatgtctgatgtgttcacagaatcaactggtagcatttgtttcctcttttcttgcttttcctttgcctcttccgatcgttctcctttctactcctaatcttggtttccttcgggatatgtttcccctcgctaacactcttcagatgaatgcagaaatcttctcgattcaagattgaatggtgaactctcgagcatgagaaaaaagcccataaaggatagttctactaatctctttgtttaattttgcattgttttagacatggtaagcgtaatataggtctatccatgttctcattttcttcaagtcctatttgataaaatagacatactttatcatcttacctgttttagaagagctcttcaaacaaaccgaaaagagaaaatcccttgtgtgcccatgaaaactcatc

SEQ ID NO: 60152 - DNA, 1466 bp, Oryza sativa
tggagaattttgaagaaatgagctttaatgaacaaccacaacttactttttgcacccccagttactcaagaaactttgatgaaagttattcttacagtcacagttactggctgattctcaagaggggcaaaaatgcttttataagtgatttttttcctctgtacttggtatgaacttgagatttgaaaatttgtcctttcctctaattgttctttatctgcttgcagttccccctgctttcaaagagtgccatcctgggaagattgattgaggagaattcagacagcgatgaatgtgtcatcatattgtctgacatccctggtggcgcaaaatcattcgagttagtggcaaggttctgttatgggctgaagatagagctgtcttcagaaaatgtcgtctacctacgctgcgctgctgaacatcttgagatgacagaagaaacatctggggataatctgattaatcagacagagtcattctttaaccaagtagtcctccgaagctggaaagattccctggaagcgcttcggacatgtgatggccttctccctcatgctgaagaccttcacattgtgaagagatgcatcgaatcattggctggcaaagctagcatcgatccggacctcttcggctggccagtctcggaacatagtaccatgcaaagccccgggggaagtgtcttgtggaatggcataagcacgggtgcgaaggttaggaactgcagttcggactggtggtatgatgatgcttcctccctgagcttccctacatacaagaggcttatttcttccatggagtcaagaggcatcaaacaggagatcattgcgggttcgctcacatactacgccaagaagtttctcccagggttgaataggcgtcaaagcaccggaccaatgcccctgccggctgctaccctgtctgatgaagaacagaggcgcctgcttgaagagattgataggatgttgccacttcagagaggtttaatatccacaaatgttttgctctggctgctccggaccgccatgatcctgaaagtcgaccgcgcttgcatttcaaacttggagaaaagggtcgggatgcagctggacgaagccacattggaggatctactgctgccaaacttctcatacaccatggacacgctctacaacgtcgagtgcgttcacaggattctcgaccacttcttggcaatggatcagaccatgggtggcggtggcgcctccccatgcttggatgatgtgatggcatctccttcgttggcaccgatcaccgctgtcgcgaagctgattgatggctaccttgcagagattgcacctgatatcaacctaaagccactgaaattccagtctctggcagctgttttacctgaatatgctcggccactggatgacggtctttaccgcgccattgatgtatacctgaaggtacactttcgagccgctattcttgcataaaaaatgccattg

SEQ ID NO: 60153 - DNA, 2630 bp, Oryza sativa
catgttctctctgccagaatctttcaagtgaagaatcatgttggatgtttgaggacgcagaaggccgcaggcatgggccacattctcttgctgaactttcttattggcatcacagtagctatctacatgacctttcaatggtaagaaaagcatcagtcgaaaccatgtgttctggatccactcttacgctttgcttgcaaatgttctattttattggactgttaatgtgattaatgtgacgtgcatagtgtttttaaacaagtaatgaaatggctgttgtagaataaattgaagatattgtttcaatttggccctaactaaccactacatgtagaatatcaggctgttacaatgctcttatgtactagatgataaaatagtacaggagatttttacggtgcaccaaattagagtgctgcttggtttggctgtttttctccacaatccattgacactgcaacttgattaagttataatttatttggtttgcgtacactagtattggatactgcagtatacaatacgggcccaatacaatctcgttaccactgaatatcgagtgcatttggaaagtgttactgcaaaagcgatcgcccactcaatccaaacaatatttgttattcctcatcccgtttccattagctgtcagcttaattggaaaatgttacggtgtttcaaccaaacatctatattgagccatccattctatgagatctaatggttagtattactattactatctataagaggtaataaagagtattactattaccatctataagaggtaataaagactttctgaccgccccataaataatgaaatacatgtaatctttagctggtggaatcatttaagtgatggataataaatgttggtttaacttttatgattcaatttaattatttgacatttaggactagattcgatttgttgtcttcttttttttaaaaaaacctcttgaaacataattcatttattggttttggtagatagcatcacaaaaagaatatttgatgtgattgttcttatacatattgtgattgttcttatacatatctttttccctcctggtggaggaatttttttaaggtatctcaattaagttggaataaatcaataaattaataggctatgtgctgtatggaaatcatttaggttcacccaacttatgggtaaaggctaatatatgattatggtggaacttctgttggttaggtttttttgagtatcttcttgtaacaggatgacagatcagttataacgtgttatgtacacagctcccccaattccagtggatttacatttgtgaattattcttggttcacactagtacatgatctgaacaataacacttctttttttaacagatttaccatgttgatagcaagtttggcccatttacacttgtatcactaattgattggtggagtggaggcacagagcattcagaatcttcagccaatgattctgggtcactgaacgctttaatggatgatgtagttgaagatatcagccatcagctgcatgctggaattatgaaatcagcccgcaaagtttttattgatgaaatatttagcagcgtacttccagaaatgattgcttgcaggaagacagagaagcaaatggctgcaaaacgtaagagccaagctgctaaggtgtgttttatctgtcatggtttttgggacatgaacttcttttgtattacctacccatttgcaaattttaatcctgtccaagatggttttatttttccagactgacaatgtgagtaacaagaatgctttggtacttaagggcaagggtgatggaacatctactcgtccaaaaagccaaactcgtataataataaagtaccggaagatccttctgtggctgttcaatcaactgcaatgcagtatgaatttgctgatatattatcggcagtttgggaaacaatttataacaaatccatgaagagtatctgggatgaagtactgtatgatcctgtcatggactactgtgatgcatggcttaaaagaaaaaatgagtcgaatcttctctctacagttgttcctggagcctctgataaccaaaagatgcaagacacagatgaaatgtcaccaaaggtttctccaataggactaaacacatttctttctttgaaagatgggtttaacatttaagatgtaaatccttctttcgctgcagatatgattttctgacagtttcatggtttgcaggcaatttgtgattcagatgctcctgaaagtgacatggatttccctccaggatttggaccaaatcaggaatctgctgagcattcccactctgcgtgtgttgagtatgttactgaaaaaacagatgggaggtctggatcaagtatcacgttgttttctggccccttaggacgagttcaggtaatgctggcaaatgaactatatgtggcagcaaaggaagctttgttccagcattttgaggaggtcatttcagaggagataacaaactgtttgtgcattggatttgaagatgatattaatcaagtgagatgacaataataactactttttattgatagctgttaatatttcagaatttgcatgatttttacatctaagtgttgtattgcaggaacgaattcgtacgcctgttc

SEQ ID NO: 60154 - DNA, 775 bp, Oryza sativa
aagtaattcctgtttatataagggtagaaagatagttgagtgtaaaataagaagaaatctgaatgagaagtgattaatgagaccattagtattatatgtgataattattttggaacaaatttaaatcttagaaatataattattataggacaaaggtactacagcgaatttttatttcctttttcttaaataaaaactgaaccaaggtatactgtttggtttcgattttatatttttcccaaaaatccccttttataaaataattaactattttccactcttacgtcactgggcccacatgtcatagacaacaagtgacaaattattaattgtcatatattaagagtgacaaatagttaaatattcaatttttttatctccccattgttatctcgcctatttaccatactgcccctctccgtgtgcgaaacgggaggggctcggtcgccgggtcgcgtcgcaccgcatcataaggagcccccccacccgggtgcgggccgacggtcggtcggactcgcctcgcctctccccgaatcccgccgccgccgccgccgccgccgacgagactcgacgcctcctctcctccctccccgctcctcttcgggcccggagctcggcgggggtggagcggagacacacacacgacccggcgggccggttctttcccccccttatccggtgaggaagccctagcttttgcttgggtgggcgggtggggtggggtgggtttggttactggttctaaagtttgacctaatctgagttgcttctctcg

SEQ ID NO: 60155 - DNA, 2628 bp, Oryza sativa
  unsure (1)..(2628): unsure at all n locations
aattggatcctctgtacaagaaaatgattctaatacaataagagcatcaatagcttcatacataatatagaaacatacaaaaaatcctttccatacataacagttcatatcatgcacacacaattccatttccatacccagtagtgcaggaaccaaaccaacttttcattcatacatcaggagcacaatggcataaggtccataatagtatgtccataacagggacattttatgagaaagcaatccttacaatagcgaaatgagatatcaactatgactagagcactttgcagggcatcacaacaacaaaacccagcagcctccacaagagaaatggcagtaccaaaataaaacctaatcagtaagccatatatatgatttagtccataagctttcttttgctcctagtgcccattgcaggactcttatttttgctccttgtgcacatagctgggctatcaggagtaccagaacgtgatggctttccctttgttttgctcttcgccttttttggtgcaacggtaggtgttttatctccaatacatggcaaggctacaacatgttagatggctcaggttgattagagccagtaagtgatcttgatctagaaaagagagttgagaataaattgtatagaacaacataatgccagcaaattgacataattgatctatgtctcttgatctaattacttacctaattgatatacttgaacatgagctattgttccatgtactattgtcctcagtgaaatgaaagttttgactgtggaaaataaattgttatatacctaactgatctaaatccatgtagaatgaaataaagaaatttgcctaacctaggagagtatgccattattggtgtaactattggagcagccatgataattaaaaaaaagggctcgctaaagcactaaatcattcgatagtttaacacattaggggaaaaaacgctgctcttgtcgtctcggctgttgttagcttcagctactggctgtagcgctgctcttgccaaggcaatgcgagtgaccaaaatttgtcgatgctagaaacagcacaagcttgcaacaaacagcgcggggaatgcatgggaaattccaaatagaggttggacaatgtcgctgaactcctagtaataaagtgccctaggcctaggcagtgttgttggtctccaagcgcttgcaaggaagctccaggagaggcagatcattgggatactcacgcgtcgattaggtatggtagatccacccccaataagaagtgcaacaaaccaacaggaaaagaagatgattaacttaccggctagatgatccccaactgataagatccccaacttcctttggggtttctcctcctgctccagggagggcggtggccggcggcccgtgtggcgggaagaagacagctggacgacaacgtgcgcggcggggagggcggcgcgcgcggtgggagggcaacgcccgcgcggcaggaagaagacggctggacgacgacgcgcgtagcgggagggcggcgggacagctggacgacgacgcgcgcggcgggagggcgacgcccgcgtggcaggaagaagacggctggacgacnacgcgtgaggcgggagggtggcgtgtgcggccggaggggtacggaacagcagcgctagctactgcaagccggcggcgcgggaggccgctcgagtcgagtggataagaggtaggttgaccaaaaaggggataagacttagggttggaggggcattttggcattttttaaaaatactgacaatactacacacggtttgattaccatttctaacggaaacctaacaggaggggcatggaagggatgaaagcgaaatttgaggggtacagaggagattgagtaaaattcgagggcatggaagggattggatgagttttcatgggtatacaagggattttctcaaggaaaaaagactactaaaggtaactccttgcctgcttcatgaaatttctgctttccctagaatctcactttgggataattacgtctacgcatcaacatgtaaatcaggccattagtattaaattacattcatatatgtgccactgttgctatattatttcttaaatgtatcgtctgattccatagattctgttaacactgacacttcgatgcaaatgatagtacaaagtgaccgttattttgcgtgcttttgctatataacacattctcttcggatgaatatgtgttaggctttgtctaatatttttagataatgctataggcaaatcatcgaactgagagatacaagcaccatatttaatcttgagtcaatatatgtttaatgtttagaacagagcatgagagcatcaactatttggatattcatgcagcacattcacaacaaactagcatctacgtcaaagagcaattgccagaccgtacttttttttttaatatacgacgctgttgactttttaaatatgtttggttatttgttttattaaaaaattacgtagttatcatttattttttatggcttgatttatcattaaatgttttgtaagcatgacttatattttaatatgtttgcacaaacaaattgaataaaatgagtagtgaaacgcatataaaaagtcaaatgtgtcatatatttaaaaacata

SEQ ID NO: 60156 - DNA, 1452 bp, Oryza sativa
ttcctgcagccccctagataaaatatagaaaaattactttaaaaaaatcatattattatactatcttttaagtaactttaaactaatacataattgcctacttaattaatcatacgctaataaggtatttaaaaaaagagtactttttttaatgtgtggaggaaatatgcttccaagtcccaacctaaaccttcaaacgcacccttaacataaattttactcctgtgatccactccacctctcatttttttctcccaacccccctcaatctatgactttgttttcatgcactatgcaccacgccactagctgacctcccctacttctcctcgatagcaccaccgacgtcccctactctttggctgtgtttagatccatagtttggatccaaacttcagtccttttccatcacatcaacctgtcatacacacacaacttttcaatcacatcatctctaatttcaaccaaaatccaaactttgcgctgaactaaacacagcctttatcgttgtggccgtctcatcctccttgttgtcagagaccaccacatcatcgagcatcgccgccttttcttctcttagggcttgtttagtttccaaaaacatcacattgaatctttggacacatgcatggagtattaaatatagataaaaacaaaaactaatcgcatagttaggggggaaattgcgagacgaatcttttgagtctaattagtccatgattagccataagtgctacagtaaccaacatgtcataatgacggattaattaggctcaaaagattcgtctcgtggtttccagacgagtcataaaattagtttttttattagtgtccgaaaaacccttccgacatccggtcaaacgtccgatgtgacacctaaaaaaattcatttcgggaactaaacagggacgcccacgagcttgccgacggcgatcagttttgctcggactcgttgtcatgcttattatgtcgcctcaagttcgctattgctacgccatcgagcttgttggatccagtggcagatcgagtgtttgatgatagcagggacgaggaatactggttcagatcggacaacaactgatgaccgacatagcagggggcgaggagcttggcgggatggcgacaaccttatactcctccgttcctcgtctctgtcctgataatccacttattctgacaattaatctggtttgcaccggcctatcgtagatctattagacatatatatggtgcgacggggcgttacacaatacagtaagttttactcctccgtcctaaaaaaaagacaaaccctaggtttttgtgttcaactttgacggtccgttttatatgaaatttttttataattcatattttcattgttgttagatgacaaaacatgattaatattttatgcgtgacttgtatttttaattttttttataattttttcaaataagagggctgcaggaa

SEQ ID NO: 60157 - DNA, 1798 bp, Oryza sativa
acatggttggagggatgaggccttataaattggttccacccttactagactagcaaggtggtactaaacatgcgcacacagtttacatgggccacacatgcctcattctaattgggccaggatgtcatatatatgtgtatgagaggtgggagcaggtattgattgtgtactatatgtttataggtaattattgtatgaattggctataaaattgactatagatgatttgaagctggtagttggctatactattaaacttgctcttaggagttgctgcaagctcccgagctgtggggagtatggatatgaaatttataaattttggacaattaattaggaattgttgagatttgtttgaggggacagtgcatcataccacagttgttaggtaggtgtttgtttctctgccacaccttactaacttaggcttaccatactttcttatactttgggctcacaaatcattcactcttttatttttcaaaccacatgccacgtactgcacatttgtggcttactaattcatgactgcacttttatatcatattgtcatgccacactttagctaataaggttagttgtggcaaagttagttactgcaaccaaacagccgctaagtgcttattagctccctatatatatctctattgcggtgtggcatcatatcacacgcaaaactaattaagatcgagattgtccgtcccagcgtacctcgacatggtcggcggtgagcagagccaaatccaaggcaacggcggaaatggctgcagcggtaaggtggtacatcagcggcgcctagtgatcaacctcgaggataagaaccaccgggccgatctcctcaggtacgcggtcatggtggacgccgcctacaagacgttcgatgaggtgaagaagcaccccggcgagtcctacgagaccgtcttgtccagccgcctcgccaccaatgctgggtacgtcgtcaccgcccacctctacgccaccgtcgagccactaccactcccgccatgggttgtcgactcgttgccggccgccatcgccggcctgaacaagccgtactggttcggctacatcgccgtcggcgccggcaagcagcagggcgacgactgctgggacgacatcgtcgtcgtgctgcgcggctcggcgacggtcgccgacttcatgatggacatccatgtcgaacgcgtggcgttccaagggttggacggcgaacccgccggcggtgaggtagccgaggggttccacaaggtgtacaggtccaacgacgcggacaaggagcacggcgagctcagcgtgcagcagcaggtcgtcgaggaggtgaagcggctggcgaggcatctccgccggaagcagcagcagcccggaaaactgatccgcgtcaccatcaccggccacagcctcggcggcgcgctcgccctgatggcggcgcacgacgccgcggtggcgctggcagacgaggaccgccaccgccgcagcagcgagccgttgatcggagtccgagccgtgacgttcggcgcgccgcgcgtcggcgacgacgcgttccacggcgccctcgccgcgcgccgcgtccaagtgtcccgcgtcgtcgtcaaacaggacatagtgcccaagctgccggcgaacaatgtgcttgacggcgactacaacatcgagctcgacgaccatgatgccagcaagtcgccgcgggagctgatcaaggcacacagcctggacatgtacatgcacctcatcctgatgaccttgccgaacaccgactactactccaccatgttcaagatcaacgagaccagtaccgatcagg

SEQ ID NO: 60158 - DNA, 4488 bp, Oryza sativa
  unsure (1)..(4488): unsure at all n locations
tgtcaatgacagtctgacaataaaattgcatgcatttctcagtggctgaagattaaccatttcccttgctaacagacacagaagaatagaagaatatattaatgttctcattacccatttcccctcagagaaatgcatttctagatatatattatccaacactgttaatgccaaccagaatcctgatctcaaagtgtaccacgcctaatcttaaatttcacagttgggagtcatcgacaagtgttcctacaaccatttggccagttaacaaaagaattgcgcaataaatgaagtggtttagttccttttttacgagttacatgttccccatgatcgacgctgcaagaccaacatatatagctgcaggcaagacgcttccgaaacagcttcaactgtcaaggagatgtttttataaaatttagtcatctacgttagttcatgattgtagctacctatcaaggagatgttcttttaccttcaggcgatgtcccctcattcttagttgtcatccgaataattatatttttttaaaagaaaatcacaatatagattaatatgtaatatatcacttcataaaatgtaagtataaattcaattcagctattcagttaattaaaaaaagaaacgaatgtgattataaatagtgcatgtactagttcagcttttttttcaacttatcgtaggacatatttaaacttacatatgatgatatatcaatttttttatctaagttgtcaatttctttcaaaagcttttaatatataacagtttggatttcataccagaaatgagggtgtaaaatcaaagcgttttttattgttattctgtgatgaacaattgacatctgtgtttattggttttgatatttggagattattggcgaagtggttttggagatgactgattttttcaggtgataaacagggttactgtttcttgtcaggtccggtcagaccaggcagtggttgcctgtcagaccggcgctatgcgagcggtcagaccggtttagcccacggtctgaccggccgactctgtgtcggttttagtttcagtttgtttgtttggatatccgtgattgtttcgggtttatgacttctagatggatactatgtgtatgtaatactgttgtttgctactaatgagtcaagttggagatagcttggtctcggaatatggtttctttgtttgattcatgtgtaggtgacttgatgcctcgggagagtattgccggtgatggatcgggagttgacttggggataaggcgacgtccgtgacggtcagatatcatatgggatacttaggctagagttcaatgcacgtggttggtgaagattccatatagcatacgatggaggtattgtgtgccccgagtttgtaaagtttgtttcttgtacggaaaggtttcctaggtggattagaacttctagtatgagtttggttcgtggctttaggctgcctacctcatgtataaatagagagggagcgtgaggtttcccggtatcgcttttgagagcattgagttgtgagtttagttagggtttcgagtttagtcgagattttcgtgaggagtgctgttgttgcactttgtaaacacagagagaagtaaaaaagttgtcatctactttgagagttcttcgatttatgttttctcgagttcggcggtctaaccggcgaaacaccggcgatcagactggcggcattgcggcggtcagaccggcggcagctatacaagcgacatcggttgatctcgcggtttgaccgaaggttcaacctcggtcagacggtggtatccatgcggtcagaccggtgcgactacttcggtcagactacgatccgtcaaatttgagggtaacttttaattccgcaaaaagtttgggtttttgggtataccaaccattcatccctctctaattggcttagttcttgtgtttttatcctacaaagggtacatccccttgatcattcatgattttccactatcatgaatatccgtgtttagttattcttaatctgattcaccgttacttgatcaaccttgatagctcacacgcatgtacattgtgtccatgcatggtgatgacttacaatatttatataaataggcatggtacggtggactgtttggccagacagtttcaactatatataccttagaaaagaagcggaacgggttacaatgctcttacaaaataaattagaaaagtggaattgatttcaggttactttactccatatctaactcttaaaattaaatttagaagttaaaaccntaccacctgatcntaagatggtcactcgataccaaaccaaacccaaccaatatgagtacttaacttagtatgtgagttaaactttggcttggtatgctccttttatgttggacctatgcttaatgggacaattagttcttaccactattttaacttgtaattttaccctcattcttgaactgcaatttgtgtttgcccactcctatttcgatcagacttcacggtgttaaaactcatctatatatgtctttgcagatttaccactacttccctaagaactttgtgactttgcccttgttttgacattaaaaattttgagatgaactttggccctactttaatagcaatattcacttattcaagataaggacaagtataagcttgacatgaactttgcccctgttttaacatgaattttaacaccattaaattcccctaatgcaataagggcaagtacaagcttcgtcaaaatcataaagttggaaaaacatgaggaaaatcataatttgaattcaaaacatgataataacgcaaataccccatgcttaatttgctccgaatttaggcttcgtttagttcagcttatcagttgattagctagtaaatgaatataaggatcaattaaatatataaattataaagttaacaaataggttagaaaaaagttatctgcgcaatgctgatgaatttttttttttgaagaaatcgtaattataaaagcatgacacagataatagatatgcctccattagttaaaaagaaaggttattgtttagttattagttaattcatgatttttcttgaggaaaagttaattgacaattgaattaattaagggaatatcttcaaaaaaaaactgccacaagttttttttagtcaaaaattttcaaatgtaactatagtataattgaaatataattacattataactatattgtaactacacttcctgacccaatatgcatactcacatctctagcaatggtggcaatgtatataagatccccataaaaaatgtggctacatctaatcaatggactagtggtttcaaaacaaccaaattatttcccaaccattaccactagctcggtagttgcattggatcttgccaagaaagcatattttgcaccttggaagattaaataggaagacaggaaaaagtgactacgaattcctctttttgtttgtgaatccctgtttgtatcctttgagcgatattagataagtatagaaaaatcaatttaaaactgcaagtgcatgtgcacctacaccctttatcattattttctttaagatatatgtatgtaagtatagatttcaataaagtttaattatcattatattcctctttttgatatagcatgaatcacaataaagcatccaatgactcggtatgtaatgtaggtgcatatgcattgcgttgtaaaaatcttcttctaataagtagaacataattttatattactacaacaaatgcaaatggcagtgtgagagcatcaactcacgattgccctgtcatcacaaattttcaatatgaagattccttgtgcatgagttcatatatacacatcccgaaatgcttttttatatccaatggatggtttccattttagtaaagtacatgggcatgcataaaaaaataagattaggatgttaataattagggtcgtcaaacatccttagccaatcaacacaacttatagatgagacaacatctaagttggggaacaagacagagtagatcactagggaaataatttcaacaatattcccaacataaacagagagtcataacctctggctgcctccgccaacccagcaagcaccacgccacgcgaaggggagaaaaaattaaaatcacaggagtagaaaaaatagagaagcatgtagaaatgtggacgagaaacaaaagattaaaaaacataaaaaaactgaaaaaaaaacaatcgttcggatagggcataagaaaaactcatgaatcttgattctttattagaaggtataacgtggtagcatatgttatctatttttttgtgcttagagcacctcaagtataatgctaaaaatcgaactatgcgtaagaaaaaccgaactgaccacacagtgagaaagctctaagctagctgcatccgaataatgatgaactaatgcatgcatggttccatatactccctccatcccaaaatgtttgatgccgttgactttttaaaaatgtttg

SEQ ID NO: 60159 - DNA, 6166 bp, Oryza sativa
cacatatagttttacacatttcacaaaattttttgaataagacgaacggtcaaacatattttaaaaagtcaacagtgtcaaacatttagggaaggagggagtatataattatatattcttctccatcttatccattccaatgacaaattgacaatgaatctcagatccacatgtatatatgcacgaaaaaactatacacacatgtggttgtgtccagtgcggagccagggatgcagccgtccacctaattctgggatgttgatgagtggatcttgccaggagtaagcctgaaattagaacggttagataagaagaaataggtactagtaagtactattacttaatccaacaaatgcatgtgatgacgactgattaatcaattataagtcaatacaatgttacttaaaaaaagaacaacaatcgatttttcactagatacatgcatgtgctaggcagcttaattacacatggaacatgctaacatttttttaggcaaaaatctaaatagtgtgtaggcgatgttttgcttaactattgcacggttttttcagttaatggttttgacaacctatatcaaggtaatatttttatgatccaattatatcactatattcattacaattaaatatttataacatgatctgatctcatatgattatattccgatgaaagaatttctagaaaaaagtataatggtgaaagaatttacttttatcatatatgtaaattagttttggaattgaattaattacttcttagacatttatgaaaataacttcaataaaacttaaaagtaatttatacaattttaaaagtaacttaacaaaaaaaagttataacggcaataaaagtaaatcctttgtgggattaatagtatactcacacggagaacgaagaagtggccgttctgatgctgattaaaatttagcctaaagacttaatgatcactatcatgtactcaacaacaaaagtaggagatgtataccatttttattattaaaaaaaactccattactttatactcgctccatttcatattataagtcgtttgacttttttcttagttataactactttacgtttgatcgagtttgtagaaaataatagactaatattttcaatacaaaacaaacatattatcaaaatatatttaacactaaatttaatgaaactaatttggtgttgtagatgtttctattttttctataaacttgatcaaacctaaagaactttaacttaaaaacaatcaaacaaaacggagggagtactttagcaaggtcggaccggctatatataatgcatgctgcattgcagtgtgtttacacacacactccaagcctttgccttgcgttgccatgggcagcgtcaaccagagcagcctcctccatggcatggcgggaaagctcagggcctctttggttgccgccaaatgcagcaatcgattcgttcgtttgcctgcagcagcagcagcagtcgactctgctcatcacacgagatcaagatttctttcgtcgcaggttgccacgagtaaggtgtacgagcatccatcatcatcatggcgaaagccggccaggacgtcgaggatgatctcctccgccatggccgccggcgccgacgacggcgacagagacgagctcctcggctacgggctcatggtggacgccgcctacctgacctacgacgccgtcacgaagcagcagcccggcggcggcgagcgctacgaagccgtcttgtccggcgagctcgacaagctcatcgccaccgccgatgccagccgccgccgccgccggcacgtcgtcaccgcccacttcttcgccaccattgagccgctccaggcggtgctcgacgctctgcccgtcgtcggcggcgtggacaagacgtactggttcggctacgtcgccgtcgccaggcgcggcgactgctgggacgtcgtcgtcgcgtggcgcggctcgtcgacgctcgccgactggatgatggacatgcatgtcatgaatctcgtcgacttcggcggcggcgccggcaccgccggccatgtggcggaggggttctacaacgtgtacacgtccaaggacgtgaaggtgaagcacggcacggtcagcgccaaggagcaggccgtcatggaggtgaagcggctggtagaccatctccgacggcgttccggcgccgccggcgagaagcccgtcaaggtgcgggtgaccgtgacggggcacagcctcggcggcgcggtggccgtgatgaccgcccacgacgtcgcggcggcgctggccgccgacgccgacgccgagggcgttcgtgtccgcgccgtgacgttcggcgcgccgcgcgtcgcgacgacgcgttccgccgcgccgtcgccgcgcgcggcgtggaggtgttccgcgtcatcgtcaagcaggacatcgtgccgaagctgccgatggggaaggagtacgtcgacgccagcgacggcgactacgacatcatcaagctcgacgacggcggcaactggttgtcgccgctggagctgatcagggcgcacagcctgaacctgtacctgcaactcatcaccctgcgtaaccccgccatcacttccgtgctcagcaattcgaacagcgatgcgccgccgccgccgccggcggtgagagaggagtgggtgaatatgaaggaggaggagggatacatgcggctgccgctggagaagctagaagaggagctggacaagctagagggcccaagcccaagaaagtgaccaaagtttgaagcccatgactgaaatttccctaacttgggccatgcttcgaacgacttctgcagaaactattacttttgtaatttgtatttgcgttcatcctattttgtttactcctcctgttttgtttaatctccagataaataaaatggcatatatcgctgtttaaatatttgcatttaaatggtttgtagtgatctttttccataataacgttataaattccagcatcacgtcagtgacaatctgacgacaagatgtttacacgacagaacaagaaaatggatatgggttgtacaaaataaatcattgcatttctcaatggctgcaaaattaacaatcttccttgataacagatagaagtatatagaagaattagtttttttttctgaatacaagttaatttctcattcccctccgacaaacgcatttctagatctatccaacactgttaatgctaaccagaaacctgatctgaaatagtctacgcctaatctccagaaatttcaagttgggagtcatcgacaagtgttcctacaaccatttggccaggaaacaaaagaattgcacaataaagtgggttagtccctattttacgagttacatgttccccaggatcgacgctgcaaaaccaacataaatagcaggcaagacgtgttcttctgaaacagcttcaactaaatatatattcatggtatctgcaccatccacataaagtaagtattagacagttgggtgtgatgaaaattcaaagaaagtgaacactgatttgcaaattgcaaaatgttgccgtcaaacatagtagattgattttcatatggcagttgatattatgtatgtatgtatgtatgtatgtatgtattacaacaacagctctgtcatacgcttgaatatttcaagaacagataactaaagatttgcaaatgatgctggatgttttgcaaagaaacaacattaagcatgcagtgtgctgcaagaaagtatttttatgatacattactacatttctgcatcaaagtcttcctctgttatgatctaaacagaaagcagcattgatttctttctctttctagaatagcatcaggtaaattgaagatggtctacaactctacagttacagtatggtttgccactttatcgtgtgaaaaggaagacagaaatttgtcgaggtccaaaattgacttcccacaaagaaaaaatcagggcaaatacatctacacataattactttactatgatgtggataataaatacaaaatgagactattgtttagggagccaagcaaaaggcagtatgtcttattctcttcattgactaatacttcgaattatttattaattaatcatttaatatttaaaaaaagtagatattctgcctgacacattactaaatttgttggtgttaattcacttctttttcatagattggcaagattgttgttcatgcatccacaacccatcactagatctatgggaagtacagaagatatttgaatgctgcaaacaaaaaaagttcaagtagcactaaccactactgcggtgggttttgatgacagaaaccttctgagcctcctttttaaggacatatgacatggattgacaatcgaactaaggaaagtgtagctaactaagtccattccctgtgtcatctgttctggaactcttgtgctgacatacacaagccatgttaacaaacaaaaacgaattactctatgaggaaatttgcaataccagcaaggatcataatggctgtgtgtgctaccttacttttcttgtgcttatgcacatcggctgaatcctccattccctcatgcttccttttctgaaagatgtccaaagcccagcatatggaaagatggttagctatagaagttttcaacatacgaaatttcctacattaaatggacaaaccttctcatgatgtttctttgaatgatcgccaccagaatcatgatgcccacttttatcctttttcttgtccttatccttgtctttgtctttgtctttactcctatctttatgccgatgtttgtgcttcttatgctccttgtctttgtccctgtctttgtctttgtgctttttatgcttcttctctttgtctttggactcacttttcagtttaccagatatagtcggtatacccttttcagcctgatgaatggttcaatgttgtaaagaggacaatgagcaaatgaacactgtgatagcagaagtaggaggataaatggatcttacagagggcaaatctactggagccgtttctcgaagctgaaatgcttgccccagtgtttccatgtcaaacggctggatataagcaggcttgtccctcaagtatgcgttctgaaccagctgatctagctccattccttctcctttacgaatttcagtgtccccaacaacattgtcaagataatgtgtatctgatattgccaatggcaaaggcttcttgcaaaagaaatcatggtgggcaagcaatttatagtggcttattaaatcaacagcaccagtgagctccctagggcctgaaatatcagaaccaccagcatttcaagcaaccaagacatggaaaaggacatgtatcaaaaattatgttacaaaagagaaaatagcttataatgaacagtcgtcgcactggtaggctcaaaagtcagcactgatttaaatcacagcaaaaagaaaatcactgcataacacccccaccaaaaaaaaattgaccacaaatatttcaagatgtttgacagtgtttccggtacatggagctcactcagctcaggacaacaacatgatgtttgcatcagataaccaatacaaatgattatggtggcatcagctacacgccaaataaagcacagattatccctgcttattctttaaacatagttgggacgtttttgctggaaatcttttgatgttcagaaaaaaaaatccttatcaacaaaaaacctaccttttccaaacttcttgtcatcagaatccatcaggttgaatcttagcctaagcacagtgcatattcacctgaaattcaattgaacaaaattttacaactagcgtacaaaagcaaagtcaataggtcacagtatgaacttacactgtggcttaatcgatccctgttcccggaaacagaatatctaccaaaacaaaattgattttcatttcccaaaagcagacccatttattgaaaacaatttatcacatttcaaattagatcatctattatccatctatatattcaaccacataatgccatgactgcaatactgcgtaaatattaataaacagattgataagctaaactccaccaatcctggaagacacttacaataaatattctcatattatggaacatatatcttagttttcttgaacttcttagtacttactgtcgaactgtcaaagtatcacaacgaggaaacttaagtggctctatgagttttaaaa

SEQ ID NO: 60160 - DNA, 1059 bp, Oryza sativa
cgattatataagaacaccaacgaatgaattaaaaatcaatgtttaaaaatttaaaaatggaatttgaaaagtacgccatccattttattttgtttaacgttgattatttcaaaattagacaggtcatacatttgaaaatagaggtagtacttttttcaaaaatcacaccgtataggagatttggtactaggaccagtgacataataaatttggacaagaaaaaaaatagcagttttcgttgatagctcgttctttagtccgtcgaattctatggtcaggctacctggctgacacatcagtacatcacacaagaaactcaacgctatattttaaacagaagcaataatgcaatatatccaaggataacgtctgcgtgaaattcaatcttttttctaccgagcatgcattactaatttcaggacataattgacttctctgttttttttttctttcaaacctttgcactgctatagagttggcacattcaaagaaccagcacatactggcatacaaccaacaaaagaaatgatataatctcatccaaaactgtccacctccagttagtgcataaatagcagacaagaaaatgctttgcccctgtaccgtacttctagcagctaaaatgcaaatgtgatttctgtccctgcctcaggctttcatttccccacccacattcgcattcacctcaatcacccaaacacagctgtatggtactcctagatatataccacatgagctccgggaggtgaagcagtaaatatcccaccgatataatacttatcttggcgtagaagagctcctgtgaaatggtatccgctgtcagtcgagcaagacgaattcaggtcaagcaaatggagaccctggtccatgtatgcgcggcacaaaatattgccttcatggggggatcgatcgatgttgcctgctgtcagttgtgaaatcgaaggagtggatgagtgagcgtcatctgtagttacagcagtgtgctcggcctgatgacagtttgttccagaggcacagcatttgccaaggtgactggtaatgcgccgtgaagtagttatg

SEQ ID NO: 60161 - DNA, 1566 bp, Oryza sativa
tatttccatgtaaatttgtaagttcaagctgtgcctttttcacttctttttgtaccaaaataatacaaactcttgttacttggatcactgcattggttctaatcttgacagagtttaaggttggcactttctgtcagaagttaagttaggacttccacaaaattataccatctctgggtgttcttataggtgtttctcactatcaggaatgtacagttcttgcagctgtcaagttctttgtacctatgtttctgtatcttctaaagattttgattcgtctgcactgtgcagccatatctccatgagtcacggcatcaacatgccctgaaaagggctaggggagctggaggccgatttcttaattcaaaatcggatgacaaggaagagcattctgattccagttccagagataaacaggatggagttgcaccccgtgatagtggccaaccgtctacctctccgtcttcaaagggtgcatcatcagctaaacaaaataagaagtcaaaaaccagtaactaaacgggatttaagcacctggtgtgaaacatggaaacagttttgtacagtacatgctagtgatcgacaaagaatggtgtcattgggtgttgtaggataatgctcatagagaatatatagacagggcaacagattttgcagcctttggttcggtctgctcagtttctttaccttcttgtacaatgagtagttttcgtcagttgtgctttgtcatggggatagctgaatttcttcaggaagtcttgtagttttaaagagttcattagcttgccaattgtttgctttggattggattggtctcttactgcctttgcatcatcatctgcagtgcacagaataaaacattggctatgtgtatgttcatgacaataaaccttaaatgtaggacaagcagtgacttcatctggagctttatctcttctgcacacactccagatgccaaatgatattcccatctttctcttggaatatcatgtattcatgtgatcttaacagctgttatggcaatccatgatcttaggttatgtcttcgcctctttggcttgttgatatgatgcttgcattgcatacctgtaatgcatgttctccattgagttgcctgatgattatgtgagactaagaacatatctctgaacctgattttgataggcctattacaatccaggcatgtcttctccatcatgttgccattacatgagcatatgcttttctcgagaagatggaaattagcagccattaccaagaagaatatactttctcgagaacactgaaacattttaatttgtaccttttctcgcacgagcacatctcgcttttttgcttagaaagaccacaaggataaaggataatactgaggaagaaaggataatctgaatctcgactttcttcaaaggttctgaacttactttgaatggtaagggttctgaacttaatgtgaacaattctgaacttctgaatctcaactttcttcaaaggttctgaacttctttgaatggtagggttctgaacttaatgtgaacaattctgaacttctgtttggcttctgggaag

SEQ ID NO: 60162 - DNA, 1565 bp, Oryza sativa
tgcccagcccccagccctcattcttctcttctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgttgatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaagaaacgtccgttacaggccaagtggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatctaggtgtgcagacgaacatggatgatggcgagggaccaagtgctgaagtaaacgagacttctgtgaggaggtcaacgcacgagaggacgggggcgtagtagctccagtgggcattcaaccaggtggagtggccgacgagggggagactgtcggtgccattgtggatgaaatggagagggaggattctgacaacgaacgtgtagaagaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagtttggtgtgttaaggaaaaagatggttgtccctagagagtgcacgcgtataaggggaaatggaaggattattggacagtgtcagttgttaccaagcatacatgttttctacctggtgttcagaaataccataggaacattacatgtgcatttgttgcatctgagatgtatgcgcatgtcatcgataacctcacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacat

SEQ ID NO: 60163 - DNA, 1058 bp, Oryza sativa
gtgccctagcacttaattgatcttttccgtagcttaatttttacagtgctgctcctgcttagctgaacatgcatcaacagacagaaagacagacagatctcactctacacatctctagacaacatcaacctaaatttcactccatgcttggtaatctaattaactgttggtctctctccactatgatactgacagtaaccagtgattagcagtaagtaagggcgtgttttgttctttgccaaactcaaccataccaaaattttgtcaatagcaaaggtttagccactgccaaaaaattgataaggttgatcatttgatttctaatttcttgccaaaatttttgaaatgtgtgtgctttacttggttttggttgctaaatttttggcaaagcctgttttggcaacaaagcaaatggaaccatcattcattgtcattacctttttttttttgacatggttgaattggacaatgaaccagaatccaaattctaaaattgaattttccatttgctcttcagcttatccgccacagccaaaatttaaatttcaaaacttaattttagatttgattctgatgtttcttgctcaacgtagtttatttatattactgcctttttaagtcgctaatagttgtttcggtttataatcggctataggcaagtttggggagtttctagcagatgcggtttcttccagaatcaaaagctgcctaaaatagttcggttttttattcatattccgagaagctagacttacataatttcaaaaaataaactacaagtcaggagttatgctttcttcttcagatttctaaagccggctacctatcacccgcttcttaaaatcgtaaagttcaccaaacagaatccatggtagcctgaagaatgaaaagagagtgaagagaggatgatgatgctacaggcaatgcttggataattggactccctttggcattttatagcattagcgttgggaggagtggtgaggtagcaccaccatgtgtcgtgctcgctgctgatgctgataccagggttcgccataccgccgttatccgcgcgg

SEQ ID NO: 60164 - DNA, 1178 bp, Oryza sativa
agattagtatacattagcaccttcctattgggctttgctggtgtgccttgcatccaaagtgatgccactatctccacaaatgcaggctttaccccatgatcaccaaatatgcttatgggaaaaggaattaaaggagaagattttggccagttgaatgagtttaattgcactgtttattctttcagtgttggaatgaaatgtgaggtcaaaattgttctggtgatgtattcagtagtagaagatttttactctgaaattgaccgttgtcctgaagataaatgactgtgaacagtaaattttttacacttctgtaataactgttgctgacttgctgtacctgtacatcattaacctgtctaaaattttttcaaatctttacacaagcagaacaattgatgctccgtggccgtaaaattgtctctcttgtctgattcctgcaatctttggacattcaatccagatctgaaattcttgctgtttctacacaaacaaggagtatactattatgcagttgccagtggatttcaccatcttaaaattgtttgcatttacatcagcacaatagacagaaacatttctatgctgtactacaaagatgacaagatctagcattgcatcaagaagtatctaggaagaacagaaaacaggaaactgttcttagatcttctcctcatcaggtttcctcactgaagaaacttgcaatgctcatctctgcaaaaggttgatgcatatgcattgaaacagctctccaaaatgctacaagcattatctatattgaccaaagatctgttctttgcatctgtacctcacagaagagattgcttggaacataaaaagagctaagggtgaaataatttccatggaaagtgtcatgctcttgttgcttcagaatggcaggcaagggtggtaaaagctgatgggtgcaagatcctgcatttaagcacctgggtgcagttaatggcattactcatgagattgtgtagatggatgtgaggcagttcaagtgcctctgctgggtttgaaatggcatggcaagcttctggctgacagagtgacagagtgcattcaattggttgtcattgctgcatatactcctctctctacatgcagggtactaggggttgaaaatgtgcaattttttatagactttgagatgatgctaacaaaacagtaacacc

SEQ ID NO: 60165 - DNA, 710 bp, Oryza sativa
atcgtcgtcaagaatatttggacaaacaaagaaccttcgacccaatgttgtaggatttatggaacgaagaacctgacaacgatcactacacctgcatcttggacgggcttcccatggagggagtgccgtagttagcacccgccaatcgctctgttgttcacgacattgtcgttcataagccgcttttctctgtaagtattgctcagtactttcggatgtgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaagttggtagtaggtatacacaaggatcgctacgccagtttggatcctcaacacctcggcgtctagccattgacgaaagccggtcggatttgtaatgaagcaagtggggaagagagtactaaatgtgattgagttctgaaagattgtgaggcctcactcgttaaggcgacttatataggcgcaaaaaatcgagtgatacccctgac

SEQ ID NO: 60166 - DNA, 1529 bp, Oryza sativa
cgcaggttttgtttttttacagagggagtacgaatcaaaccgcgaatcaggatggatgagcccacagtaacagttctcgtatacccgaaatgatacggcggagtgtgcagttgaatgtcacgtcaacagacagatgcagtgcaatgcaaaagcagagacgacatggatacagtgctgtaatactgtctctcatatgctgcacagtgcactgccactgtaccagtatttcgccgctgctactttttattttgttttatttcttcatgttcaactttgaaattcatagtactatcaatcatctgtttcaaagtatttcatacaaaatttccttgcaatattaaatactccaaatttcatacgccttatttataaatcaaagagagcttaaatggattaaagagggagtcagggagagaatagagacaaagagccaagttatgttggtctttttaatggagaactaaaatgaagttgtatttaggtgacatgaaagtatttttgatgatgtgataaaaaaataataaagtgtcataccagtatttttttatgaaaccatgttaacattgttttcttacaatttatctcttacatgtactacctatgaaacaaaaaaaatgaaacaagaaagaaaagatgacattttcaaaaattttcatattcatattcaagtacctatgaaaaatcattttcatattaaatatcttattacctaacacttttaaaaatatgaaaatgatttctttcactgggctactcatggagcaagaaagaaaagaaaaaaaagaaatttactatgcatacgacctaactatccaactcacgtagaattgaatttgatcaacgtttgtaaacggttgcagtgcatatgacatattcttctttaattgatttatggtttagtacatatctctaattatatatgggttataaaattggatagtacatactataacattactcctacttgagaaaaaaaaatactactccctcctaactaataatacttgtcgtcttagataagagtgatgttaaactttagaatctttgattgtgaatcgtttttaaaatatttatcttttaaatattgtgactacatgtatagattagtcttaaaaatactttagtaaaatcatatatttgttaatattatatattaattataatagaaaataatggttaaagtaattttttaaaaaccgtttcgtttttcaaaccaataccaggtttatttaccaggggaagtgtgggggaagggagaaaagaaggaagccaccgaggggatcccgggcgagatacgccgtcggggaagacaaatcgcgtgccaggtattattatcatattaattaatccccacaccagggcggatctgaaccgtccatccctaacggccacgctgatcctgcggctcacgatcggtcaatgcccgattgcccggtccacgtagcccgtctctcttcgaccgtacggcgcacgcgcactgctgccactgtcactgtctccggatcttctgtggctgctcggcagcagca

SEQ ID NO: 60167 - DNA, 1963 bp, Oryza sativa
caggaacagtgacatggactaaagttgagcttgagcgatcggtgatgcaagctaccgcatcatttgatttttcgtactacctccgattcgaaataaattcagtccatgtttatttggtgaaaagaaaattttttggtgtcacatccgatatttgaccggatatcggaaggggttttcggatatgaataaaaaactaatttcataactcgcctgtaaaccacgagacgaatttattaagcctaattaatccgtcattagcatacgttgtttttactgtagcacttatagctaattataagactaattaggctcaaaagattcgtctcgtgatttctatgcaaactgtgcaattagtttttctttttatctatatttaatgctttatgcatgtatccaaagattcgttatgatgtttctgggaaaaaaaatagaaactacacaaggcctgatacgaaatatgatatatatcatatcagccttttgctttattttaagattgttcgatttattttgacatggaggacttagctagtgtggtttgcctcttcatcttcaatgagccattgtgcaaaaatgttgtcttagttggctttattatctgcagccaaggcttaattttaaataattcagacataaaaaggttaaatattatttattatctgcaaacagattgcttcatcgtttgctcttcatcttatcaaccataacaaaattaaaatttaacttaattttagagttcatcatggtagtttatttttagcattggtttttaagatgctaagaacgctatgtcaaagttctagagaaattttaaaaaattgctttatcctaaacgctaataagtattactctcttcgtttcacaatgtaagttattctaatattttttacatttatattgatgttaatgaatctagatgtgagaaatgttagaatgatttatattgtgaccggataaagtactatcttctccagcctctagggtgacactggactgtatccagagtataatcgatcgtggacgatggggtgacactggagtgtacacagagtttcatacactattctactactaatattcaaatatatcctactactaatattcaaatattttaccaccgacatcttgttcatttactgagggagaaaatgactgaagattgtgtagatctctctttttcagttatctctcaagctttattagtccggaatttttgcaaaccaagataattaagtttagtttgaaatggcgataaacttttcaaccacacgagtacagaggagctgagctgagcaggtggcaggccagctgcaccgctgtattttcagagacagttcatgtaggagtatatccagcactgaaaatagtttttataacagaaaaagccacacacacaaacacttggaaagaatagaaaccatgcttcaatcgaaaactaaaaaaaaaaaataacctcacagagttctcaaaagcagcagtacatttcagagaaataaaaaactaatcttgcattgcctccacgcctacagtagaatctctctctctctcgagagagagacagctttacactgttcaaagctgccacttacccccaaaaaacctttcagttttggacagctcatccctgttttaaacctaaaaaagagagtgtgcatgcgcattagaagtgcagaagtgatctgttcaagattaatgcaaaatcctgcaaattactcagtcagttcaaacttgctatagccaattctgaaaaaaagtagtactatcatttcagaaaagagatttgctgtaccttgccaagtctgaagaaaaaaaaagaactaaaaaaacaaccttttctttttgcaaagggattcagaaaaagagaccgacctcattgtttgacttaatgcttatacttatataagtcaaaatttaaattttacagcttaatctgaatttgaccttttggtttgggctgcaggaa

SEQ ID NO: 60168 - DNA, 6549 bp, Oryza sativa
  unsure (1)..(6549): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatttatctagctataggtagtagtaagcttggatttagcgtagaaggtttcggccaggttcttgatgactaaaactgcgaacaaaagttcaggaccagcttctccaatagctccaacggcgccggcgtagacggcgagcccaccgacggcgaagccaccgacggcggcggccgccgcgatgacacggtcgatccgacggctagtctcgtcccacacgaagtatcccgttccgatcacccgcgtcctgaactccctcgccgacgagcgcgacgcctcggcccaggccatggagaggagcgtgcacgacgcgacgacgaacacgctatggatcagcagctcgtggatcaggccgggatccaccagcagcttcgacggcggcgtgacgtagtagacgaggccgcccaccgggtaggcggcgccgccgccggcgtccttccacctgccgagcaggttgacgacgaaaccgccgccgccgccgccgctgctgtggaggtggagctggtgcgagactcgacgcagaacgccgagacggcggaggcgtgcagcatgatgggcatcgcggaggtgtagagcagcttgattgggacgaactcgtcggtgccgcggcgcggtctggagcggtacagccgccggaggtgggtctcgtcgaggcgcacggcgaggacgaacataacgcaggtggtcatgtagttggagaggttgggaggtccaggcggagcagcgtgaagaggagcgccccggccttgtgccgccacgacggcggcgcggcggccacgcggtgggtgacggcgaacacgggcccctcgaactccgggccggcgccggcgaggcggagcttcacggggctgaacaggtgcgacaccgcgcgctcgcaggcgttggtggcgatgagcaaggaggcggcggagacgccctccacgccgtagcccgtctcgtggaggaggtcggccagcacgacgaccacgccgccggcgaagagctggagcacgacgagcgccgcgttgcccgctccgccgctcccgcacatcccaagcgccgccgcgatcccgatcaccaaccgcgacgcgttcctacgagagaccgtgacgtgtgtaaagccggagagaacgtgacgtgacgtaagcgaggcatcgagctagtaactcacaggaggccacggtggttgaggagtcggagtcgaagaggagggcggcgaggaggcgcaccaccacccacgacgtgacgacgggggcgacgccgagctccatcactgtgccgcggggcgcggcgaggaggggccgcgcccagaacagcgggtcggggtcggcgtcgccggcgccggcgtagagcgggacgtggctcagcgagagcaggagcagcagcgacgccgccgccgtgttccgcacctggccgcggaacggcaccgccgcttccctcctcctctgcatccgcggccccagcacgcaagcggccggagcagccgccacagcgccgtgccgcgagcccgtgacttctcctccgccgtgcgagccatatccgccgccgcgatggctcgccggcgatctcttctgcctcgtcgttgattcggactgttcgatcgataggccgagttgatataacatgacatccgcgcatgtgcgtaggccgagttgggctgcaattgggcccaaggaggggaataagttcaatttttgaccctcaaaagtggtcgaaatctaatccgtgaccccaaactacaaaactggatatctcgaccccctaactctcgaaatcggtacaatttgactccctgggtggttttagagcgcggtttcgctgacgtggcacctacgtaacggtgttggctcggtcttctttccacgtggcgcttacgtgacattagaaataaaaaatatttgggacccatttgtcatacacacaggaaaaatgtgggagtcactgttatgtggagcccacataatcctctcctccccgtcttcctcctcccttctctcctctccacggacgatggagtctgcgccgactcgccgccggccaccgccttggccgccgtcacagacggcatcaccaacgcccctcccccgcgggttgtcgtcggcctcccccacccctccccgcggagccgttgctagcgcacccggcggcgggcgggagggcgggcgctggagctgctgcgacgacgaccccttgtctcttgctctccttccttcttcaagcggtgtggcgacgaggagcagccgcggagcatgattcctgcggcggagatggcgatgacgcggtggaggccggtcggcctcgaggtagcgcgccgtggcggcgcacggggtgaggcaggcgtggaggacacggtggaccgggtggaggaagaggtggaacgcgtgcgggggcgcaggaggaagcgaccagcatcaattatcacgacgagctgctttgggtgtccgtccacgccgacatcggctactgcttttctgactcgcgccgcctcagcctgccataactccaatccaacatccaggtacagctcttactatacaattaaattaaatctgccattagttagtaactaagcttgataatatttgataatcagcgagatgtacagaggatcttggccatctccgagatatacagcggtgacgcctgcatgacaatcatcggtgagatgaatcaactgatatagaatttctccggtatctgcgccacagctcagagaaaggcacccgcccgccgccgccggaatcatgctccgcggctgctcctcgtcgccacaccgctcctactcgtcgtttctgtttcgccggaacatctccgccgctgacccccgtcccacggccgcagctcgccaacggaagagagaggggggagaggatgatttatgtgggccccacatatcagtgggttccacccatacttttggtgaatgacaaatgagttccacgtatatttttttatttctaatgccacctaagcgccacgtcaacgccacatgaaaagaagtccgagtcaataccaccacgtaggctatcagcgaaaccgccctccaaaaccactaagcgagttaaattgcaccggtttcgagagttagggggtcgagatatccggttttgtgatttacggttacggattagatttcgatcacttttgagggtcacgaagtgaacttattccccaaggaggacgcgaccgttggatcctattcgcagcccagctcggcgaagcaaatggattatttatttatttatttatttttattattactacaataaaaatgcccgtgcgttgcaatggatgaatgctattttaattttattattgttgtacggtttagctagaatgaaattcactttggcaattcgcctagatatttgatgaactaagtctgattttcattttaagttagcagtatttttaaagagatttttatatttccaaaagtaaacgaatttaaaatccgactcaaacacggatctgtattttaaaaagcgaacgaaattaaaaaccgactcaaatacggatgacgtacgaaaataccagcaaaaacatattcaatttttataatagtagagatagagattggattgtaatgagaaacgtaaagctattcttttgttatctgaaaagtatgtctcatattttcattgctcgttggcttattaattgcagcccaattttaaaatatgaaacttaattttagagttgtttttctcattgtaatttgtttttcaacgttggctttaaattattaagaacacgacataaaattgtactcataaattattttcgattgattatctattaattgccgcctccgcctccacgccctcggcgaagcgctccaccaccttctcctcctcctcgctgctgctcatgtcttcttcttggcattcttcctcctccagctgctgatctgtgtccatggcagagatcgccggagaagagatcgctcgacttgaggcccgcggcgtcggcgtcagcgccggctgcgaggcaggaggtggtggatcgacagacatccgcgcacgtgcgtgggccggtgataggctgagttgggctgcaactgggcccaaacaagacacgattctattcgtggccgagatcagtgagcaggacgtagcactgagaaaagtctatttgggctccctcaactatgtaccacaatcagcaaaggataatggtttaagctgagagcataatgagccggttttgataggtagaaacgcttttgttttagtttaacggtggaggaatacgaatcacattcagcaaatacttccttcagctacatatgcatcaacaatggttcagcacggcataaaccaaccaaggtaactcaatgccgattgctcaaagcatacacacatcacacaattcatagcattagcatagatagatagagatacataggtcctgaaacttgttcatccacacagcagcagaaaaaaaaaaaccagggttctaaaattttaagcttcaaacatggagagaccatacacacaggtgctagcactagctaggataaagcaagcaccatgcatgtatggacgcatatgtttaatacaatacggtggtggtattcaggtctttgttcagtttgccacaatggcacaaaagcaaaagcactagctggaagctggaaaccatggatggtggatcacatgaaggtccagttgacgagcatgaaggcgaggcagtgcggcgcgtcgtcgtcgctaagaaccttccacgccaccgcctgctcatacgatgcctgccgccccatgctcgacttgcagacgcctccagggagataggtgaaaccctgaaagaagatagacagaccccaaacaggcttgatcaggaacattgctcatggtctggtagtactctgatggatgcgtcaccgattgtcgcgaggcagggacacggtggttttacctgctgcatgatcttggggaactccgagcacagcgccttccggccctcgtcatccaggatcatctcgagcgagatgtcctggaggttgaccagcgtcgtctcaaggatgtcgaggccggcattgttggcgaaggtgaacataggagcaggctgccagtagataaccaaactgaccattagcaaggtttccagaacatgcatgtgatgaaatgagcataaaattagtgggcagcactactaaccttcagagaacagcacagtattgcgtcgctgtgcttccacaggagcgccaggggagaatcggcatcttcggtatcagaccaacggatatctgctccggtgtgagccctgaaagatccacggaaataactagtgcattaacatcattgatcacaacttcagatgtggcaatgtgtaggtggttctgatgatgaagaacctgagatagacttttgctaaaaataagtattttacttacctatagctcctaccaatccagctagcaagtgtaagcgcctcaggagaggctggagggtgcttcattccgatctggggtccaagtcgagaaggagctattgccacagccaccctctgcacggatgccatcacagctctgacataactcctagccattgccgccacgctctcacgaaggtggttctcgtatgagaattggaaagcaatggtcaggactgatctgttacatgtgccagatgcttcaactgaagcacgcgaagctccacctggtccaacctcaagggcggatgcaaggtcgagcgtgcgtgttgcagatggcccatcctgcaggtttgagtgcataacggttaattggtgagccaacatgggaaagacaaggcctctggaataagattatggaccagtcataccatttttgtatctagtggtatcacacggaatcctgagggtaaaagtggtgcatcatcagcaaaagattcgtcaataggagcaaagacaagctgtgcagatgcactagtagcattctcatcaaccccgctgcaaagctgcatagaaagcaatctctcagaaccaggaaaatgcaacaaacaggtacaacttaaggcaattgtcatgagcaaggattatgtggagaagaatcgggatgaatggggatagattggattatagtagatgaaataacaaggaatacggtcctgaacctaaacggcgcgacgctctccgtcgcactgagaaggcaggccgatgggcactaagataaatcttgatctaatgcctaattgacctgagataggatccctccttatatagatggaggactccttaatctaatcctaacaaaccttatctaatcctaacaaaccctaatcctatccaatggacttaggacgcccggcccaaagcccatgacattactcccccctttttgagcagctcgtcctcgagctgcagcacaccctgctagactaacgaagcaccataacctaaactaagactcttaaaccttttacatctcagcttttattatgaacaaaaataaaaaagggctgcaggaat

SEQ ID NO: 60169 - DNA, 1203 bp, Oryza sativa
ggtatgagcgaggggtagtataacctgactgcccataaacccgctggtctttaagcctggaactgcatatgggctggctcgcaaagaagcagcagaataagcatcaacaccaggatcagcccattcagaacgatgctccctcagaaatcgcacaagtagagcaggaggtacattctacattataaaaaaaatgacattttgtaaagcttaattctttgatttggaacaattttggtcaaagtgaaacaaagatagagacaatctataattagctgagcaactaaatagagcctatgtcaacctgaagtagcattgatgcctttgcgcacaagatgccacctccaacagtagaaaacagagggttcgggctgacatgggatccaacaagcttgtttggagacgagtttactgaaattgtaatgtcctcactaccatcactgctcaacaaagaccacccatcatctggaaatccactaacagcatcattgaaacctctgcaaattagagtatggagttcagatgcgtgagcaatgagacatgcatggaactgtgtcatatgacagtatgccaattggttctaatacatgggaaccctcaaatagctacagacctgctgagcctttgactgaaggtcctgaaaacagcaggctggcgaccagcaccgtaggggatttcaccgcttgactcatgcgcaatttgcctaatgtgtcgcaatgcctgaacagaatgaaccatgtcattggtgataagaaaagttatgcactcacaatcaccatgaggtgaccaagtgctcttcaacaacagaataaaacagtgcacatactgcaatggtcatcttctgtgcaaggatctttggagattcatagagcggtcgaagaacctcaggcacactccaagcctgtaaaatacacaggattaataagatatgtatctcaaaactattcaatattacactagttaatgtgaaaacactattgttacttacatccaaatcaacatgatcaacaatgtaaatcatggagccacctccctcacatggtcgaatcagataaccactgggaagtacctcggctctgataaaattcggagtgttaggcccagatgggccaccagtggactgagtcaatgacctttcacagatctacagaacaggaatggtgtcaaacaatatttaatacaacagaaactacacttcagttgaaa

SEQ ID NO: 60170 - DNA, 17173 bp, Oryza sativa
tcatactatactcaattcttgaattaagttggatcaataaacttcatgtttatatttatgcaacatagatatgatcataagatggatgcgttagtattatataacttcacgatgtcttcaagaacataactataacactaaaacattaatctatgaacaagtttaaccatcatggaacttttcaaatcacccaaacattattctacgagaatatttattcttcttgaatatgccaataaattaattgggtgacatatctaacttttattcattacgcctaagtaaatgtggtgtcatttgatcattcagaatcattcgaatccaaaaggtcattatttatttaggatattatttactacaagtaaaccaatagctttcaaatagctatatgcaatttcatacttcctcgatgaatatgcaattttcaatggccaataaataacacacttcgttgtgtgacaataattcataattatcccaaataagattcgctaatagtttgggctatttttgcttctagcatttgacctataacacaccaatttgcctgccacatatccacaatttcttatgcttctttattgcaaatattctgaaattaatttgcaaaatacacatattcctcccccttttcacgccaatcataagaaaatttacaaaatagttatcgtgaaacccacatatttgttgtaacttcatggtacaacttttctaaaagaaataatgtggttgcgggtggatatatttaagcttcaatgcttaaacataaatattctaattgttcatgtgcataagtaaactttacatgtatgccaatatggcgtcaatgcacttagaactatcaacctacatggttgattgaggcttagtggataataagaatacattcgccaaaaaaacttcaaataataggcaagacaaatatttacgttcaatgttagacatacaattcacaattttattccacaaaaggttaaagaattactacaagtaaaaaaaaggcaatataggtaaggtgagatgacctatataaaaaaaaattcagtaatctaatgcagaagcttctatgactaaagcaaaagataaagatgctctacatgagcttaaccatgttcttcatattgaacttaatctaaactataatgtaactcgtgtattgtaaaatactatctcaaaagaacgaatgcaagattactgtcattactattcgtctccccctgagttgaacatcaaattcaaatataccaaattcctttccttccacaaattttgagtatgcatgttcttcatgaacatattaatagtataagtcatatatgtgcgtgcaaatgcatatgttgacagtaatacaacttcttgtgtatcaattctaacaactaaacatgttgcatctaggtcaaaattgcttcaaatgcaaatgaccaatttattcaaaataatgtacatacatccataaaaacaatacttcatttgtaaagtcatttatacgtagaagatgcacataacattatcaatcaaattaactatagacactgcataggtacatagtcttttgatagataattttggtgcagggcatattggcatatagacttctcgtctatatatttgcaaattcgatgacattgtatctacttggacacaattaatataaattagttgtagcttatcttctatgatagttatgcactaataaatatctctaagtatactctcttcatgaaaagtgtatatatttattctatacggagaatatataattgtgccttctacaaatgtggcgacaattagacaaagagaagatatatgaataattctattactcatttacgcaataaatgtatttgctacatgcaactacttacatgatgtccttctatgcaactttctaccggtttacttctagtaaataaagtgcacaaaacgagtataaaatagtaaataatggttttctatacacaccttttattacaatcctagcaattaacatgattttctactattcaaaggtatgtgtaatttacagaactactaacccacagaacaatcaattaccccaaacaaacaattgctagtaaataaaccataaaatataatgcttccaaaaggggtgctaaaacaaaggtttcacaagttcatggaagctcttttgcctaaaaacaatgtttctaggattgattatggttattcaagaaactaactaaatagttaaagcaaatacttataaatacgggactaaggtataaatccttaattcttctctatttggcgtaaacctaattcatgaaggttcagagtataaatggcgaatgtatattccccgtaatttctaatgtcccataggacttttccgcataatttccgagttccgcataatgccttggaaaccaaggacttttgaaataaaatatcgttttcggacaaaaatcacggttcgtgcccgactccttttaataggccaatttctacttggcccacctccttatactggctagctttaaaacctggccagcccatctcagatgttgcctaatgggctattacgaccttcccccacaagaagtgggtgaggtatgatctaattgtcattcttcaatggagacaacggatggaaccaatggcaaacgtgctagtgagccctcggtagagatggacgactatgggaagttgccatggtcagaggcggagcggcggtgcaacatctagtagcaccgacaccggcattcgttggcatcaggccgtgaccggcgtccgacaatcatagctccatgttacgtgtcgatgaaactcggctcggcatacaggccggcatggcggacggctatcgacggcgggtgctcacggcggcttcgaccctcgtcccggccgcgtgtggtagcacgggaggcatgccgtgcgtaccggtggcgaggggaggcgggcgtaagctcctcggcgtcgctacgggcggcgaccgtcaattgcattgcggatggcctcgaaaggccgtcgagtcgacgtttcagatggcggatcgacgaggaaaagtctctggattgattcggcaaccattgacaaaggggaagacatcatgcggtggcgtccgggtgtcgctacgtacaggcggcggcggcggcgcatgcaggtgccaatgactcggatttgttaccatctacttcatacagataacaatatgacggattattaacatacaagtcacaaccgacacagtgtcccaagcgcgctgatccataagatcggcgatgacaagtgtattaatatattcgtagatcaacgactatgttagccagatagacgacaacttctaggtggtgtcgtgtgttaccgagtgtgaggtgtcgtcgtttgggatagcactccgtcgttcaattaaacggattatgtatgtgcaccttcttgtgtacacggtaagcgcgttcgggcgcgtggtgctgaacttcgtggtcggcaatataacaagagaagagtcggcgcaaaggccggacaaatacatctattcatgcgagaaaataaaacgactagaggcatgatctagcatattaatctcgctgctgctaatttttagaattgattaaatcgataacttatctcgtttaaccgacgtaaagttcgccgatccgcggatgccaatgcatagcgtatcgccgcggatcggcgtgatgacgtccggttgttgaagaatacgatggattggtgaagatcgattggtacgtcactacgtgcatcttgcatgctgatccgtgcatgcattgaacgtagagtggatcacacacccatacgcatgtgctttcttggttcatcggctggttgcaatctgcactagtgcatgtgcatgcgtcggcggcttgtacgcgaagcttgcgcgcgagcggcccaggcgccacatctccgtgcgtgactgcgtggacacagcaatctccggcacgagtgccggacgtgcaggcgcctgaccgcggtgcctcgcgcggcggcgcaggcggtagatcagcaagccgacggcggacatgcaaaacaatagatcaatctgtggttagatacgagatcatatagttgtaccgatacatatgcatatgcattagtgaattgaatttggataggtccatatgcgtgggcatgcatgttttgtgcttggcatatggctgctgcaactgcgatctgcgcatgtgtcagatggcttgggggctccagtgccgacgaccggcggggctgctgctccgggctgcctcggtgcgcggctacgtacagaggccatcgtctcggccgacggcagacacatgtataaacacaatagatcaatctaattattacgaaaacaaattgatctagtaaaaacgcttatcggatcagcggaacgagtgaactcgtgctgataacgtgttaaataactagtggcatattcgctgatccggagtagaaaacgacgatctcatgcacacaatcatatagtaaataaacaatgaacacagatatagagagaggcatcacagctttattgctttcttatatatagatacatcaaccaacctctcaagccctctctctctctcagtatatatacccataataggaagagtcttattagtatacgtttacatatatttggtatgagtctatatttatctctggcagaagataatagtttcgtaacataaacgaacctacgaaagcaatccgtcttcgatacacacggtgcttaatttggataacaggcaaaaagattcaatgatgaccagataacgtcgccgccgaataaattattcaagcgataaaacgaatgcagcagcaataatcactgaatcgttttcctctttaaagaggaccattaggttacagcagtaccatactcctaagtggccatgcttgaaaaaaccgatccccaaaaccgattgggttggaattaatagatagaccttattctatttaaaaattaattttacagaaaatcgaaaaagcccatctcataggataatatgcagagggagtttagtaacacattgcctattttccctgttcgtccacaatcgctcgcgtgctgcgcgccatacctgatcgtccacaatcgctcgcgtgccctcctcggtacatatttaacatgtttcgcatattcgatctgttcatgctttacagtctaatctatatttatagatcgtatgatatgattattctagtttacatatgcaatatcatgattatttatgaaataaattaaatcattatgtgcttataaattcaacatattgatggaccacgcgcattgatagactggttccttttgctttcttgccaccttgttcagctattatgtgttgaatccaagtaagggagcaggtcttctgacaacttgatatgcaccttgggaacttcagaaatgacgacaactacacgagcaacaaaacagagctatacaactctaagaaagaaacgataacaatacattaaaacaacaaaataaaacaacagaaacggattcttgaagttatgaaaaaaaaattaaacaatctaaaccgatcaattaggagctcgtatggccgagaaacgaacatccgaattttaggtgcaattcagttaaagcggatatttccaagttgtttaattattattattattattattattattattattattataccgttatattatgtgtaatgcattatcgctcaaggagagagagaatcgaacgactgcaggtctgcagcagagacccatggatcaaatagctagattaccatggaccaggttcccagagatgatccacggagagaactgagtgagaccctacgcgtcaaccgtaacaagtgggagacaagcgggcctcacacgaatgccacacgaatgcacgcatgcggaacaatgtggcggccacaagggcacacgaacatagccaccaaacgtgcacgcgaagactgcatgaacgactattgtcgtcagtgcaagagaccagggccgacaatggcacgactagcacgatggcaacaccgagagggcaaggagggcgccttgagaacaatgtccctccaggtttctactactaataaggccttgttcaatttgaaagggattgaagagaattggaggggattgataggggaataattccacaccacaataggtgtggaataaatccactacaatccctccctcatggggattaaccaaacaaggccctccagtcttcttcgatcccctccaaaccgaacaagacctaactgggtagtagtataaatacatctgaatcctttgattaaataagatcaatggttcagattagtttctactaccagtaaggaggactgtagtgaggctcataacgtaggaggaacaacttgcatgagaaaggtcaggagattttggcacgatctaaaattaaaatttattgtgcatacagcagttactccctcagttccattttaagtgcagccatgattttccgtgcccaattttaatcgtccatcttatttaatttttttggaaaaataaaaacataactcacgcataaagtattattcgtgttttatcatctaataataataaaaatactaatcatattttttttaaataagacgaataattaaagttgtgcatgaaatctaatatttgcacttaaaatggaattgagggagtagttagcaaagaatttttggaagaagtaattaagtgatgtgatgtgagatgtgagtggaggtggtgcctccagtggtgtcatccgtgtgtaacagcgaggagaaagaggaagtggtgatgatgacttgggggtcgagatgagcaaaggggctgacggtgggcgctgcgacgtggtcatgggcctctagcatctgaaccacgctggccatggacggtcggtcctccggcctgtactgcacgcaccagagggccaccgtgcacatccgctccgccttgtcggcggcggcggcgcctccctgcgcccgcgcccgcgccaccaccgcctccgtctcgccatgctccaggcgctgccacacccaccggggataccactgctcctggctctccataccatgcatgtagcccaggatctcgaacagcaacatgccgtagctgtacacgtcgcacttgtgcgtcaccggcaccggcttccacagctccggcgccgcgtagcccggggtgcccctcccgccgcccgtcatcgtcaggtgcgtcttctccctgtcgcacagcctcgccagcccgaagtcccccaccttgggctccaactcctcgtccaggagtacattgccgggcttgatgtcgtagtggatgatccgccgcgcgcactcgtcgtggaggtaccggatcgccttggcagtcccaacggcgatgcggaacagcttgtggaagccgaggccctgctcctgttcgtcgaggaagaacaggtagcgctccagcgagcccttgggcatgcactcgtacacaagcgccttgaggtcggcgtcgaagcagaagccgtagagcatgacgaggttgacatgcgacgtcctaccgatggtgccgatctccgccatgaactgctcctctgcgcgcctccccatgtcgctaccaaggaccttcacggccactgccagaccgccggggatctgccctttgtacaccaccccgaaacccccggcgccaagcctctccgcgtagtcgccagtcatttcccgcaactgcggcgagctgaacctcacaggccgctccttgatgacgtcaaccgtcgtcgtggtcagcgcggccacagcacggtcgtcgtcgctcctgggcctgggcggctgcgatgccggtaattccggcggcgagaggccgtacttgcgccacatgcgcagcttgcagcacttgtagatgagaatggcaacaacgatgactactatgccgcctgtgatcacggacactgcaaaacgcaaataataatcaaactatctagctagctagctatatgaatcgatcagatcgatcaaaaaggagctagagctagggaatcgatcaaatgatccatggcgcgtaccgatggctacggcgatgttaccaccagatatgacatctgacgacgacgacgacatgtcgatccaactggtcgagttgatggaagcgcccaggtccagccgtggtaaaataaataaatttctggctatgcaattaccacctagtagaaggtagatggtcgcttattgttcatcatatcatctgacttgtagtaattaccaacgagtgattgattagaacaagtcaaaattggctggctggctagctcgacccaccaccgccagaggatatatatatatgatcggtcgtgttcgtctttgaccagccggcctgtaagcaattaattctgattattactagctagtaccaccaattagcaatcaccatctcgtaattaagttaggagtatttggagaagtagtacatcaacaaagactacatgaaattagtattattaattttcagctatagatcattcgattgattaccaagaacgttagggcttattcgttttaaaggattttttcattcataggattaggaaaaatgaaggaatagagatggttgtggagttcaatcctatgggaagctaaacctcaggaattgaaaaaaaacgtgcattcggatacaccacaggagaagtgtaggaaatctgccatttgaaatatatttttttaagtttgcatcaactgacatcggccctcaactagccgttagctttgaagtgcataaatagccctcgttagccttgtgcaccattctcccctgttctttctatttgctcatcaactgtggaagaaacttgctgatcctttgttcttctcttcactatctgcataatttttccagaagctttactcatcgtctagccaccatagctagacgttacttgctcgtgtaacaacaaggtactacttgttcatctggtgcaccaaaattgttttttcctcagcaaaagtcttgatttttagctctcttctatttgagtttacagcatcagtttggtagcatctgcacaccatgaatccaagctaccgacgtatatcagaaagtgatgatgagttcattcattttgttctgcctactttaggagattcatcacaatcatcttgtattaggagaccaatgcacacgtcaaaacttacagggggttgccgtgtacatgagattttaacaggacatgaaagattatgcaaaagaaacttccgtatggaggtcgacatttttcatgcactagtcaataagttacgtgagaaagagtacataactgacacaatatatgtttcagtagaagagcagattgctatattcttatatacagtggcaaaaaatgcaaccaatgaaacacttcaagattggtttcagcatagtccagatacaatacatagatatttcaaagcagtgctggaagcaatcacaaatctcacatctgtctacattcgtgcaccatccctacacccacatccaatcttgaggaaaccacaattttaccccttttttcaggtatggccacttgttaagttgttctgatttcatattttgaatatcctattttttcatgaactggacaaaaataactttgacatgtcttgtgtagaattgtattggtgctatagatggtactcatatccctatgaaacttccattggatgagcaagagccatatagaaataggaagcaatcaatctctcaaaattgtatggttgcttgtgattttgatttgaagtttgtgcatatacatcctggatgggagggatcagcttcagatgcaagagttttacatgatgcacttaatcatggttttcaagttcctggtggtaaattttatctcgtagatgctggttatgcaaatacaccgcaatttctagctccatgtgattgaaatatcagcttcaacattactgactccttgtgattgtgaacgatggccttgttgctcatagttccgacgattagacatctgtaataaatcataaatagtacagggaggataaaacagaacaaaaattaaagttggatgctattaaaaaattatgaactgataactgatgtgctcattctgctcatcaagatgctagctaagtagctagaagaaggaccttaattttacatgcataaacatatacagaatatggatgaaagaaccatatcatccaatcgtcaccgttaggtgattcatcaaacacaaaccacaaatacagggttagctcgcctactacttgttgctgctcatcgccgccgcccgccggcaacaacttctctgaaccaaacaagattgccattgggcagacactatgaacccttgtgtgttacagctacgaccccatccgcagcgacccaaatgctaaggtgtatgcaaggaagcagcagggggcatcagatctatgcataacaacggaagaggaggcaccaaacctgcaatcaaagcgtccttgccgatctctgccgtggctcttcccgttgttgccgttgcgtcctgtcacctgggcggcgaaggtgcatccggtgccggcgatcgatgtgggagaggaggtccagtacccaatcgtggagacaggagaggaagtggtagaggagatgggatcaaaggcgatggcttctatgcgagtctgtttgcctcctgtgatttttttttattttcctttcagcggtacctaccttttttgtcgtgagagcgaaaagattacgcgcgcagtgcgctcgtggcgcgctcttttcgcgccaggaaaatttccaagaggtcgtactggatgcaaaaattcctgtgttttaccgatacagctggcacaaaaggaaatttcccttcaaatttcctatagctcaatcctgtaaaccgaatgctgtatacaggattcaaatcctctgttttggaaatcctttggttttccttagaaacaaataagcccttaattctacaaagataaggatatgatatatgctgatgcaggactacggccacacctcatctcttcttcacataagaaaaactgtgattgtgattatgaatacgaggacgtgcttctggttccggcggcccttcggcaaagcggagatgagacctgggaagaggagttggctgagttcggtggtgggtgttggacccatcacccacacacgaaaaatgaagcagtctattagcgcgtgattaataaagtattagctattttttaaaatatagatcaatatgatttttttagccactttggtatatttttttttaaaaaaacaccgtttactagtttaaaaagcgttcatgtgtaaaacaagagggagttggaaatggctggtatcgaacacagcctaagaggactaaaggaggtctctgcggtgccgtgggaggtggtggtgtggtttgccgctgctccggtcgatagggagggggcggctgagttcgccggtgtggtggagagagaggaagacgtgaggagatgaggggagaccaagggagcacgggcagtggtaagaggtaaggggagaggagatgctgccgccattttataggcctggaagagtggaacggctggaggagaggaggggaacagccggagagcttgccggcccggccatcaatggcagcggttgaccggagattaaattcgacgattaaaggccgaatcaagaaggggaaacatggggtaattgatgatgaggaggagaggaaccgatttttgcattcaaatggaaaagaaatcaaccggggagtgagatcggcatgccggcggcggtagggttcggccaggagaagaacgggcggcagctcggctggaggagggagacgacccgcggctgggccgcgtggtgctgagatgggccacggggagatacgtcccaagaggaaggaggtgaggtgaccatcgggaggacataaaacgcacttcagtacgtgggagaggaaggggaattaggccgaggtggctgactggctgcagcccaagagggagagagaggcccgggagggagaggtagaggaagagggagggaatagaagaggactccatcggcgggccgaaagaggaggagagctctttgggccggattcggtcaaaagagagggagaggattatttttagttttctcatttcgttttagctacatgtctgtcatgtgattttttcttagagcattgagaatttaataaaaataatccaaagctcaaattaatttttttcttggatgtattttagtgtttgagttttcttttaagcttttaataatttctattattccttttaggaagtgatttttaatatgggatggatttatcagggcgtgacacccgagacatgatgacaatcggcttggactcagactctgcaagtccgaccggtcacatgccaccagtcagaccaaccctatgtgctagttacactgtcccataggcggtgatcagaccggccccatgaaggaaatctgtcgctttccaaattttggcaatgctctaactttaggtgctaaatttggttgagggaggagccctaggccagccaccacctgccacctctgttgccactccaccgatgcttgagtgagcttgagctcgccggttggcccccgctggaggaaagggctgcacagaaggaatgaagaaaggatgaatttttttttagataatggaatatattatctcggcctttgctcaaagagagctacagacaattattataaggaagtgctcgagaaaagagtgtagatctaaacaactagaacacaccaaacaaggataaaggaaaaccaaaactgacataaggagaacatatttattgtagtctatttgtgaatctccatccatagttggcaaaaaagttgcataatcgtagtctccaacttgcaacatgtaacttttagtaactctccatcttcatcacatctttctaactgtgccctgaaaatgacctgcatataggaaattgacggtgatttatcaaataccatatcattcctacttagacatattgcccaacaaatggcagaagcttccacaagtatcagtttactctttttcttgtcaacacccaaaagccacccatcaaaaatatgagatatgctagaaggaaggttaaaaccaaaagagaactgaactgctctccatatgaacttcgcgaaatggcaatccataaaaagatgttgaatagactcattgttcatacaaaaagaacatctcaagctaccattccaattccgcttcgccaaattatccttagtcaacacaactcctttaagcaagtaccacatgaaaaacttaatcttaagtggcatcttaagcttccaaatgcacttattcctttcaacatagccattattacttaaaagcaaggtatattgaccttaccgagaacataccattctaatgaaaattccatctaaagctatccgaagaaaaattcaactggatatgtacaattgaagcacaaaactcatgccaataagcaagattctggcaaactaaagctcttctaaaagaaacattaagcgaaacagaacccatgatggtggcaatagaagacgacttccttcagacaatagcgtataaagatggatatttatccttgaaggccaagttgcctaaccatttatcctcccaaaacctaatttgtttcccatcattgacaatccaggaacccatatttaagaaagtacttttaacattcataagtccaaaccaaaaatgggagtcaccctgtttcttttcaacctgagttatagacttattataaagatattttctcttcaataagtcttgccaaaccccttcctcattaattagcttaaaaaaccatttacttaaaagacatttattatgaatttccaaattatgaatcccaagaaccccttggtccttgggttggcaatatcccatctcgtgagcctgtactttttcttgtgatcatcctcttgccaaaagaacctcgatctataataatcaattttcgaagaacctcttttggtatctcaaaaaaaatatcattaacatgggtaaactcaaaagtacagaattaatcaaaaccaatctaccaccaacagacagatgcttgcctttccaactactaagctttttctcaattctttcttcaatacctttccgatctttattagaaagcttcctaaaatgcattggaattcctagatatttgacaggaaaagaacctaatttacaaccaaagatattagaatattgatcataacattccttcgcctagccaaaacaaaataattcactcttgtgaaaatttatttttaagccagataacttttcaaatacagatagaatcaatttcagattctttacctgttgcaaatcatgctccaaaaagataatggtatcatcagcatattgcaagatagacaaatcatcatcaacaaggtgaggaattaccccattcaaaagttccgcctctttagccatcttaattaataaagcaagcatatcagctacaataataaaaagaataggagataaaggatcccctgcctaagacctttgtaagtttgaaaattattaccaatttgatcattaacttttataccaacatggccaccttgaataaaagacgctatctactcacactatttaggagagaagcctttcattcttaatgtttgttgtacaaaaggccatttaactttgtcataagccttttcaaaatcaatcttataagcgaatagcatgctatagctctgtttaggtagcttgatattttgagagatagctaacgagtagttagctggtccgaatatgaaaatactccctcccatttttttcgtttgacgttccagttcatactcaaaagggtttatttgtttgacgctcgcagttcagaagccctcctcccgtacgcaaatttcccctcttcccccctgcatggatgaaacgtatcagtgcaaagggataagggtgaaggcaaacaagtcaattcacagcttccttaatttaatcgaaccggtcggcaacgtcaaacaaaaaaaactagagggagtactaagttttctagcttttgacttttattttatttgatggattttctaactactaaccggtagaatctagttaaaaatctagactatttacggaagctaaagattttgagagctatagctattaaaaacttataaaaatgagtcatgtatatattcattaaggctagctacgcttgtcataggaaatgatatacctggattacaaagacatatttcagtgcctactataaatataagagtaaatagtacattgatctacctatgctacgaaggtttcaccttggaccatcacaagaaaattttcagtttgggctaggtataatatcttttgttgcacgttggatcatttgaaccctccatctctcactttcttcttcccatgccatgcttggctagtggacaatatccggaccaattctagatggtattggaggtgtcactactggagaactaatctttacacggatgacgaaaattacatcagtcccagatcgaataggaaccgagttcaaatacccagcggtactttttgatctttagtttgggttggaatcagttttagtcccttttcaatagctgtcaggccatgtgaggtccccaacgaacattagttccggttggtatcaccaaccaggactaaagatcatatctttaatcctgattggtgataccaaccaaggctaaatatcactctcctacatccttcttgtccttatctaccacggattactctccctccaccgcacgtctctttctcgcctctctctctctgtctctctctcgctcactctctctcgacttgctctctgctgtctctctctccccatctctaagttctctctctcgctccctctccctccaccgcaccacccggcgacggcggtgggaggggataagatggtggcggacctacggcttaaggtggcggcggcgccctcccttcccctgtccgtctctctctttctctcagctatctctctctctcgctccctctccctccaccgcaccacctgacgacggcggtgggaggggaggagatggcggggtacctacactatggaaggtgtgtcttgttagtgatttctcctgcgtgtagttctctttttatgaggaaacttagtgtagtttgccctgttagtgctctaaggggttgtttggttgctgccctgagcaacatgcctgaaatttctgtgcgcctgagtggcatgcgagaagacaatgcatctagcctggtcaggtagcctgagtatatgcttgtttggttgtttgttgctgcctgagaaacaaatatgcaattacgcctttaattattatacagctaaatcaattattaatggccgtcacaaatcttgccacaaattgcatctaaacctcctgccaagatccatttatgaacccaacttcccatgtacaagcacaaatcttgcatacataacgaggataaaaatctagaaaaaaaagcagggaaaaaaagagagaggagaacgcaatcgaagagtcaaatagatcccaaatccgtgcatcaggagcacaaccttcagatgattctgcccagatgtgcaaatgcatctggcaacctgcaaatcgatctgcttactattttgcacgaaaggcagcctgggcagcatctagcatgggcggtgctgctatgctgggatccggcaagacggcgacagcttcacccgccggcgggagcaacacagcttcgcagggatccggcaaaacggcggtggcttcgcacgccagcgagagtagcacagcttcgcagggattacaaaagacggcgggcggcggcggcttcgcaaggatccggcaagatggcggtcggcggcggcttcgcggaagcagcgcagcttcgctcctggaatctacgtcgcgtggccgctttggataaagattaggatggtaagtatgtatcgctgttgctgcctggagctcaggcgatcgatttcggtcgcctagctcacgctaatgacgggaagggctgcgtcagggcaggcgaagggtttggaatctaagggcaccaaccaaacaagacctgtgttagtctcaggctggctttaggtcaggcaatttctctcagggtagcaaccaaacagcccctaaatctcacattcttatcaagattgtgtggatcttagcattaaaaatttgcactatattccaaaatcgttccaatagtcacctcatgcgtatgacatggccgctgtcttatgtcgtctcgttcaaataaaatctcgaa

SEQ ID NO: 60171 - DNA, 1483 bp, Oryza sativa
aaattgtaagaaaaaagaatctttcctctttttttgtctttacagaatggccatgtggatgtggtggccccgggaacaggaatgctggacactgccaaaatgttgccgtgcggactcatcacccacaaactatcaaattaaatacgctttccacaagaaaaaggaaaagaaaagaaaaaaaaaaccctatgaaagtacgcacgcatttgtgtcataaatggactcatgcgtctcagtcacacacatctcgatgccatggcgcctgcaagcgaccggaatggccacgaaggccgccgccgcgtgctgctgctcccgctgccataccacggccacatcaaccccatgctccgcctcgccgccgcgctgcacgaccgcggcctcgccgtcaccgtcgtccacacggagacgcgcgcgcccgaccgccggagcctccccgccgggtgcgagctggtgaccgtgccggacggcctcccgccggagctggccgcgtccggcgacatcccgtcgttcgtgttcgcgctgaacaggaactgcgcggcgccgttccgtgacctcctcgccggcgcgctccggcaggaggaggaggaggaggacggcggcggcgtcgcgtgcgtggtcgccgacgtcgactggttcgcgccgctcgccgcggcgagggagctcggcgtgccggcgctggcgctgatgaccagcagcgcggcgaggttcagggtgtacctggcgtaccctcggctgtgtgaaaagggatatttacctgtccaaggtaattaacactatattattctataaatttgattaaacttaaataagttgtttacaatatgaaatggaaggagtaataattatgtctcttgttgtttacattttaaaagcattacttttttttattttcatgcactgacaatatattatgtaaagatgcactgatagataggagtaatacgctattttgcatcatgccgcactatcaatataaagttatgaacgaactattctaaatgtagtgctcttttgtctggggttcacatcccctgcctttgggcataacaacaaaggccctgtttagtatcaacgcagaaactttttaccctatcacatcaaatatttaacacatgcatgaagtattaaatatagaaaaaaactaattacacaaattgtgtgtaaattgcgagacaaatattttaagtttaattgcgtcatgatttgacaatgtggtgttacagtaatcatttgctaatgacagattaattagacataataaattcgtctcgcagtttacagataaaatctgcaatttattttgttattagactacgtttaatactttaattgtgtattcatgtatatgcgatgtgacacaccaaaactttccacccctataataaacagtgccaaagtttaccgttcgtcaatcacaagcgtccattaattccacacctacggtgaatataaaaattcagggttgatagagtgcagatggtca

SEQ ID NO: 60172 - DNA, 7834 bp, Oryza sativa
  unsure (1)..(7834): unsure at all n locations
ccataaggttctagcccatgttaaatcttctatctatctatctatctatctatctatctatctatctatctatctatctatctattatatactaaaagttaaataaacttcctaaaaatactcccaaaccaccacgtggcactgtacaacgctaatacgccgccacgtggcactctattaaattagagatattataaaaaaaagtaaaatatttaaccattggttttgatttaatctgatggatccattattttcaaccgttagatatagcttaaaaaaccaacaatatttatatttaaaaaaccacagctcccgtacatcgatacatgtacgtgcatatacgtacatattttgtacgtgggccccatgcccctcttttttttcgttttcactaacataaaaaaacaaaattcataatttccagcccatatagttcttaggagtacataggagtatgtacttctcacgcagtgccccacgtccatccttttgttttatttttccttttttcactcacacgagataaaaaccatattaatagtctttcgtttttcctttttttactcacatgagataaaaaccacattaatagttccagctcatagttgcacaaatataagtttttttcagttgtattgtactaaactcacgtcatcgaaatatccataatctaaataaaatgaataatatacattatataattatataattgtatatcacttaataacatgttttgttgaattcgatttgtattttcaaaaacaaaacaactccagttgtgagtaatattcaaaaaaatactcactccttactatgaaaaaaactgttatatcaaaataatattactaaatttgtcatgaatgtattttcatgtattataatttttttatatatattattagaaattaacggtcaagtatgttcttttgatatcgtgtccatgtcttctatgtcctacttaggcttcgtcattaagtgagcttatccaggcacacgaagtgatacagattattaccatacgattaattgagtattaaatattacaaaactaaaaatgaatttattttttaaaaaacaacttttatatatataaaggatttgaataacatgcaccttgtaatgcagcatttagccgctcgagaaatgtgctcgctacaaataagggagtatctaatcctatatacacgttagaacgcgctcttaaatttattacttcgataataaaacacatattatgtagtttagaatatacttggtcaatcctagcctaaaatatcaattgtatgtcctgatgatccctatgtttgtaagttttatatataagccactatccactaatcgccaagtcatatttcatattacttatgaggtatctatctaataagcacgtgtgttatcaagcacaaatataaagggcaatactaagtgcataacggtcaacaaatgatactccctccatcccataatataagacatggacgcatttcaagattcaaactttaaaacatttgaccaacacttagtataatataaaataaattttattagttaaaaattatatcattagattgagatttaaatttacattcatatggttataattttgttgctacaaatcttatagtatatgagaaattataagttaaaaattagttttggagactgtgccaactttgaccacaccttatattatgggatagagggagtagttaaatagaggacgcaaccaatccaccgcaaataatagttgactataaatagattgcggctatgagtaatagtgttcctacactcatataaacgcttataagatgtcacatgaccctctaataagagagaatataagaaataaaataataaaaggcaaaacatctatccatcgatttacactcaaaatcggtgatccattattttcaacaaataaattagatctatgacagtagttcctctatcctaaaggctgtctaatcttcccttacatacatacacaactcctatgtacatgcgtatgcaacgtatataaaaagaaaaaaaaggagtgtggatatgatatgtcccatttggtagttttctttttcttaccagctataaggtttttcccaaattgagcatacgcgtagcgaccactccaagcgaggtggtaaaagaagccacgccatggcgccgcctcacgccacccgttgctcaccctcttgccatcaatttttttgaagtattcttttgtaccaatgatgtaaaaggctcacatgagctcttataaatgcatgcgtacgcacactatgaatacacatacgtacaccctgtctctatgatagataaaattcattaaaagaaaatgaaaaaacaaacatacgagagaatactattcggaaaaaaacatacacttaactacattatatccccgttttaaacgtcattgttattcaaattgtgttaacaattagcacaaatagttttgacaaattccatcgaatattaatcaccgtgaacaaagcatacgtgaattaaatgtgtaaacaagaaaaaaaaatcaaaacctatattaactcgtatgttagcaaaggatcacaatttgagaaaaaaaaattttacgtggtcgtcaccattgaagctattagttttttttaagtagagtggaatgatcaaccatgaaaacttttaaaagagaaaattatttctgtactatcgattaacacttgaaacaaattatatctactctatacaacaagtcaacccaagatataagaaaaactattttcatcacctccatctttattcactcatatcctaaagggcaacaagcatgaatcttaattggccacgttgaaataacaatgacaggagtatgcattgttaagttgaggtggtccgagtaaaaggttataattgttgacaatagagctcaattgacctacatacaaatacaatcctttataaaattatacttcacacttttcgtgatgagcacgactatatcaatacgggacccataagtcaaggcatccaaggaaaaagccttagtggctacaattggcttcacccagctattagaggggcattcatatacgattttatcctattaattggtagaagcagaatttttaaatatttatatatagatttggatatctatgagacatgggtatgaagtagagctgaagttttttggtattaatgacgcatttggttttttataggtacagatgtaataatatctattaaaaagacatccaaattttctgacaatatcgtttagtgtatcaactgttagcatctattgtctactctctccattcgaaaaaactcacttcttccatattcaaacccacaagtgggttcccacattcaaacccaaaagttggtgttgtagtgaatatggtgagatagggcttcttttaatattatttttataaacagtaaataaattgcccgtgcacatgcgcaggctttcttcctagtttcttttaaaacttgcatgaagtgaggcattctatagaaatttcacacatttccatagaaatttcactatgtaaaagaacaaattaaactatagctagttatcatatatttatatttatatttgttatttgtgtacctgcatgtttacatagtgatctatctgatattattttattttgtcaattttttttattttttataattatctaagtgaggtacaagaaatgagaggatatcctcttgatgaatgaaaccacttttcattcaatactgactacataatgcaatcgtatatgttgttcagagtcaaatctggacatgccagtggacaagcatccgccgttgttggtgcgagacctccacatcatgatggacacgtctcggcacgtcgcctacgccagcctgctcgcccacatcgtcgccggtgtccgccaatcctctggtctaatcctcaacaccttcaacgccatcgagcgcaccgacgtcgagcagatccggcgcgacaccgccatcccagtgttccccgttggccccctccacatgctctcgccaccagcgacggtggcgacgcagaaaagcagcctgctcctcgaggaccgcagctgcctggaatggctgaacacgcagctcccaggctccgtgctgttcgtcagcttcggcaccctcgtctccattgacgccgacgagctcttggaggtggcttggggcctcgctgccagcaaccggccgttcctgtgggtggtccggccaaggctggtccgtgggcgcgactccgtcgagctccccagcgagctgctcgaggagacacgtggcagagggaggatcatcaggtgggcaccacaagaggaggtcctgagccaccccgctataggcgcgtttttgacacactgtgggtggaactcgacgctggagagcatatccaggaccgtgccgatgatatgcaagccatgtggcggtgaccagttagggacggcgaggtatgtatgtgacatgtggaaggtgggtgttagggttgaggtcgaggataagctgaccagagggggaatacaggcagcgattgagaggttgatggatgggatagagggtggagtagttagagataggatgagagagatgggtgatgtcgtgtcaaaatgcactacgaaaggtggttcttctgatttagccctacaggacttggttgactttatcaagtcgtcctagaaattatttctagcattaaaattttagtgaacatttttctgcgacaattattcttatgaatttatcgcatttggtaattggcacatgaaaatgtcttacacaccacttgtattaagctcagcccaaggatttggaacctcatctagaaacatttcacatcaaatagttatatttccctgaaatttgaccttttagcacttaccctcgtatacaactctgttcgatcaggatattcaaataaattatattttaaccttcatatacatacatacatacatacatatgggatacccatatgggactccatggtgcccgggctccaaagtataaaacacacaaaatctctcaaattttttttaaaaatttaaattgtgagtataaacccaggtatatgaatttgattcataccaatacctaacaacaaaataaattagactcaactttatttcacaattcattattacatacctagcgaattatatgtttggatgttatatacctagaaccaaaatctaacaaaaaaaaagttcaaactcagttcaaatttgtttgaacttggtagtcaagaagttaatgttcatacctaaacattttaaaaaaattcatactcattcaaattggatatatactcaatttgaatcttggagcccatactccatgtagcaccagttaatttacccatatagatatacatatatatacatatactagcaaaatgctcgtgcgttgcaccagatgtggctgaagtttgatctcaattatttatcgaagcacccgagcatgatcatcggcattgacgatgtgtataatgacaaaaagtcatgtttgttcttggacaattaatctactttatattttacgggatgtggatgatgctcgtgacacgacgcgtgatggatgtagcatatgggaggaacgaatgggcgaacagtgtgattgcctttgtgcaggagataaagatagaaatttgtgtgatgaacagaaaatcaatattttaaagtagataaacctaataaaaaaataaaattaaaattaaaataattaaaaaagattatctaaaataaataataaataaaaaaaataaaataatagatgtttccgttgtcagtataaaactaaaaaaatggcgagaataaaattctatcgtaacaaaaaaggaaagaaaaaaattctgtcgtaaaaaaaaaggaaagaaacgtctgactccctggaaaacaggacttctcgtccgtaaacaaaaaataaaaaaacgtccgactcaaagtctgtaaaaaaaagaacatccgctccaaaatctatacaaaataaaatgtctacatatacattttcttctctaattaattgcaaaaatagattctctagtccttcctaatccttttcccacctaatttcaaataaaaactgacatatatgcaccgttttcttaaaaaaataatttataatagttttttttaacggcccataagagcaagtttaatagtatagcccactactagctccaaattatctatagccaatgtaatagccaattcatacaatagttgcttactatactattaatacctgtcccacctgtcatacacacattacgtcttggagtccgtgatgcagctggctacatatctgtagtctgctgcttttctctctcttcctttatctctttaaaatatgtttatagctagcttatagcctactattgtacttgctctctcttcctttatctctttaaaatatgtttatagctagcttatagcctactattgtacttgctctaagagcggagagagagcggcgtgcccaactgcccacgcacctcgattctttcgcccgtccttatctcttcatttgttttcccgatctctttcctccgcctcgcctccgcctctttcttgctcgcccttctctccttcgtttccctctttcctttccctccttttctccttctctcagccggccacgccctccatctccgcccctccccctccccctccccggctccccccacggcagcgtggcttcctctccgtcgctccccgtaccccttagtccatatgatgtttgtttgtttgttcgtacaaatctgatgctattttttctcttttcctccttttgtgtcagtcggtcaggcaacgggcaacggctgcgcggctaggtggaggcacggcagggagacgacgaggatgaggccgtgcggcggtggtggctcggtgcgatgtggaggccgggacactggcgcggccatgcggtggtaggggcaggtcgtgaatgtgcggtggtcggagatcaccattggcgttgcctccccctcctcttgatgtatccatggcaacccctaacctgcttcttgtcgctatctccacatagaggtagtggcaatggcaacggaggaagggagccaggctttagcggtttgtagatgatgacgcaatgacgatggtgtctctcaagcggtggctggaggtagaacaaatttttggattttgctgtttatcttctgatcttgcttttcgttatgcatctgatttggttgtatggaagctgtgaaacactgattttgaaaagtgcctgtctaagattggattcatacgaggattctgttgttatgacttggttttcttaatccgattctgaggatgaaaaagagtttaggaggagcgacgggtgatcgcggctgaagtgacgaacgaaaaacggatgaaacgggaaagtgacgaacggaaaaatatgaatcttttaattagttaagattaagatatgaaaatgattctgtaccctcaagagtacgtactcccggttccatctaccgtccatcgctgcaagcctcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60173 - DNA, 4950 bp, Oryza sativa
tattgttttcatcaggcacaatgtcaagtaaggtcacatttcagatagttcacgatgaaggaaatattagatttggtccagatggtgttgatctgtcagattttgtaatgacatctaagggcatcgataggcctgcggagagaacatttcagtcaatttatagttggttgttgagaggatttagaatagaccaagaagtatacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtagaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccttgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcagtgtgatctgctcggccatacttacaagaaatgcccgaagaatgcagaagttccaagcggcgcagatgctagtccatctggacaggcaagtgatggtaggcgaccacctggtgaaggaacaacaagcaggcgcgcaagaccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaagaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttatagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacggg

SEQ ID NO: 60174 - DNA, 1613 bp, Oryza sativa
tacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcaagccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatattttctttcccactagcacacaacacacgaaaatggaagcctattcattggtaatacgtaatctagatttgagattatgtagaacattttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcgccctagcggagggcggcaagggggccgcctgcaaaattccatgccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccctccagagggcggtaggcgactacttccgtcaat

SEQ ID NO: 60175 - DNA, 19705 bp, Oryza sativa
  unsure (1)..(19705): unsure at all n locations
ccggcgccgtgttcctctccctcacgccaccggtcgccgctaagaaatcaaaccgacaccgctgccgtgctcctcttcttcttctcctctgaaaccgcctccacaaccgccatcggcaaccgcctttcatcgcctatataagagatcgaacccccctttgtttatcccacacaaaccgagcttttctctctctctccgggccatgttaggccatggccaccatcgatcgatctccatccctagagcatcccaaaccaagcccttgcgccatcgggtttgcctcgacgaggcgaactcattttcctagtttccccttcctttccccttccgaaaccaaccatcacagtcacctcctcttgttaccggagcaagctcttgccgccgccgttccggtcacctccctaacgctatgtaccggaaactaccctccctgagtacgcgttgcttgggaacacgtgttgccgccggtgtcacagtctttcatccaccggagagccggcgcccctcctctcccttctctctgtttgttcgtgatgaaagagagaagaagcaagaggaaggaggaattagaagaagaagagacatatgacaagtgggccccctacacagtaacttttctcttttatttgattttaattcaatttcgatctttagacacccatatctttccaaccacaaatccaatcccagtgagactttgacctaaattcatataatttcaaactcttcgttttgataccaaatttcctattcttttaaaaaaatttatttaaaattctttataaaaaaacacttttccttatttatttatttactttctaattttaaattattttaattagcctttaaaaattattttactttacatccctttaattttaaatttattattttatttaaaaacctttttaaattttagttatccttcaatttctttaaatacccttttctttatttcttttaaaataccattttaagttttatttctttaatctatttaaaacctctttttgaattcaaatccctttgatttatttattccctttttatttctaaaaccttcaactatttcatcccttagctaccaaatagtcgccgtgggaacgttacgccttccatggagacgttcgcgtggtctcaaaccccgacgtcaaaccgttggtcataaaacccggcataacctaatcctaaggtcgaagtgtctctcttcgcaccccacgcctcgacgtgtatagtggtcggagcctcactactccctcgacctccacagcacgccgcacactagctttcaggctctgtgcgattcaaaccgctctgctgccactcacggctgtagagtaacactattccaccccgcaaacctacacaaacttcccaactctctagccgttgtgctgcttaactgtagcatcgactagacgagccaataattagctgttatgccttagcatcggctaaccaactccaaatatctagccgtcgtgctaccctaccctagcaccgactagaaaccaatccaccaaataaaccccacctctccattttatcctttcctcaattttattcgattaccaacctatagaaaccaccacctctcttttattttcaacctaaaatttattttgaacccattccctttttcctctcgcctcgctccaattttatttattccttgactttatcgtttctttgtagcaatttgcttataggctttatttgctatcttttcgtattcgtacgttagccgtacagcaagttttatcagcatccaaggagctgacgtggacccagatggctacgctaaagccacgggaaatcttaaggcgcaaggcaagacataactaaaattttgatcatatagaaaccttgatataatcttcatatttaaatttgatgcatgatatttgctcttttaacatctcgtgggtaaatgttaaaagcttttaagcatgatttcatgatattattgaaagatgcattggacatcactttatgtggtttattattcaaacatctttacaaacttaagaatccggttaaaatgggcatttatgaattgagattgtgaatattgtgattataaatgttcataaattatgaagatggtgtggggagtttggaaagttttgggtggtttaaccggattattattacccccttataccatggaaatgacatagttgggtccatccacaccatcaagtaattggacttagcctagtatattgtccccctatatgaaagactgttgggtggtttatgaacggtattggggtgaacttgcgtaaggagtttggcggcagtgttttataacagtgggattcatgaaaagtgtgacgaataatagaatacccttgcccctaggcctggcaaagagtttcgacccactatgaatganacccaangaccccactgtgcagtaactagtagtaagtgggaccttcgaacggctctgttgttctcagcgtagctatctgtgggcatcgtgtgggtaaagctggacagtctctgcagaggtgaataaatcattcgaatgtgtcgtactcccgattctggagttgtgtcattagggtgattcctactcctgaagtataagtatttttaaaattaaaatgttgaggataaatatgttttatggtttttattattcctttactttattattgtttatttattcatatctattcacctttaattatttataatatgtcttgctgagtatataagtactcacccttgcataatttgacatatagaggaaacgtgctaacaaggagatcagaaggaagcgagatctacgacaacgactagtttttctaggctagtctacactcgagcttttgcctgtggagttctttgaaattctttggaatttattaattgtagttctattagttgaagaagtttaggagtttagtactttggattttcttgtatttcaaataaggatattttagtttggatcttttcaccttttaacagtagtataattagcttgtatgaacaaacctgtgtaaataatcgaaagttgttctgtatatcaatctgtacgtgattgaaatcctagacgatcacgagtggattttgggggaaccaagcctaaattgggtgtccccacaatatatcaccaccatagcatacatatatgggcctccacatgaagttggggatacaaatggaccgaattccattaatccagtgcctatgataggggatttttgtgatatgctattagataaagatggaatatcgacattagggggagaaaagcccatgtgttaaagatgccttatattttcaagaagaaaaagatctttataagtaagaataacgcacaaaccaaactaaactcgaaggtttagtttattctcctgtaagccagaagcgggagcttgccagataattatgaattaaaggagtaatcagaagttatgtttacttgtagtaaactttctgctaccagtggtataccccgggttttgaatagtatatccacaaatgcagagtgacatgttagtcaatgttctaaaatctacggggatgcatgcggattctaagatctaacgactattgttaatgtacccattaataactccttacaactcttgtagagtaatcaccatgaaggtgaattgcctcatgaagaggttcatcatgaagatgaaaacccggaattaaagtgcacacatctatctaattctgggatgcggacaaccatacatcttatgtttgggaaatgactaagatatggtttataatgaattaacctcaaggaatgagtatgtggagaaaagaatagttgtcgacaacatcgcttctatgattgctaatatttctctaattaatgagaatccggatccggaaccaaagtccatggtagagttgcatagtagcactcatattgggtctattgaagaaagcaatgagattgaaccatagtcgctaaataagtctatgtgaacatggaagtttagacttaataggaaatgaagtggtgaaaagcgacgattcatttggtcatggaaaagactgatattctcctgctataaatgtattaaattccgctatatatatcgctggcaaaaggcatgaataaataaatgatatgcagtttatacataccgcatatgtgtatcgttgcaacttattttcccataatcctccgtaaggattaaactttgtttgtattgcacatttgaataagtggttatacatattgctcctatacgttgatttatttctcatgttcatagtagaacttatgaaataagtaaacgaaagattaaacattgtggtaattttattatcattgttttacacattaataaaaatgtggttatgacattggaacatggaagtttcaacggatgtcttattgagggggagcatatatgctaaacattgattatcatacttaagacttggaagtcttaaatttgatttaccaagaattaatcaaattaatcattgttttgataatttaccttgaaggttactaccgctatattgttgtgttaatccaagttgattaatataataaagcatatagatcattagctatttataaagaataatcgatcttaaagattatgcgatcaagaaaatcgtgtgttgtactttttttcccttagtgagtttttacttgaatatttctcacgcaaggttttttaacgaggcaacaagtgcaatataattagcgtggatgatgtactcttttctcctatcctttcctcccactgggtttttgaatggagtttttaatgagatatgtgtatagcgcggtattcgcccagggggagtgttatgaaactattatcttctgccagagataaatataggctcataccaaatatatagaaacgtatcctaacaggactcttcctattatgggtatatatacagagagagagagggcttgagaggttggttgatgtatacacatatgagaaatcaataaagttgtgatgcctctccctatatccatgttcattgtttatctactatatgattgtgtgcatgagatcatcgttttctactccgatcagcgaatagaccactggttatttaacactttaattctgctgttgctatatttttgcctccgacgttgctgaccgatctgatctagccgatcgaatccgatcgcgctagtacgtgataaacgaattgactagaggaatagaaaaaccaatcagaggcaatatcctttcgatctactacacatggttacctagtaaaaaataaatcaaagcagattcaattgcatcggctgttctgggaagctttagattaattctcaattttttgctaagtccacatggttgattaccaaaagaccaaacattcctggccatcgtttcgctgtggaataagcgaaatgacatatttgcaaacgaaaagtaatttttaaataaaacttttatatacgtcttcttagcgatctaaaagcaaacgctgaaaaataaacttcgataaaaaaaaactttaaaatcagctctaaatttaatattgaaaatttaaattttagttgataagcataagcataagcgaaaagatgaccccattattgctaggtgcacttgccgattataataagtaactcaaaaccgtatattaatatatttggttaattaaaatattccgactatgattcctatactctcctctctttactgagaaacgcgaactaaaaaaagtgaaataggggtaccccataggtatttgatcttgcttcctgccccccttttttcatggaaaaaggaaagatgaatttctccattcattgaaccctagttcgggactgacggggctcgaacccacagcttccgccttgacagggcggtgctctgaccaattgaactacaatccccgcggggcgtatggcatacttattcttaaatggaaccataagaataagaatattcgcctgtcctactctaagaaatagacgaatcatatactacatactttagggataatttttttcgctatcttcttccaagaaccacctaaggttccgactaaaaaagtgaaataatttaattgaagtaagaagtctccccgggagacttcttacttcaattagtcctcgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaatttatggctacacaaaccgttgaagatagttctagacctggaccaagacaaactcgcgtaggtaatttattgaaacccttgaattcggaatatgggaaagtagctccgggttgggggactactccttttatgggggtctgcatcaaccatgataagcaagaacgtgatcgataacaatctcaccaaggaggacttgaccgaggaggagcggcaagactttgaagagcaaatggtggcgttgaagaagacaacgcttgcacactatgccaagatcaatcaagacatctccaaaaagagatatcctgctacctcatgtcatagtttcacacaagataacctccgatccacccgatctaccctatgctattaaaaaatcaattgatcgttgtatagatatatctattagtcttatatctataaatttgatgatacgttagaagatgcttttaatagtagatatgatgacattgttaagaaaattgactccaatatagccagttatcaataatccaatgctacttctagttttgcttttatacaatatgcttataattatgtggatggatcaaaatcatgcatgtctaaattaaatgaagtcatttttttaaaaaaatattatccacacataaacattcgtaataaaaattcaaacaacattaaacaaggtgctcgcatatattgtgggctatttgaatttaattagtacaacgacacatggagttagcgtgtggcctcagctgggataaaagagaaggaaaaagtccacataaccccctaagctatggatggaagtccatctagcaccctgaattttgaaactggatattcaaccccctaaactttacaataccatttatataacctcctaagatggttttgcataatggtttgcatctaattcgtatataagttggatgagttcgctcacatgtcattcactttggacatatatattaaaattttgacttaaatctttcttttttttccttattggctctcatttacaaacaaataccaacgtaataatagtatgatatcactgtgtaagaagaaattgatgacttataactgatgatatgcaaatatgttatattagttatttaaaattacccatttaagctttcaaaatatacaaaaccgtcatccaaaacatcttaggggttatatatggatggtatggtaaagtttaagaggttggatgtccggttttaatgtttagagtgctagacaaacttccatcgaaagtttagaagggtatttggactttttccaaaagacaataacggtgaattgaaagaggtttgggtggagaattaagtatggcctctgatcttcaccattagtgatgatgcatgattttttttttttttttgcgtaactgctcttcagatggctttcatgggcacaatagattatttgaacatgcgggactttaacaataatgggccgatgggtgaaagcggaggccgtttagttgggcctgattggtctagatggtggccttgtgcactcctgaaaggaaaaagtacaccgaaggtccctcaacttgtcgtcgagttacaaaatcgtccctcaattgcaaaaccagatatccggcgtcccttaactaattaaaaccggtcacaatagatccttcggtggttttgaccccggttttatcctacgtggcaactgagtaagcatgggacccatgtgggccccacgtataaggatgccacatcatctctcccctccctctcctcctcttcctcggttcttctctctcttctcttcctcggttctttttccggcgagagtgccgcggaagcggagcacgagcaccacgccagtggccggagctggaggagctcctgcggctgctcgcgtccgctcaagtgagttgggagggatggaggaggcgacgggcgccggagatgtgggggcgtctgatggtgctccaccgccggtggtgaagatgacgacggaaggtgggaatgcggcggcgggcgacaggggaggagcagcgcgcgggcggcgggagaggagctgggcggccggcgacgagcggcagggtggcgtggcgacgcggcggcggcgggccgggcgcagaggtggactcacgagccttgccgccgctctcggtggactcgaggccgtcctcatcgtagcaaggagtgacgatagctcccgtcatcatcctccttccgccgccgcattcgtcgtcttcccccacggcggcgcgcgtgcccggagggtggtgcggccggcgacggcggctcccgaggaggccatcgaggcaccgttgaagaggaaggagacggcctcgccgccaccgccgccagtgaggacgcggacggacacgctcccggcggtgcccctccgcacgagccgcctctcctgctccatcctgcgcagcacctgctccgggttgttgagagccttttcttttcagtgcatcatcattgcattgctttgtttcgttttggtgatggataagaaagaaggcttttggcatgcaaagaagattgctaaagaaatataggggaaagggagcttacatttttgtgattgatcatttgggaagtttttgttgctgtgtcatgttttttttttttagatcagcaattttcatgctgaactgttcgagatcagaatttctcttgctaaacttgaatcgtactgtgtcattctttttgtgttgctgtgtgatattttttgtttgagatcagaatttttttgtgccgaactgtttgggatcagaatttctcttgctgaacttgaatcatattgtttcatttttgcttgataagggtgagattatggaactgaacaatggatgtaggatctgactttcctctgtttttgtggtgatctcttttacaggatggattggtgacaaacaaacctcctgggatgaggtttacagcgagaagaaacatgcgtgggcctgtcgatcaccttcacaattccaacagctttgatgccatttcggtgtcaggttcagatgggagctcagggagatttaccgtaaaaaataatgcaagtatgcaggacagccgcctctcctccacctgtttcagcacgcagaccacctccaccgcgtcgggcagactgagggtggcgaggctgcggggcggaggaaggtggcggggcccggaggacagcatcggcgacggacccgtaggtggatagctcggcgatgagatagggattgggaagggcggtgaggtagtcggcgtcgtgggagtagccggggaggaggaggagcagctcgaggaggtgcgcacgcctgccgccgccgcctccccttctcccgtgtctccgccgccgcgtcgccgccgccgccgcatcgccggccggccgtcggacctcctcgcccggcgacctcctccgcaccgttggccggccttcccagagagaagagtgtgagagagagagaggaggaagggagaggaggggaaacaggtacctgctgacgtggcatactaacatgtggagtccacgtgggtcccacgctgactcagcagccacatcggacaaaaccaaggtcaaaaccactgagggacctaatttgtactggttttgtaagtttggagatgcgttatatccggttttgcggttgggggatgattttgtaactggatgataagttgagggaccttcggtgtactttttccctcatgaaatgttgatttaggaaaaagtacacccaatatctctcaacttgtcagtgagataaaaaacgtcctcgaaccgcaaaaccagatatatagggtcccttaactatacagaaccggtcacccgagatctttcggtggttttgacccaggttttggtctatgtggtggctgagtcagcgtgggaccaagcgttatgaaccgtggccgcctacctgctttggttggtgggggcagctcctccgttgtgggtaaacgggaaacccgactctacgaacccgaggaaaggctgcactgcttccgtaagggcgttaagaccggagctttttgtagtgctagcaggaatgcaagtgaatgaatccaatcctaccccctcggcgaggtaataccttattgaagtagggcacgctagctctaaaacttctcacctggttttcctattgtcaactttccttacgcaagcggtcagtaaagaaaagccgagtcgagtacaagaaaaactaatagcttcctttcgttatctgtatctgttttcctcaaaaggtctagctttgccaaaatcaatagtttagttggttgggtcctgtcgatcaagttataggagccctttctcttttgtagatggagtggaactacacaactctcctacggagctcgattagtttcaactagacaaggaataaagaacataaccaatacggggaacaagggaataccggaccatatctgcttttgcggcatgacaatctcactcgcaaaggtgaaaccagaggaaattcagaggcccagttgagaacagcaagcgtacaatcaatcggtgtatggaagttcggtgaacctatatgaaacagaagattgaggtgatgctgagctccaaaggcagcgggaggagtccttgttgtcgttgaatctggcgctttaggggcagaatgtgtgattgattccagcgagacgtgggtcccacatgtcaggatgccacgttagccggtcctcggttcctcctctctctctgcctgttgagcgcgagcgcgaggcttgcaggcgagcagatggttgaggactcggcgagctcggaccggtgcacgacgcggaaggggtccgggtgaccggcgagggcgcggccgacggctgcaacgcccacggcctcggcggcagagaggaggagatcggcgaccagcgccgccgccgccgtgcttcctccacgcgctggccaccaccgcctccacggggacctcgccgcccctagggccctccacgccggcgcacaaggggcttgccgcggaggacgagcggcgtggagctccagacgcgccgccagcgggaggcgagcgcggcggtgcgagtcgcgtccttgacgggaggcgggcgacgaggaggtcgtcggggagcgcgctgacgcggtcctcgccgtcgtagccctcggcggcggaaagcgtggcgccgttgtcggaggcgggatggccggggaaccaccggaggcggccttggacgtggcgctgtcgtcgtcgtcgtcctcggagtcggggaagaaggtggacgcggcggcggcggaggctagggggttgccgcggctagtgtggatggaaagctgaacattgcttcttcatctccaagatactgtaattcacgagcctgtttattttgatggttgcttcttcagttcgaaaggtgtctctgtttttattcttgttcaagccattggcaagtctgaagaacctagactgaattctatactgtagtacagttctaccatcgtctgtacagtataaagaagcaatcttttgaatccttttcaagtaggactatagtatgagattattatagcctgtcaacttgctgtttgtagctagccaatgctaatcttttcagctcgattatgatatatatcacgtcgtcagatttgtgcagaatactaaaattggtatagagacattctgaccgggttatggtcgatgacactgtccatcatctgagagtttgcaagtctctgaactctgaacatttgcctagaatctctgggatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgactaggagtaatacagattctgaagtttataaacacatctatgcctgaacaagatggacacctactgttttcagttcaccatttgatctttaccagataaacctgaagttcaaaccgagcagcactgcagccatgtttcccaagatagaatgacgcgtacacaaactttcagcgtgtcgagggcgaggtcgacggcggcgccgcaccccgggagcggcccgctcttgggcaccgccaccgacgcctgcctgctgtacagaaactgcagcacgagcacgagcaccagcaccttgtacgacaccagccgcggcaaccccccagcctccgccgccgcgcccaccttcttccccgacgccgaggacgacgacgacgacagtgccacgacctcctcctcctcggcaccggcgccacccacctctgccgcgtgccccccgcagcaccatcctccccggtggcgccgccgcgccactatgttcgttgccggccggcttgcaacaggagaaaagacagagagagaggaggaagggaggatgctgacggcggcgttgcctccgccggcgcgacgccggctgccggacctcctcctctcccctccccccggtggcctcctcccccacagcgccgcctgtcgccggctgtcgccggctgagaaaagtgagagggagagaaagggagaagaggggaaactagagggagagatgaggtggcgtgggttctacgtgggttccacgctgactcattcgtcacgtaggagaaatccggcgttaaaaccgccgagagatctcgggtgactggttttgtatagttaagggaccccgcatatctggtttcgtggttcgaggatgattttgtatctcgctgacaagttgagggaccttcggtgtactttttccgttgatttaagatctaatggtcccaggtaattgcggtgatgtggctaatcatcgtagcaactttataactagtgggtaccaagtatatactacctctgttttatattattataagttactttagctccttttatattaattaggaaggtagtccgcgcaaatgcgcgggcatgcgtcgtacgttaagttcgagacacgtacttataggagcaaaatattaaccggccacgatttctccgttgttttcgtcggcattagttgtttttatattttttaacatattagctttatattatatcatatttaagtgatatttttttgacatgaaacaacaggagaggctcctattgcaatatatattaaaatataataaatgggtgaatttacaaagattacaaataattacaagggaaaactaatgaaaattatctagccatgattgccaaagcgagatgccagcttcctttgctctatgcatatgcaaggcaaactcctgtttgaaatcagctttcaatttgtcaaaattgctctatgcttatatttaagtgatatctataagcaattatttataatcttcttcgtcatttgaaaagatggtagactaattttctttagaaaacatgtcaacggaaataaaagtaagtgtaaagtaaaagtaatgttttattaatgtatatatattatcatggtttattagaggatgaattgggtgggacatgaatccactaaattttatatagcctaatatgattgatgtagtttgagagacggtccatctatgaacatttcatgtagagtgggtaagaggttctatgcaacctaacctgaatactataatgataaaatataattgcacaataatattttaaaaatgtgatgtaccataaatacacacttgtttttcttagaaataatggttccaccggtttaaaaaacataggagtattccaggaatatagcttaaaaattatggtgttttaatatccaatattattacgaagtgaacgtagctcaactggttaggtttcttgtggtggaacttgcccactcgggttcaagtcctagattgataaattctttcagtggtagacgacgtacccgtcgacagtgaagcgctcgtggtgactttgtcaatctcaaaatatgtgcgcccagtctctcagaagtactcatgagggatgtgcatgtgtgccctcataggtatgagcgtgcgcgcgttgtgagcgcctgcatttttactttgtttctaaaaaaatccaatattattgattgtttctctttttattgattgtttctctttttgtttaatagataaatgatagggagaggatggacaatgttgtgtgcgtgtgagggcgaggaggaggcggaggagattttatttttttaatttgtctaaatgatttaagtgaaagccgatgatagtgtgtttcatttttctatgaatttctaagtttctctccgttttttataggacgtgacacatggcgacttaagaatttttgaaaaaaatagatttaatagttaaaaataatggatacgtcaatttattggtttttcttagaattttagggcatgatatagggtgttttatgagcgctctggaaggcatttaatgtattttttgttatgtacaatgatttagtgatttagtattcatttaatttttgttattatttatttgtcaggtaaacgatagggtctatcctcaaatgatgtattttaacttttattttttttaataactgacacctaaagtattagtatcggtttgtagttgtaaccggtatctacgattaataataggtgtcggtttcctcttaccagcacctttaagttggtacctatttgagattacgtagtagtgatagttttatttgaactggctgactaaactaccagaggcatccttaaccttaatttctgttaaaatccttgctcatagtattatatatgtgagctcaaaatggcggaaatttcagccagaagccaaaaaagttcagtaatccgattgaaaaacataacccgacacttctgaaaagccttgtatttctttaccagaaaggctgaaacatgaacgcgccaccaagcgaaagatcgcaaccaaacatgatctgcgcccacgcagaaggcagaaagttcccggctttgcaccgacgtgtcgagcagccaacggcagtgagtgcgtagcgagagctgatgagcaatcgcaatgcatgatatatcgaggagatatactgtcacgcctagaaattcacaggtaatttcggaactaatttgtgcattaaaaccctcgtccagaaattagccgaggtacacaaactgacaatttaatatacagattcatcaaaataactaaaacgataaatacttacataagatgcacttagttctcaccataaagaaaactgcagcggaaaataaaatctagcgaagcttcagctccactcccacaggcagctcaactgggatctaagccaaaggtcttctccttctggatcctttttcttcaactgaggtttgatgattattgcaagaatgagcatatgacatactcaacaagctacacagcaaatatgcaagtgcacaagcatatcaaaggatggcataatataggattcatttgcgaaagcagcatttagcaaagagttgagaatttgtaaaacagtagagtaattaatcatcaatattaatcaacactgaacagcacaaccatgctgcacaggcccaaccaaacctgaacaaccaaccccggtcgtacagattaaacctccaaaccaggaattatccattccaaaccaggagtcaaattaattatcacattattatcattaatgagtagtgtggactaatcacgaaaaatattgttagacccgcccataaccgcgggcacggctatttgaatagttttactctggccagagatgtaccactgtacccacaagacacgattccacacatgttgccatgccttgaagtaccaccacggcactgcaaagggggaaatcgtgacagtaccctttgcacaacacaactcaccacagcgcaccatttctggatcataatcactccctcaaaaaccagaggcatggactccccagcgacccccacggacttctcgccgcttcacagtcttgcaccccgcaatgaatcatgctatacaaaaggtaaagccgttgctcatgctggcttgtggttggcacggttaatgtctcacaacagtagctcgcgaaccggtccttaattgtcatgagcacgaccttcaaaactatgtgctcacaacccaccattaatcatattttaatcatcaattaattatcataacacgattgaccatcatgagctaccattaaatataaccataaataataatgtagtatgattcatcccattaatgaactaatgtttctaagcatggctaagcaattatatatatatagcatttagctgaaccaatccaatatataaggttctagctaatcaaattataacccatagaaaaataaagtcatattcggctattaattaattgggaaaggctcaccacccgatgacattcgaaaataatgcataagttgaaataaaacattagctttaaacgggttcaacatgctcaaagggttatttgggatctgtgtgacttgccttgcaaacaagtgtcttcaattcgtcttcaggaacttctccaacgaacgaacgatcctctgaaacaacagaaaactaaacctagaacacaaaatgagaaataacactaataaaaaccaaataaacagtacaactaaagttcataaataggtagagcttgaatttagatgaattatgagacttgaacgacctcattccgagttcgtatgaattagatatgaattttacaagatttaattccaattaaacctattaaaaaaagactattccaaattaattaaacaatttacaaatgatttatagctgaggcaaaagattaaaacatcctccggaaaagattagatcatatttggtagatgacatatattaaaaaagaataatatgttattaaaaagagatgacaaatttatattaattttggatggccaagatggcgctgatgtcagcgatgacatggctgccatacaggatcaacgccggtgagcacgggaacggtggttatcagagaaccacaatacaatgacacaaacggagggcaccgggagagagaggagatcaaggcaacccttaccaccacttacgcgatgacagacggcgagggagatggccggcgacaagctccatagggcggcgacctagggttgacgatggtgacggctttccggcgacgggcggcggcaatggaggggtggacgagtttctcctcacagctacgaatccaatggaaacaacggcgaccgaaggcgacgatggacgacgacgaacagcgcggccggagatagattagatcggcttcacggtgacggcgaattccggtggggtttggcgcaaaggaaggagtggccggggtagctctcgcccttgcgaagccgagggaggtgacggggctgaccggggacgggcggggcgacggcgcacggcggctggagaggcgaccggaggtggagagagagggagctcgcggggaggaggctagggttaaggaaaaaattcgggaaagagggggaaacggaagaggaggtcgaggggctgctatttataggatttgtgcgaagaggttggataaaaacaacgggatttggcgagagaaaaacgagggtttatccgagttcgccggaaaaacggagctcgaaaccgcgtcgaattcacgcgatatacaacggtattcaaaggggtttcttagggataaggtagaggagatcgaggggaatccgtttttgcaaccaattttggaaacggatcacgggatgcgacggattttgcgaaggaagcggcggcgcacgcacacggatcggctctgtacggctcggctggaggaggaagaaggtactgtagcgaggggaggtaaagtagacttttcatgggcttccttttccttacttgcttggcccgattgctagagggacaaaaagtggacttcagctaagagagagggagaggagtgggctgaattcggcccaaacaaagaagaggaattttaattaactttttaatttaaataattgctgaaatgatctttcatttattaaaaatacttccaattctcaaataattctgggaaaaatccagaaaatacttgggcatacaaagtatttaataaaattttatctagctcaagtttatgttcaaatttttcatagattttattcacacacttgctttaattattaaataaattctaaaaattctttttttcacaacaatttataatttagcgattttcagggtgtgacatatacctacgtcctttggcatgctgtgtcagtccaatatttttcacgaacacacagatggattacacgctaatatactagaagaaaagaacagagtttgagtacatgacacacacggtcagaagaccgttgccaggggtcaaagaaaaacgaaaaataaaagatactaacgtggataacactactagaaaaagcattatcgccggcggtggaaacaggtcttcccaggtggacggcggctccgcctgtaagccaacgactgtgaagatcgcaggcgggacggccgtcctcctaggaagataattttcgcagttggacgttagctagacaggtccgcctgcgaaaatagaaagcggccgcctgcaaaaaaaaaaacatccgcctgtgaagatgggtagaaaattttgaaatttgatacaataataatttgcccataaattaatttttaattatttaatagaaattgatgtaggaagattattagaattaacaagcatttggtactgagaaatctacatatattgcataagtgaaaagtgttgtcaaaatatatattacaatatttttttacattgtcacttcaaatacgccatctaattacattatggcatagcagtactctactcccaaagttgcttgaattcgtcacttgtagctagggcaccctctgggacgaataaatctcctcacacatgacagcactcacggtggatgaagtgacacaaatcgctctggacatttgtgatgcctgtatcgtcaaagcttgttcgaaattctattcttggcaactgcatgcattagagaaaaacaatatattagtatcataaatatgtgatactgtctagtccatagtctagagacttacatcctctgcgttaaccctgtacctcccattaaccgtgaggaattcgcacgcgtaatacccgcagaggacagtgcctctaggttgcttgtgacacttcacgacatatcatacaagaaaatagttaaattttgtaattagtgaaacagtaggaatatattaaatgattggagtattaattaccggccaatatgtatgtactagcagcttctcccttgttcgtgtctgtttctccacccttgaacttgtagtagttgtacgcactgtatggatgtcgtaccgtttcgcattaagaaggatattttattataatatattcatataaaaatgtaagattcagaatcatttcttactgtatgatttttctagtagtgtaagccgatacagtctcttgctctcacttgg

SEQ ID NO: 60176 - DNA, 8216 bp, Oryza sativa
tatggccgacctaacagcatctgtacactatgctgacatgaacatggcattgaatggatcatttggaatcaagcaatgcatacgctgagtcgcgacacgcagagttgctgcagcaattcagttcaaacttgcgagagaaaaagtgttgttttgtatgtaaaactttcttgtaacatttgcttttttcttcaatcataataatattcggatgaccctcttcggttgcttgaatagaagtgttgctttaccattgtcagggaatacaacttctttacattttgtctgtccgattcagaatcaacgaataatctgctgttagaattctggaaaaattcctgacaatggcatgtcgagtaattaatactcctatggaatttatacaaaagctagctcatgaggtgagggacccctccccttttaagttggtgccactccccctaaactttcaatgtgggactattcccaacaatctcccccgtcacacattagtgccccttagccctaaccgggctacacacacgagcacatacaggcctcacacccgcggtccactaaccggcccaacacataggcacatacgggcctcacacccgcggtccactgggcttcgggcttacaccacacgagtgtgcacggcacttagagagattgtgggcccagctctgataccacttgttggccaaaaaccgggagacgttggcccaaccgggagaaagcctttctacaccccaaaagctagctcatgaggtgagggacccctccccttttaagttggtgccactcctctaaactttcaatgtgggactattcccaacaaacatgaattcagatatcaaaatttgatgaatggatggtgatattagtctccgtgggtcaaagtcatttcagatgattccatatctggtctgagccaccatcataagatccaacttacatcacgaaaagctccaattgtgcctctattagagtttgttgcgcatgtctcggtcccaggagtgcccactgcgtgaatgtgacaatgatgccccataaagggattgggatccatctacttgattaaaatggcatcaccatgaaaactagctttcatgtatcctccaaaccaataagtgaaaaatccattcagcaccaaagatgtacatttttatttgcaaggtacttatccattttttttagtaacaaagaaatacataataattgagagtggagctacaaaattgagagggttcctatgaacccggtcaaaaatattgttagcttagttcatatgtgcaccactcaattgaaacttggacacccagatcaatataaatttggtccaaaacttagtaaagcaagcgactagtacctctccattttgttctacatcctcccccgaatttatcaagccctttcaaagtgttttcatggttcgactattgtgaatcttggagagaaatgtggtccatcaatttttgatacatgcacatagggcatatacatgcacacaccgacttcctcaacacacaatcaacaactgaaaagccaatgatatgtttgtggacctcacaaaaataaatattaaagcaaactagcgtgtgcataaatgcacgagagtgtcacgaatgggttaactctatcaccgcaccgaatgtgcttccacaggagaaaccttgtcaattaagaggtctaaatgtgtgtttaggcatggcctttcattgcagtgttttttccttgatcaaaatggacccttgtaggcgtcatgataattgggtagcacttgtgtctccatcactagggagggtgcaatcttgtaagttgtcctcccaatggaacagtattgacaatgactagatacctgccatgccatctagcggtagagtggccactttgagacaaagtaaaaaagcctctgatattgttttatttttgtatatatatacacctggctgtgcaaagtaccagaattaagtttattttctggtgggaggccaggaaggaccatagtagatgccaaaagtttatcacaggttttgtatatgactaaaggagaggtagaagaagaggcagtagtactctgcaacagatgcttctatgctggatggaatcttgtccactctgtaacccaatacctaccttcccttttgtttttggggtttctcttctcttccttgtctggttaaagaggtgtctacaggacagcaaaccttatttttatatggggtttagtattttttttttcagttcctttggttaactgaacctgaccaatgttagagcattagaaaatagtccgtggaataaaaggccaataataaacggtatcttttataaaaaggataaaaacaattgtaaattacatttctatcagcctgattggttgactgaaagaggcaatacacatgtacattaaattattggacaaaaatgtgattttcttttgttgttctatattgtaaggtttttttttaggtagaccaaacctaagaaagaattttgctgacaagacaggagcccaagacatttgccaatatgaaactcccgcaaatcatgtcagttcggctcaaatcatgcgcccaaaggacctttctgccgtgccagcagttttggtgctttgcagaataaagggcacacacaacaattctatcctaaagattagttgtctagggctcactagatgagattaagaatgcaatcatacaaacaagcaagacactaaaagaggttaagattctgcctagagttgttgactccagctcacacggcttaaaagactccgtgatgatgataatggcgatgataacgcagagaacaaaacaattccacctaccggcacaaagcctacagtagcaaccaaatgcaagaaacttctctcataattatattcaaatcccaagttgaagtctagaaacaattacattccactgcaacattacatattgcatcctttgtgagatggatgaaaattcctaagagcaaatgaagaaaactaaatctttttcttttttcgtcttcgcctttgccttcgcctccgcctccgcctcggcctcgccgtggtacaaatctttgagctgaggcaatgggcaagtagggcattttatcccttctccttcttccattttcttcccccacattgaaggtgggggggttgtatgtacaatcatggagggatgatccaatgattgggttggaggtagctcaaacccaaccccctcgtgttaagtgttccaagcacccgacatgcctccccgggtgaccgtctcctggctttgattggtgaaactgatttgtccccgaatcaattcagagaccatggccatgattgggggctctcatctgtttatctatctatctaatctatcatgtattgcccctgaaccccatctgaaccacgctctgcaggtcatcctcccacatgcagctccctgcctgaaaaaaattcagccacaacaattcttgcgttttacgatcagtgggtcggagaaaaatgacggcgatttcactgtatgatcatttctgtggcttgagttgtagtacaattttacctgagaatgagcactgtgaaacccatcaagtgagggaactgggatgacatggtggtttgcaaatgttggcgccgtttctaagtgtttggtgcttgtcaccacgctctgcattgctgtcccttgcgacgacgcgtagcagatccccgggcttgcgccctccggtgagtaggatagcggtggcggtggcggtggcagcgacaacggcgcgggcatgatgggatcactagcctgctgaaaattcagagacttgtaagtaaaatttcagaattatatggtggtctaaggtcaactaactaaatgacagagcgaattcaggttggattgttacatcttttgggatgaagttgtcgacgtcgaaatccagctgcgggttgacggtggaaagcttcattgataggaactgttgggacagtaaacaatcttgctcaaattaacaaatttgaaaggaattaatcagaaattattgtaaattaagtcggtgatgatcatgacaacgcacctccacttgccgttgcaacgactggacgtagtttatgatctcgtcaagcatcactgccttgcctgtcacctgaatttcacaaactcgaaaaattaataattcctctgtgaaaaatgttttaccagcgtgaaatttaaatttattttttggctgaattttgccaccttgttgcagccaggaacgaggtcttgaagcagcttcatgcgctcgctgatcttttctctcctcacctggaggtgaaaaacggcggcaatggcgtcagcaaacgcgagaattgaagagaaaaagaaattatgattggcggcatcgatgccggcggcttttacccgctcggcgaggctgtggctgtcggtggcctggccgcggcgagcgcgcacgtggatgtagtccttgggtggctcgccggcggcgtcgaggacctttcccttgccattgccgccgtgtcccgcgtcgccggcgaccggcttcgtgtcctcgtctccggcggcgtccgcggacagcttgcatttcttcgccttcgtccccggctccggcgactgtggaaaattcaccattgtttcagggctggttcggcgtcgcgattgcagaggcggagcagagagcagacgaagtaccttggcaatggtcgtcgctgcgtccttgcctctagccttggcgcacggcgccttccgcttccgacaaggagcgtcgctgctcgacccgtcgctcgccggtagctggtggacgccaccggccgccgccgtctccgcgaggagggactggctgctcgccgcgcgtgagagcttcccgccgccgtgtccggcagccgccaggcacgacatccgcgcggcgcgctcggcgatcatggcgtccgccgcggcgagcagggaaggcacaggcggcgccggcgcgggcttgcacggcgagcccaccggcgtgctgtagcacgacgcgtaccgcgacgacgacggcggcgacggcaccccgccgcccccgagcccgccgccgcacacgccgccgagcctgctcgccagctcgtccatcagcgcggccttgtgcaccccgcccccgacccccacccccaccggcgatggcacgagctcgccgagcgccgggtcgctgtcccaccctcccccgtgcagcgcggccgcggcgtcgaacggcagcggccacgccgccatcgcgtggaagcttccgccaccaccaccgaggaacccgtcgtgcgccattgccgcgggaacacgcctcgagctccgcgacgcgacgcgagcgttcgtgcgttcgtgcgcgcgcgcgtgccggcgcgaggacggcaaaggcgggaagtgcgcgtcgcggcgcggaacaaagtggggcgcgcgcctctcttctcggtgcggggatgtctgtctatagagagagagggaaggggggaataggcagacagacagggtagaagaaatataggggggagggacaagtggagaaaaagaaaaataaaggcagatgctgtgtaattttgtgtgtattctatgggtttgtgaccctttcaaactttttgaattttttttttatggagggaagaggagggatctttctcaaataggaaattagagggaggcttttttctggttatagggtatattgtaggggtggtgatggtctactgaaaggaagggatggcaaattcgaatgggtttgtaatgggatccggccgaaacgaccgaatcaccgaaaacagcaaatagaaaaaaaagatttatccaatttagtctaatttttgcagagtcctattttttttattttaacataattctaacattttgaaccggcataggccgaaaaccatgacatttgatatgcttccggtacattttcaagccgtgataaaaacattgtatccgcatttgccattttcctgagaaaatttgaattataaatttatgtatacttcattttcaaaaaattatgggcttatttggctccattatataagattaaattgattattaacatttattatttaaattaatgttcgctaaaaatatgtatcttgggaaaagtccgaattaccccctaaactattgtggttcccccaccccctctaaaattcaaaaccagacattttcaccaactttttataccggacgaattatcctgtgatagtctttgaagcagttttggtcctacatcgcgcacatgttatagtccagtcagcataagaaaatataaaaaagagtagggtccacatgtggtgaccgagagaagaggcaaaactgataagtgggccctcactatattttattttttttatgatgactggagtgtcacgtgtgtgccacgcatgacgaaaaccttttcagagtcggcaggaggggtaattcgtttagtatgaaaagttgatgaagaagaatttatagctttcgaatcgaggggggtaatttgtactgccataaatagttttttttggggggcggggggcggagagggggacaatatggactttttgctgtctatctcatttgttctaaattttggaatacggtagtcttattgtttgcaacatagattggaaaatattggcttgccaaaaattaaatttcttaaagctgtctggacaaatgagatcattataacctaaccatttttggtgttatgcatttttctctaatcccacgaagaaagtatacagaattatatgtttgcttattgacatgaatttattctagtgatctttcgtgaaattacgaataaaagtaaggtaaaccagatttgacaaaaccagggatgactaaccagtcatcagtgtagcaaaaattgagcatttcaatatgtaactttccaatctactccagtcgtttctgcttatacatctgataaaccttttcttcagtaatgcaactacgagtggggatacaccattaattagaggtgattacgatcctctgtcggtttaaagtgttccattttgaattaaatgaatgcatgatttgctaggagacatgagcaaattgatcatgttgaatatgaacatgcatagtttgttaggtgaatgtgatatttgtcaagctgatagtgcaatatatgctggatagaaagtgattgatttcaatttgaaagtgtggttttcatcaactgaaagtgactataaactttgatctgtgacatttgtccatacatatgtcgatgtggtttttcctggtttcaatcaattcataaatcaccaaactgtctttttcttcatttcaataaaaccggtttcgttggtttgaaaatgaatattcctaatcagcaagggcgaaacgaccatctgaaaatgtttttttttaaaaaaaaacaaagactaccattttgttcaagtaaactgtttcccaaactcaaataaattgaggcagtcaaatagttaataaggttctcaatttctcaaatcttattgtttgatcctttgccatgaacccaaagcaaacaattgcaaaggccagagcatgcagctaaattgtccattccaaatggtagctccgagctccccattaagctgagcaagcaagcccaaccgaaggcaacagcaaaagaaatccccattaggtgactcggatctgaacaaccatgcacgctgcacacacaaacacacaacaccccaaccttcccacactgatgactaaccaatctgctaattgcgaagtgctaaccatcgattgttccaggtctgctggtccaatggcccaatgatggaagttctggaagatattgcggtgttatccatggcagatttgccccattttgcgttgctttaaaaagattggcttgattagatggcgatatgtcagtagcgactggtgtgatcttctcttcggccgagcaagatttgcttgggcaaataatatctgtcagcagagcggcgccgtcagaaatttatgtctgtcagtcgaaattgtccaatgatcagggtaggatatggcaacaatttgtgtaactcattttgttagacacaaatgaataacattcccgctgtctctgctgaaccattcattttttttcccattcgtaggaacaggccagtgctaagacagttttattcttaaattgtgacaattcggtcatttttaacattttcatgttaaatttgtcattaaaaaataaaaaatagataatcgaattttacgtctcctgcttctgccattgttttgttattaaaataaaaagacataaatcaatgaaacaaatgggctgcagga

SEQ ID NO: 60177 - DNA, 4483 bp, Oryza sativa
tgaggcacatctggagttcattctactttacctttggcatccgtcaacccagcagcatagctcttatgtttggtagttggtcaaataggtttaatccaagaatccaaaagttgatttttgtgggtatagctgcaatttgttggacggtttggctgagtgggaataatgtggtttttattgcttacaattttaactcgtttttgcaagtaattttcagcgtagcacattgggcaaggctcttgtcactgttgtgaagttgatggcaagatggtgaaggcttattacaagctcctcgaatcaagagtgctgaagttttatgctgcatatggctggaattttaagagaaggattcacgcttagttctgtttctttccttttgagtgagcatttgtttgatttgatattgaactccccatattctgggtgagtctatgtacttctttccataccttttggttatcactactagaaaaagcatttttcccaacgtaggggtattattttcacagtcggacatgacctttgaagccaaacgactgcctacaaaaatataaatcggggtgaagttagctgttcgcagacggaccacttaagcggcgcggcggaccacttaagcgacgcctgcgaaaatcaattttcgcaggcgcatgttaggtggtccgcttgcaaaaatagtacctacctccttatcctctcctcccccatccttatcctatcctcacctctcctctccaccactcatttccctccccacctctctctctctctctctctcacttagaaaaaatctcctctccacccccacctccgccgcggctggctccatcctcggctccccacccccgccgctggcgacgacgacgaccgcgacgccgcctccacgcgccggcgacaacgacgaccgcgacgccggctcccctcctctcccaacgtccgcgcgccaccggccggctccctcctctccaacgtccatgtgctgccggctccctcttcggcgacgacgacgaccgcgacgccggctctacgtgccgacggctcccctcggccacgacgacgaccttcgcgccgccggctcccctcctctccccacgtccgccgcggccgactccctcctcggctccccacctccgccgccggcgacgacgacgactgcgatgccgcctccgtgcgccggcgacgatgacaaccgcgacgccagctcccctcctctccccacgtccgcgcgccgccggccggctccctcctctccaacgtccgcgcgccgccggcttcccacctccgccgccggccggctccctcctcggcgacgacgacgaccgcgcgccgccggctcccctcctccccacgtccgcgcgccggcagctccctcctctcccacgtccacgacgagcgacgacgacgacgacggcgctgacgaacacgacgggcgacaacgaccacgacggcgccgacgcagcagctcggctcctccctggccggcggcttccatggtgaggccggcagcagcgcccgtgttttgtttttattttttttaggcccgcctgcgaaaatggtctattttcacagtcgatgggttagcggcggtcctcctccctgcctgcgaaaatggttttgggccgcctgcgaaaatcctttttctagtagtgtatgtgtacataactgtggatgtagtggccgggttttttgtgaatcacatagttttttagccaataatttgaatggaactataccatccacagtgaaaaatgagatcttagtcatcgattgcaagattgtagcactattacgtatagtatcatgtttcatctgtggtagcatcgtagatcaaaagtgcaggtaatagaaagctatgaagatatcatatggaagttgtattataaaactgaagaactccatgatgaggcatttaaaaaaaatagttcagggtagctgtaccgtacatcttcctgttttgaaaagagtatagtataatgattatactcctatgtaagatgtacatagatcactgctaacatacaaatcagtgtgccctttaacacatatcaagagataattaaatgtccaaatgccaacattcaatagccaaattaaaacccgtttacagaacaaatacagagattgctacgggctttgaaagacatatagtttggatccgataacgatccactgaggcatgtgtcattctacagtttaactcaggttggaggttactttcaacggatgaaaattattttggatagaggaagacaaaggctgagaggccactaaaaaaagagaaaagggtgagaggagaacgcgagtcctctctgggggaagagttcattacggagctactccctctgacccataaaaattatatttctaactaatttaggacaaaacagtaggattagaaaataaccacaatgacattatttaatgaacccattgcatacacacattccatatatacaaatgattaaaaggaaatttgagagaattaacccatataattagcatacttaaattacaagctgagagaacttaaggaaacttatctagatgaatcaatttgctgggccccacatggctagaaatataatttttatgggacaaagtcttagagatagaaatgtaattttttttgggacggaggtagtacgatcctatgaactcagagaagtcaagcgttcattaagttcattttatatgttaatttgttcaccaaaaaaatgttcaattcacacgaatatatatcattaaaggaatcatcatttttcaataggacttaaaaatggtcaggataagtgggatacctgatcccgaaaggttttatctattcaataataacttgtataatagctaaaaaatatatcgaggcaaagaaaaaaaaagacgagaaaacgtttcaaatcgatcagtacttctgatgtttgattaatcgctagtttcattttatccgattgtagtttgggatatggcctccaaataaattaatgtcggcgatgtcaaatgccataaatcaataaatatatttgtgatttggctattgctaagttccaggtgactgaaacttttagcaatttcacgaagtaagcaaaactcaactgggtttttctggtttttggtgatggaacttgctcacccggttttaaatcctaaacataacacatgtgctcgcatttatggctaatgagacgtccgtggtgatttgtcaatctcaaattaaatatatcaacctaattttttttgaaggttcacatagggggaagggtgtgagtttctgcatttgtagggctgaatattcacgtgttgtgattgcattgttagcatttgtactatgttttaaaatgaatatttaaataatttcaatcgcattcagcctaacacccaattcaaggaggaggggagggactcactagtgatggcgacttaaatttctagagatgtaggctggaagtgtgcgggatcagcggtgggggtgaggtaggccatggggttagacgccataactcggaatatgagccctagtacaaaactcaaatgagacttatacttattaccagaaaatgctttatactattacctatgttctaaaatagaaatttgttactgtatatctgaataagagtatgtctaaatacataaccaaaatttgttatatattgagactgatggagtagtaaatatcaatttaaataaaagagtaaattgcatcgatgccggtggcaggaaaaatagttgcgtcttaattaatatagtaattcagttttctttattaaccggaaaatataatcatttgcgccaagaacgcgcgttaacagtgtcgttaactcgttataaactaactctttgaggttttgatgattatcaccaaatatttgttgaagtggaagaaaacaaatcgcttatagccaaatcactagagtaaagtaggaaaacttttaaaaaatataaccggagatcatttttttaaaggactcagacagtacgaagttcatattgatagagtagaaaaatattacaagattacaatcctgagaggtcatagccaagaaaatgaagaaaaaataaccacggcccacacactaacaacaccaacacacgtaatcgagagaaggccagcaagcacaatcgagagaaggccaacaaaaaattaccttgttgctaagttggcattttagatgaaacttttgctggctagaaagcacaattcttgtacctatatgcatagtattaagtagttctttaattaaaaaatattactgttataaatgtttattggtgataaacacccctctcaatatctgtaataaaacgaagtgtttcaccatacagtaatttaaattaatgccaatattttttgagattaataaatgaaaaaatggcacacaacaccatgtataataaaagagttgaaacttgaaagagcagtgcagattaatcacaccactatccatccattattagttgatatataatatgcccattaacccaagtcaca

SEQ ID NO: 60178 - DNA, 998 bp, Oryza sativa
cttccggtatgacttgctgagtacagtgggtagtactcagtcttgctctctttttccccacaccagagctgaagatcttcctagttggagctgttttgtcaaagttggtttcgtcgctgccgtcaaggattgcctgtgaagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttagcatcagagccgaccttgaccgtagggcaagccaactagaaaacctaggagccctctgaaccctttttcatatgcatatgcctttttcacttggattttgtttcgggaaaatttggggtttgcctctttggttggtgggaaaaaaaatcttggtcgttcattcggatcggatctttaaaattagctcagtctagggttttagtaaaattttatttggagtttattcgacagtcagtcgggaatctattgggggttatgcattaggtcgtgtctatgttcgatggggcaatgttatgcgcatcattttccatgcaactagtctatgcattaatttattgtttagtcagttgcattagtgtcttttgtctcggttcgtggaaaaggttgttccatgcataaaaatcaccatgctaggttatttatttgagtcatttgttgctttgtttaatttggatttgagcatgaattggttcctatcccttgtctactttagatgtcagtcctatccctcgattgcaagcgccgccccgagcttcagagtcgccgcccttagctttatcgtcttcttagtctgtttgcttgctagttttcgtgtttaggtttgttgcttgagggttagtcggtggtcgatatcatgtgtcagtggtatga

SEQ ID NO: 60179 - DNA, 7813 bp, Oryza sativa
  unsure (1)..(7813): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttcagcagcgggcgactccactccacaggcaatccttgacggcagcgacgaaaccaactttgacaaaacagctccaactaggaagatcttcagctctggtgtgggagaaaagagagcaagactgagtactacccactgtactcagcaagtcataccggaagaggaggtatgatgcaggatataaccaaaggaggctaggggttcttttgcataaagctagcatttaaaagcagtagttgaaagcagtaaaacagttgtagtaattatcaatattaaccaaacactgtccaacgctacaccacgttgcaacaggcccaaccaaccacctgaactacacccgttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtggcggtcccctcttgcgccgcagtgaatccggcagctggacaaccggacaccccggccgacccaactccatcacgcccaccctcgccaccggtgcctaggaaagggtcgagctatacttcagatcaagcagttacccactcccgcttggggtaagcacggtaagtctcncagggtttcccgtgaaccggtccttaattgccatgggtgcgaccagcaaaaccatgcacccacagcccaccattcagtgtattttaattaaccaacacccttgcggtggcaccaatccaaagctattgccaataatcaaagtctatgctttaatgtgattccctttttgtgtactagtagaactaagcatggctaagcatttcctaaatcaacatctagtcattttaatacccaagttgtcaatggcataaggtaaacaatatatggctgagtagtaggacccatcccacatgatattgtaaaagaatgcaacatttaatagaaatgcgggatatttgtaaattgggtacaatatgatcaaacgtattgcatgacttgccttgctctcgcactgatgagacctcagtaacgtcttcgagaaaccgcggatcgacgaaacggccgaaatctacgcgacaaacaaagcacacaagcaaaacatgctataagactactgaaacaggaaacaaaactatttttaatggattctttgcatttttcttgatttactgagacttgaatggacttaaacggagctcggatgaattacttatgaattttagaagataaactgtgtttttactaataaagaaaaagccttaatcactttattgcgcaataaagcccagggctgacgtcagccaaagggggggcgccggcacgtgggccccacgggtcagcggctccaaagggagggaggtggcgcctggcaggtgggccccaccaggcggtggctcaaaggggaggcgagggaggcgccggccgggctcggctcggcctcaaggccgaccggccgaccaaggcgaggcggcggcgaggcacggccaccgacggcggtgaccggcggtgcgggaagcggcggcgacggccgaaaggtggcggcgcatggccgaaggcgacggcggcggccgaagacgacggctcacgcgcggagggcggcggcaacacccaaagaaggggaggagaggagttagggatggagaggacgaccgcgacgacccaaaatggccggccggagatggaaacaatggtgagctcacgagggaatcggagctccggcggtgattcgcggcaacgaagcggcggccgaggtgcgggctggctcagtgagcgcgacggcggcgactgcgcggcgcggcggtggctatagtggcagcggcgcgcgaccggagatgggcggcggtggcggagctcgggtgtgacagcgcgggtgcggtaggggatgtgggagaggacggcaaatgggggaaacgaaagaggggactcggggcagcgatttataggtgcggaagggggcggacgtggccggggaggtggccgaaaccgccggcgacgtggggtggagagagagacagagtgccgccctctcgagcgcgtgcgcggggcaggagcgacagggcgtgggcggcgtcgtggggaggacgcgggaacggcgtggcgtgggcgcgggaggagcggaggaggtggggcggcagcggcggttgccggcgtggggcggcagctggaggaaggggacgacctgacaggtggccacctgtcagcgtcccgaagagagggggaaggggaaacgggccggcccaaggaaggaggccgaacacggctaggcgagctggatcgggccgacggcccaagaaagaaaaagaggaaaagaaaagggaaaaaggaaaaaaaaaggaaaaaggatttttcctgggattaaaatattgcgcttgctcatttttaattggttaaaattatttccaaggctctgaaaattccactaaaaatcttgttaatgcattggagcatggggaactcaagaaaaattccaccatgctatttccgattattaattgcatttattaattagagaattagctctaggttaattaagataatttcttcggacgatttatttagccaatttttaaagcaaggagagggggaaacttcagggcgtgacacgcggcgacgacaatggcggcgggcggcagcggctaggtcaggcgaggcgaatccggtgcggtggcgagcggcgtcgacgagctcgggcgccggctggtagggttttttttttggacttttatttttttcgcgattttttctttttgtatgcggttgacttaagtgcccgcatgcggattttcgcatgcgttcggcctagccgcatgcaaagatcgccatctttgcagacgatttggcacatgcggttggcgctaccgcatgcgaaaatcgctcccgcccgtatgcaaaaaccgattttgtagtagtggcggcggccggcaggagaggatcagcggttcacggcggccggagggcgggagggagaggagcggccgtgcccccgtgctggcgaagggggcggccgacgggagcaccgcgagggaggaggcgagctcgtcaaggcggccgacaggagaggagcgacggcgcgtggggaccaacgggagatgaggcagtgcgcgccagtcgacgggagggagggagaggagcggtggcgcaccggcgggagaggagcagtggttcgccggcctctccaccctggtcagtatccctgtctcctccctccccgcccgtcactttgcaatctagtggaaagctagaggaaatacaaagagtggaggagtgggtcccactatttttattttttgttttgactgacggatgggtcccgcatattttattttattttattagtttttgttttgctcacgtcaatgcaagtaggacgaagacctagtcaaaagagtcacataggcgtcacgtcgaccaaaccagggtcaatactgccaagcgacctcgtttggactagttttgtaagttggaggacgggttgtaaccggttttccggaccgagaatgaaaatcagactgggcaacaaatgcaagtacctagaatgaacttattcctcctgctgttttgttctgttccgcaggcctcggcctcagcaaaggccggttatgttcctccctctgtctcacacggcccaccctggctgctgcgcgtctccgagcggcgcgatgggccgcaccacccgtagtccttcccatctgctcggtcgtccctgaggcagggactgcccgcagatcgcgtctcgctgtctccgcgcggctttgggccgatccactacgcagccgttgttcagttgctgcgtgcgtttctctgcaacatgccggttagaagaatcaagaatatacgataccaaaagcatgaatgtatagtagggaagtttcatcactcatttatattgttccatttatttattccatttgattggtgtcgtcgcgtcttcttttcatctacttttgtttcattctattgcatttggactttgtgtcacaaattatattataagtgaggcactaataaaaaatgtgtttttcttggcaccttctttcttttttttcctctagtggataaaattcgaaacacttgtgaaaatataactgaacgcccttgtttaatgatcactagttgtcgtcttaaaacaattgcctgtaaaaatatccccattttcacaagctatcttcctagccaactacttttgaaaatattttgtcaccatcggttctgctacgcaattgcgtgataaataaaacgcttcacggtattaaaaagggttaattggatccatgtcactgcaaatatgacatactaaaaaaataccactactattcttgaaatttgttgcgtgccgctagaatttttaaaaaattagaaccatgtcactctgtagatggatgccaagctgtctcgccagtgacctcgagcctccgccccgatatcaaagacgtcaccgctcgtggatgctgctattgctattcatgcggcccaaagcagagccaccccttgaggcccatgccgcagatgccatggacactaacttcctccttagggttgcggcagctttggcggcgacgaggaagagaagtagaggaaggaccagaaactcttcatccccgggctctcagccgtcacggaagatggcggagggttggccactggcacagcagagggaccgtggtgtgacgtcacagacctttctccgctctagcccaccgccgaggagtagagcgggggggcaccgctgcacggtggaagcatggcgactaggtagagggcggatgttttggacgccgagagggaagaagaggctggagtgctagacttggacgagaacacgagcctgcccagcttctcccgtaggcagtaggcacatatccctccgctagccatcgccaccaccgcttgtagggatgctcgctagcttcgctgcagtactgaatccatccaggcatgctgccactaccgagccatcatcctcatcctcatcatccactcctctctccgcttcagtaaccttctcccccatccttttccttccttcttggtcggatttaccaacagcacaagatccttcttctcttcttgatcccctatgctgcacgacgaacggacgaacaaaccaatctatgcaagacgagagagaaaggatgaaattgaatcggtgatatagcaacaacttggcatctatctctatgacagaaatcatgacggagtggcatggttcaaattttcaaaaatttcaatggcacgcactatgtttcacgaataatactggcattttttttatatatgacatgtttgcaatggcattaatccaattaatcctattaaaaacacgacatataaaaactgccatctctctccaccttatccttatcgcttcactctccccaccgctcatcccttcactccccaccgttcccatctttcttggtctctctttgtcacaccctaattttcgttcgggatcaaaaattattaaatagcgcatatctagaaattatgtaaaagttaattttatcaagtaaattaatgagggaattaaaatttccttttaaaatcatggccgaaaatatttttgcaatatcctttgtgccctaaatattctctgaaatttctcttgaatttttggagctcaagaagtaattttaaataaaacaaagttcattaaatcaattaaattaaattgaaaaccattaaagttctcccaataaaggtgcagtgttaggggtaccccaagacgatgaaaagatggatggaatatttgagagtgatatcatatatggattattagaactctataaccttgaaagttatgtggaaaatagtgaccggaaacaacaccctagtggtgtgaacatggatcaagaatggttttacttaatttaaggcaacagttatagcttccagaaatcatttcaatgcctctcggaagttgactaagaaatcattccatacatgggtcagaaagatacaagggtcaggtccggaaaggtttagccagcagagtgtacgacagagaatccttctcgataaatcatcccaactcaaggtttgaaagtggagttattatgatcaaagagaaagagcagaaactcttgatagcgccaaagtcagtttccaacagtcatacagattgcagtatttgttggaaagcaactttagagcttatagtctatcaacccagaggagtcaataaaggataagcaaagaagtgaaatgttatatcgaggaaataatcttttgagcttgatctattaagtgatcagtgcttatttcaagatatcaactaagcagcccgttcaaccagttgacaccgaagtcagggcagaacagaacagtcatgcagatggaaaggtcaatcaagagtctgtatgttcggaaactgaatgagagtcacttttgtggaacttcctgtcaacaactgatcagtgttatgttccaagccctcttggaatgaaagtgcaccggcatcaccttatttgaactgattgatgaagcgatgagttctccaagtcagggttccaggaaaataaccgaagtttggttattttcaaggatagcagtttaattgatcacggtcaggcaaatgctcaaccacttgttttaagggtaagtctcgaagatgatttttgtcatgccccgtaaccgtttcaattggatgttcagataagcagggaaagaacagttatagctcaaagaagcctattgccaagttaacagatttaaatctaacgtgtacacccgggctgccgtgtcaacagttcagcctacagaagaacagggagaaatcgtaatccaggtgaaatgccgatcaagcaacttcttcaaatacttgtttccgggtcaagagtagttcaaagcaaagtaagcatatgaggattcacgaaagtcagtgcaaaagatgcaccaattccttgtcagcaaagtgagttatcagtttatcaagtatgtcagcactaacagttcagtccaagatcgaaattaaatggcacaagaaactgcattatgccgctctcatgtaaatagtattaatagttagcgtaaataatatgacaatataaattattccttcgtacgttaccatggcataagtgaattagatgtataataaaagaaagaaaaaaacaaaacctatattatgtttgcgaatgatggttgtagacgagtttacatataatagtgacaaagtgatttttgtttgcatgtgatagacattaacattcagtatattaaagtctatgttctatttcacgttataaattaatattttcttcttgcataattataacatattcttcttattgtgtatatgatgagaactggcttcttttaatatactttttacaaataactagttgggtggccctcgcaattgcgcggttagcatccatataaaattatatatattttaatatgttttacttaaaatttattaaatggttatcttgttgtctcaagacattgtaaaaccaaaccttatcatcctcatgtttttaattttattgtttttaaaagtcacactagttgctaccccttacttctgtcatatccttctttgtttgcttgctcgatc

SEQ ID NO: 60180 - DNA, 1065 bp, Oryza sativa
aactcctattgcattcagcagaccagataaacttttcttccttcttcaatagttgtgtcattggcttggcaattttagagaagttctcaatgaaccgacggtaatagcccgcaagtcctaagaaactccgaaccagagtgactgtccttggtggggtccacttggtaaccgactccacatttgctggatccaccgctactccttgagcattcacgatgtgaccgagaaactgaacttccttaagccagaagtcgcacttgctgaacttggcatatagctggtgctcttttaacttttcaagtaccagccggagatgctgctcatgttcttcctcggacttagagtagataagtatgtcatcgatgaaaaccacgacaaacttgtccagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtcgatcttagagaacactgtagctcctttcaactgatcaaacagatcatcaatccttggcaacggatacttgttcttaatagtgacctcattgagtgcgcggtagtcgacgcacatccttttggttttatctttcttttccacaaaaataactggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccaacttcttagtggttttctccactactacctcttgttcttcacccgcagcctggtttaaactgatcactggcttctgcggcactggagactggaaggttaccacttctcctttcacattggtcaacttga

SEQ ID NO: 60181 - DNA, 27690 bp, Oryza sativa
  unsure (1)..(27690): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtctcccgacgtggctgatccccacgggctgggtgacccgggttagtaatgtcgtgtgggtaaagtgtaccccctctgcagaggttaacaaactgttcgaacagccgtgcccacggacatgggcggatgtgaggtgattcctagcgtagttttgtttgtctactgcttgtgaaattgctgttgtgaaaaggggttcgatgtttgaaaaatctgcagctgatgggatcagctaggcccgggtggccgtttggaaagttgttggcccgggtggccgtttgaaaagttgttggcccgggtggccgtttaaaaagctgttggccgggtgccaaccttgttgcaatcctaaagattgacacattgcacatactccgaccggacgagacgcactgtctcatccgtgtcgtttgagaagcactcacttagttgttttcagaaaagagttcaaacaaaatcaattacgaaaacaacagcctttccttgaagcctgcattaaacacttatttcccctgacttgctgagtactcccgtactcacccttgctctatataaataatcccccccagttgctgaagaagatgaagtggatcctgctgacgaggagttcttccaggagcaagtcggctacgatgagttttagggtttcggcctagttcccaagtcgcgcctgtgatgattggttcaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacagccactggccaagaatgctccgcccccgcatcaccccaggtgcgcataataacgactctctctctctctctctctctctatatatatatatatatatatatatatgtgtgaaaatagttctatacaccggggagtacgtacacctgctcccatccaccgtccatccattcaaccagcgatctacccgatcgaacctccccctaacgggtatagttgcattgacccgttaacattttaagtaagatttaatccataattatccagggataatttaactaaccatcgccgattatttctcactaaagcgacacatatctctcgcaatacagacgcgtgggcgtgcggccatggcgcgatccatcggcgattcggccacgacgcgaggcgtggtggctacaggcaatccggcaacgatggcgtggtggttcatcggccgatcggcgtcatgacctgggcacaactggcgtcggaggagatcgtcctcctcgttgttggtaccaatccttgatttctgactgctagatatatattctgattcatggtcgcttctaaatctctgctatcctttcccccttttgcaatgagacaaggatcgtacgagaaccgtatcaatcatggcagaggtttccggccaaaccgtccaacgatggcagctgctcacacggatcctcgatcaacgatggtgtgtctagtcaatgaatcacggcaacaacgtcctgtagaaacacgtactgcaccatgtttatggttatttgatttcaggttcagagctaatatcgatctgccgaaagtcagaggcgacacctaatgcatttgttccaactcccagagaactgaatacattctgaatttttcagcagcatatatatctacctctcggcgtctcggagggggcggcgtgattcagcgatgacgggacggcggcgagattcatccgcagcggcaccaaatccacctcgtcgttccctggtgcggcctttcgttcaacgcgatggtgtcggcgggcgtgcaaaacgaccaccggcggcgccggcaatcagcacgccaggcccaaagattgcagtccaaacatgggcagcgcgaggttctgaggagcagcgacgccgtgcgcggctagtgccagcctctaaagcagaagcggcgtagctggatccaagcggcaacggcgtgtcggcgtcctagcttccagctatgaaccgaaggcctggatggctcatgcaggcagcgacatgatcgagcgatggccacatgcgtcaagcaaggcagcgacggcggattatctaatgatgctgccatgctgtggcctgtggcctgttatatattgcttctctgtaaaatttcttccgatatgtagtagtgaatagatatatatactgcctcctaaaacaaacagtaaaaaacagtatactgctatgcacaaagtagtacatactgctgctttatttgaaggatacactacctgctactgaaagaatcaaagtacattacctgtaaagtggtatatactagtaatgcagtgaatttggtatatatactactatctcgaattagtggtatatatactacctttgtcgaaagaaagtatgtatattgtttcagtgtatacttacagaaatcaatatatactcatttcatgaactcgttctgagttccgagaaaaattcagtctatatactcgttctaagaagaaatcagtatatactcactccgagaaaagttagtatatacttactctgaaaaaagtcagtatatatatcactgttttaaatagcggactaaggcatttagcggttagcttctaaaacggctatagcggcagctatagcgggctaaatggagctatagcagctaaatagtacatgagagcaaatagctagaacccttctcaaagagctataacggaagatttaaaaccctgatatatatactcattatatttggtcattccagtatgcaagtaccaattaagaagaagcaatcagtatatacttattaattccgaattcagtgtgtgtgtgtatacttctgcaatgaaaaaaaaagtagcatatacttgtacatgaaaaattaaaaaaagtatagcacataccagtctataggaaaaacagtatatttgtactccaatgagacatatactgcacgttaacaaaaacagtatatactgcttgatatcctaaacagtatgtacagctttttcaacaaacgggtatatacttctttttatcataggcataaactgccttttatcgtatatactggttttcaatagggtacatatatatgctgcgagtagaaagtaactgctgtacgtacgtacttatgaaatttgaatctaactgcatgcatgcactcgcagttcaaatgtttaccaaaatcaggtgcgtcacctgccgtgcatgcaagcaacatatgaagcaatttgattttcagccggttgaattagatgcaaatggattatccgctaggaagaaggagtatatatatatatatatatatatatatatatatatatattgttgagttgtgatccaaatttatttgcagttaataaaggccagctccggaggtgcgggggcggagctcccacgaaacggatcgtcatcctttttagggttccaccatatatatacctcttgtaagccgccgtgcggcgttgtaacctcacctcagatatagtgaagatattttgctggctaccgcccgtggttttttctctcctgatttggaagggttttccacgttaaatctcgtgtcttctgtgattgatctattgttttttatcgtttgtttgcctatcgttttctaacatagatcacatgctcatttaactgtcaggtctttcttgtgctggaattgccatggatgtgatgtggtgcctagttggatttgttcgtgcgctggatgaaaatgccaacattttgtttcatttggtggatcttttgtatgcaggattagagctattacgccatatagcgtggcgctggtgggagtgacagcatgccctcctcctcgccgctgccgcagccacgaagaactcctcgccgtagggcggtggtgtaggacttgttgtcggagatggtctggttgatggcgaggtagtccgcgatgtgtttgtggccagtgcgccgcatgacattgctcctgcacgacgacgtccccatagttatcgggcggcccgtccggggacacacccaccccgcgccgtgccatggtagtgtccttcgaaggggaagcaaaccaagcagtaggggggaagagagagagcgcaagccctaatttttttttcttctcacttatatgtgggtcccatttatttatttatttttctgattaggatgccacgtcagtaaagatttctaccataggatctactttgcatagctgtatagtttagaagtgaagattatattttttatattggggattaggatgttatacgataggtgaacttattcgttgctacgcaacttccgcgccgcccacgggggatcaggtcctctgcagtaactacaccgtgccattgtcactaggtcggcgtctgtaacagtaatcgtagcacgtaggtacgttcctcttcctgtactcgtgtaaaccagcacagtgccgcatgcagtatgctctgtgcgcgcacgcgacaccgcgtcaaagattccagggttctctgttgcaaccggcacctgcagcagcatcgaccagcaacgtactactagcgcgcatataaccggtgacgactgacgatcggcacgccgcacgcatatctcgcacatcgcatgagttttcaccgcgaaggacggcccgccggggataatttctcccaacttaatcaccacgtaccgcacgaacgtgacggcgcgcgtgggtcggctctcgcgggcggcggctagcgtccgacgagatctcgcgcggtcggccggtacagcatggaggctgggcgtacgccgcatgagcgcgcagcaggggcggatgtgaatgtgatcccgtgcaacgctggccgcctggccggcgccagatcacgacgttggttgcgtgtggctgcggcatcgatcaagtggctaccgtacaagtagtttttactctacttccacggttctaaaatatatactccctccgtcctataatataagagattttgattttttttacttgcactgtttaaccactcgtcttattcaaaaaatttgtgcaaatataaacaacgaaaagttatgcttaaagtactttgtataataaagtaagtcacaaataaaataaataataattttaaatttttttaataagacgaatggtcaaacagtgcaaataaaaagtcaaaatcccttatattatgagacggaggaagtatatatatatatatttaatataataacttattctaaaataaagctattttttcatctatttaaaatcatataatattattactatttatctatttagaatcatatcattatcagggatgaagttaggatttgagatttggggaggataagccacaggaccaaacggccaaagtccgtaacaaccagatacatacagtatctagtgtaacacactataacctccatggctccattgtagctagataattaaccaaaatgtttttagagatagaaaagaaggatcaagtgttcatatagctcctgcagcctccaagacgcaaacatcacataaaccaggctgcatatgttttgccataaaaaaaacgtaactaggcaagcaatcgagagttttcctttctatcttggctgaaattaagataggaaataaaaaaaaatccagtactcaccaatcaactaaatgtatatattatctatgtttctaaattagggacaaatgactaccgtacaaataaaagaaatgagaaaactaaaagtcaagcaattaggatattttgctgtattgggggataatggagaagaaacacacctccgtgctatgtccgatggcgacgtttggtgtgctgcgtgctcaatggctgagatacacgtgatctcgattgaagggtgagtcacaaattatggagaggagctcaccgcgtgcgtcttgtatcactttgccaatggccgctcccatgcatatgatgtgaagttgaaaagataggacgaggattaaggaagaagccgagtcgtcgaatcgctattctctactcgttgatcgttgattctctcgaccggacagatcttggactggaatcttcctaatgggcttcacatggggtcttggcccatatcagataggagggtgccctgcctcctctcccacccatcaattaataacaattgatgtgatatgacttaattaaaagaaaaaaagagaaatataatttagaccatagattaatcatttaagcactaagtgagtatgaactatataagtatatagggtatcataaaacatattaaagatatacattgaaacattatgtgaattatgttggatgataatttaatatgtttgtatttgaaaagctcttaaattataaaaactatatagatatagcatgtttgcatgatgtttaaatgtgatgattgttagtggatgatgatgtggcatcttgttagtggatgatgatgtggcatcttgttagtggataatgatgtggcatctttacatgttaagcttaaggagttagtgggagataactttatagtaagataggatgtgagatataccattttctaccctttaaatattgttggagccatatgaggccactgtatttttatagagaaaattccttacatacccttgaaattttagccgattccttctatgccctgaattttcttcactcccttgtatacctctgaattttgatttggatccttccatacccttgccgtcaattgaccgttagttgaccgtttaataggtatagaaagttagttttacccttcaatatgtgacgaatatgtatcaatttgtaaactatattgtcggaagtatagaatttgttgtgtgattatcatattcataagtttgttgtacataaaaaaattaacatattagaaaagtatgtgtagcattttttaaatgataaatatagttttggaaagcattccaatataatatatacaacaggagaaaatatgttaaactaccataaaaaaagctaaatatactcttttaataagtaaataaatattagttttatgtcattatgtaaaaaataaactttgccatgaataataccttgtaaaataaagtcatcaatataatagtcttatataacaaaattatacacttcaacaatatagctagtctacaatttttagatttccttcacgtctaagggcaaaaaggtcattttcattagaattaaacattcaactagcggtcaactaatggaatgggtataaaagggatcaaagttaaaatttagatgcattcaagggagtagacaaaacttggggggcgtagaagggattggctaaactttaagaggtattaaaggaattttctcattttcatatcgtccaaaatacccctatgtgcattggataagtgagatatgtcattttctatgatgaatgaaacagtatttcattatcttaaaaatagctactccctgctcctgaatagggatcaatcagacgtgtgactgttctaaaaaaaaaatcagacgtgtgactctgtgttgggagagagatgctacgagtaatcgtgtagaccacaggacaagctgtcgatgccgaatatagccagctaactcgccattccctaggcttgaaaatgacaaatcgttcagtccaacgaacacattgccttctgtccatcgtcttcgaattcgggtacttcgaccatctgcctaaactgatgtactaataagcaccctctaattcccattcctgttatattaaaatttgatgagacatggtaaccacaaggctaaacatctatacacacttcacagttaacaattgtcttatgccagataggacaagaaatgaaatttaagcttgtacctatcccaataatttgatgcttagactctgcaacttgcttcccattggatggaactttgcttgcctgataaagttataggagtgtggagtatttcttaggttatataagttgcacccaattattcagaatttgctgttagaaagctacatttctttttggtactcttcagatgtgaccataattgcacgatcattgattttggaacattctgaggctacccgacatggcaataatgttcacgtactgatccatagctaacaccaaatgttatgttgatatgattacatcatgatgtccatattaagcactttcaggctcttaacccagacctcagagcatgcatgggttggccccatgttgcccagacgtaacccctccaaaaacctcaattgattggtatgtgtcgacatctccatagaatgtgaccataattaatgtccttgatgtgtaagttgtgaccaaattagaatcttgggcttagttacattcggaattaatgggttatcagataatcgtttagtatactcagatttgaagaattaagtaagaaggatgattttcccaacatagcaccacctctgaagttgaaaaactagtaaaagattttaagagacattatagctgttagaatatctccaagctaggccacaaatactggaggaatagcccctgatggcctgatccatatcaggattccactctctttcaatgccaaaaaaatcgacacagaacaagaagggaaacacttctgctggacaaggaaaaaaatagggttaattggatccacacaactacaaatatgctaaattagaaaaatatcactcctattcgcgatatcggctgccactgaaattttggaaaattggatctatgtcactccgtcgcgtttttcatccactgtccattaatttcctaactccatgccgttttccaactccggtcgagcggtggcgaatgagctcggcgggtacgcatctaccagcctcgccaccctgcaggtggccgtcgtgcctcctacgctagccttgccgccctcgcggaggaatccgcgcacaaggcggagcatgaaggggacgtccagcctcgcgtcgggcgggtcgcagctgtagcggaacgctgggatcatgacggcgccgagcgacgcctggtctagccgccacgccgcgcgcgcgtcgaggtcggcgaggagcgtcgcgtcgggcccggccatgctcctggcgtggagaagctgaagcaggaagtcgcacttgacgcccttgcagagagtgctgtagtggtccaggcaaacgaagacccgaaggtctggccggcgcgccgccgcggccttgacgcagctgagcacgacgtcggtgagcgccatcccgtcgtgcgcatcgtccaccacgacggcgccttagcgggtgaggagcaggtcggcggcgagctcgtggaggtgtacttgacgactgtgtcggcgtccgaggagcggtcatcgagggcgatggagtaccccacctagcgttcgagctcgacgcgcatgtcggccgcggcgtgggtcgcctcgagcacagcggcgaggctggtacgtctgggagaagacgacgcagccgtggccggtggcatggagcaggcacgggatctggctgctcttacctcttgccccgacccctcacatcgacagcctcatcggcaatggcacctccgccaccgggagagggccttcgatccgccgccaccgccgccaatgtcaatctcgcctcctccccttacttggccgaatgacggaatgcgtcgacggggctcggagaacgcggcggctccggcgactccgccgctctgcctttgccgttcactgtccgccgcccacgacgccagccttcgtgcctcacctcctggaaaaagtgacgggaaggatggaaagagtgacggaaaggacggaaaacctgatggagtggcgtggattcaatttctcaaactttcagttgcacctagcctagctgatatcgcgaatagtagtggtattttttctattttgccatatttgcagtaatatggatccaattgaaaaaaaaaatgctgccagtagcaacagtactttcacggccttaaagttaaaacttgcacacactgttggtctgttgctcattcaatcgtttgcatgccctgcaatcctgataccctgctgttgctcatgatcagtcagttgctcccgagacgcaacaacactgttgctgctgctgcatgaatgcatcgatcatgtagcctgcacgagcagcgaaggcagccaaatttatgctttttttttccctgagaacagtgcaaacgagagctaccggctacttgtgtggtagggcaaatagtggtgtgatcagtactctccatggcaggcgaactggcggaggctgggctcgccatgccgctctcaccttggctgactgcgctacggctagattcagccaaactgcacactgcttcgcgagttcgcgtgacggcccgggctgccacgagaacacactccgcggcgtggatttctacgggtctctgccgattttctgcagagtcgtggcgctagctagatcactgcctcactggcaagcaaagcaacaacacagtggtatgtgcatggctccaaataaccaaccgctgtaccgcccagtgcccactatggtctacttgattctaccggcaaattcttgagggcatctcgatcgatcacataccggagagtgctaggcacatgggttgcaatttatacctgtgatcaacgtggcggtcgtacgtgcatcaccaaccacaatatatgtgccgtgcgtcagtgtgtgtttgcatagggaataacaggaacttgggagttctatatgctcggtctggttttaaaatgtccattcagtgaagcaatggataaaataattttttcaaactaataattgcacatgggaaataaagacatcttgggatgtgtccaatcaagatttttaaatttaagagagaaaatttattatggagtattacctccgtcctaaactgttactacttcgtctgtttcaaaataagtacacatagtacatgatgtgatatatcataatactataaatttggacaaatatctctactaatgatagcaaataattttgacaaaaaatttaatccaatcctctttttttctatagaaaagtgtgagaataatttcacggagttcgtgatgtaaagttcctatatttcaaagaaaccataaggggcgtaggattttcaaagcatttagctcaagtccttgaaaacactcataactcttccattccaaagaagagtttgatcaaagtgtggcatggtgcttttaaaatccccttaggaacaaacaatactcactccatccaaatatatttatacgagaatgctaaagaaagtttcccttccaacgcatgtgcacggtatccgacatccgctatcgcgcctaccacccacgtgcacgcttctgttcctcttcctgttcgctaccccaccatgatcatcgatatcatcgttgttttctcgttgcgaagaccacaacaccacatagtcccgttggtgctaacctcctctcttgcggtggtgcccttgccacccttccccttccacaacttgatcattgttgccatcccgacctcgccgtttggtcaagtgccaccacaaaggccatggcgagcgaccagccgccgtcgacgttggctgcatcacaagctaaaacatgtactccatgccgaccgccttcttggactagacctacgccatctttgcctgatggcaaacacgagttgtcgatccacctcgctagcgaacacgagccatctcttctcctgcaggctaagcctcttgcggtggatggtgagggcctatcaccatgaggtctacccacctgcgcccctaccgctcaattccacagttgacgagctagatccagatgagtgaggttgtgagtttcatagatggtggcgttggagcacaaagcgttgtcgttggcaccattagggtaccgggtctagtacccacctgatatcatcttgttctagaatagattaggattcagcatgataaggtgtatttcatttcattatgataaggttttgaccaacaaatattagaatattttttacacaaatttgatgtcactatatttgtactcgaattaagtacttactattattcttcttttgtattacataaataatatattaacggaataactgccaatcaaagctttatcctaatgaactattgaaacaccatacttcttgtatttggacgggcggtaattcacagtccaatgataaaacaatccactgatatttttgttccaaaaaactttaaaacggttggaactcggaaatgataaaaaaaggataaatattcttcatcatcttagccatgctgggccgggtttttgcaggcccgtccgaggctcggtaaaagttccgttacctttttgggcgacaaaagtacgtcttaccccacacgaccaaattatggcctaatcacaccaaaatccactcccttccaaaccctcccatcaatcactcctatagtatactcgtactatactacactctcatctccccctgctcgttgtcatgctctcccattccatggctccatccatttcgattcccaaacagccgcagctagagctagagctgagctaagctagctatttcacgtgtccatcgagccaaagccaacctgttgctacaaggtgagctgctgccgcctacaacaaccgcgcgctatccaatggaggaaacctagcttcttcttgatccacagtttgttttgtgcgtgcaaaaggtgtctcgttgagaggtgagatcctgcggaggcatggcactggaggccgtgctgctctcgcgtggtgatctgtttggtcgtcgtcgttgcgccatggaaggaggaggaggtggttggagcagcccgttcagtggcttcgagggagtgatggatttggacggcggcaactgggacgccgccgcgtgctcatcgatgcttctgcatggcttccaggagctagagatccctgcggccgccgctgctgctgctgccatggcgccgccgccgccgccggtagagcctgctaattgcgcggagaatgcaggaggggttggtggtcatcaggaggatcaggctgcggtggcggcagcggcgacggcggtgcagtcggggaggaggaagcggcggcgggcgagggcggcgaagaacaaggaggaggtggagagccagcggatgacccacattgccgtcgagcgcaaccgccggaagcagatgaacgagtacctcgccgtgctccgctccctcatgccgccgtcctacgcgcaaagggtaacacagctagcttgctagctcacctcactgccggtcattccacggcttcgcctcgccggccggccgccggccgccggccgtactgcttttgagttttgatttatcttgcatttgcatggcgttctctcttcatgcatgtactgcttatgtgcgcagggtgatcaggcgtccatcgtcggcggcgcaatcaacttcgtcaaggagctggagcagctgctccagtcgctggaggcgcggaagagttcccggcaatgcgcggcccacgacgcggcggcagcggcggcgccgttcgccagcttcttcaccttcccgcagtactcgatgagcgccgccgccgccgcggcgccggtggctcccgttgtgaacgagttgcacggccgtgacgacggcggagcaggcaccgccgaggccgaggcgtcagggtcgaagccgtcggcggtggccgacgtcgaggtgaccatggtggagagccacgccaacctgcgggtgctgtcacggcggcggccgaggcagctgctccggctggtggtggcgctgcagggccaccggctcaccgtgctccacctcaacatgaccagcgccggccacatggttctctactcgttcagcctcaaggtaaaaaaaaaatccaagtacgactactacaaatctacaatctactacgcattcctcacatctagtaccattactaaacaatttgatctgattgcaaactaaacatatgtgtggctctcaatccaagatgcatagtacctatatctggttagcaatatcacactgaaacaagttgttggtgcctaggtttccgtgcattttgtatcttgctttgtcttgcacaactgctccaaattcccccatctgtttactttaatggagctcagctggagtagctaaaaggttgcggttccctaaaaaagggccattgtttgacctgccaatggatcgtcatctcaagtgatctcgtcgtcaatggcaggtggaggatgattgccagcttacgtctgtggatgagattgcaaccgccgctcatcagatcattgagaagattcaagaagagcagggctgtagtttagattagcaattagcataccaaccaactacgtttactagcatgtatgaatgatgatgattagttgttctagcaagtgaagccacttccttgtgcaaactaatattattgtgcctttatgtacttagcagtttcattaatcattagtgttgaatcatttcataataatggactgatttgttcatatgtggagtgtgcaagtgaaacgcatgcatggttagctgtgtacgttacgtttgaaaataaaactacgaatacttatatgctctagctagagaacaattgcatagtagacatgacacatgacattccttgtgggtgctaccatgttccttaggacctgacacaattgacaggagctatttcaataccttcttgcgaggattctgtttcccttgtgaagcaccaattactgccaaaataccaaagattccccatcttgtggccacacagcttgcccgttactttcctgaacgttcattctgctcctccatcctgtgatcaaccaagtgaagttcatgcaaatagccaaaaagccctctctaaaaatagttcttcggtttattctgctgtgtataccgaaattctaaatattacgagaagttcagataccatgtaaaggaatagaagcccaacaaaagaaaatgctcaatcaggcctttagttgggcacttgaaagtgatgggtttaaaaagtttcagtgtaccataatcagttcgttacaataaacaagatagaagcctttaaaggaaagcacaaacatgaacatcaaatcagcaaagcaaagcaaaacgataccaagaaaacgataagaaagaaatgaaaataggacgcaagctgtgtcctctcattgacccaagaaaagattctacaacagggtcctttacctgattgaccttttaccgtttctatctaagcatgattgatcaaatagtgaaagagctgcacagccatttcacctatgtgatgcttgcaccctgattgattcgaccgacaggacaaaacacatgtgccacttgctctcatgctgcatgtcgttttcgctcttcaaatgttctgctccatcgaagcatcatctggtaaaataaagaagtggagccacctgagagaaaagaaaaggataaacagcaacgtcagtgtggagttaacttcatgcaccaaccaatcaccccaaagttcaccaaccaaccgttcgcccaaaaggtcaagttgctagggaaagatgtgcaactctactagtatcacacaagtaaaatgaagaaaaaaagatgggcaactcgatgtgtgcgtataaatgtatctgtgcacgcatgtgagtggccatgaaaatgacagatccgtaaaacaaggaagcaaaccaaagaacacaagatatactggtaggatcatcgagttggaccatgacagataaacttatgcaccttatgcctagacgtatgcataatgcatatttgcatagatggaaggatcgcatctcatacattgattcaatagaatgcaactactttttgcagtatagggacaccaaaaaggataaaaaaaacatggctcaaaatctgcaaaacaggctgtagaccgaaacaagatagttgttacttaagtagaataaccatagcttattataatagtctctgtgacaaccaatctccacagcagacatagcatagatcacaaatctttataaagacctactcctgagggtctataggttagaggcgacttatcttcctattccaggactccataagaataatgacagaaaaacctttatgctccaagttgaacacttgaaccttgaaacaagcaaaagcacggtgtcaggaaatttataatcctctgtgaattgaataatagactataaagtaatatacttcagacagaatttcctaactgactccattcagatgaacctgattcataataaagtggtcccatcaaactaaccacgcatgagatgaaaatgttagtgcttcatcttaataagaaaaaccttcggacagacacctacatgcatgctaatcacaactacagggaaatgcaaaaatgtaattatttagtagtacaaaattatcaggctaagacttctaagcagacaactacattgaattctaaacaagattgatactaaccgtagttgttgaagatatgtaagtagaaccataccgcttgactaaaagttatatgtaacaataaccaagaaattgtagagtcttcccacacctattagcatgtcatacacaacaaataaaaactctaaggttttaactgtacaattaatttttgtgaataaatttattctgaaatgaattgtttgatggaagcagtgcccaaatagcacacaaagatacaccttaagaacaggtttagttggctagagagagagagagagagaaacatctgtgtattaaatggaacggaaagcataaatattttagggggaaaaggagtgctgttcaagtttcaaacagtggaagtctgtcatacatattgaaatatatcagaatagaaaagcgagaaagctaatataacaatgcatgtcgaaacaaatgaatcatgccaacctaaatgggtgcatatgttacactataaaagtacacttttcctgctcatcaaccaaagtagtcagtggacaactggaaaacagcagcgcaaccccatcatgtagcacagaaacaaaaaaaaaaaagacagcttaacagatgcataatttttgtttgcttgcatttttaataaataaccccatttgaacaaagggttgggaacaggaagagatgaaacaatgattgacaaagaagacgtaaaggttgcaacaaagtcaagcataactgcatcagtggatttttcagtggttgcaaaggtagctaaaagaagaaccagcagcagcaactttgatgaagcacgagcgaaaaaaaaaatttggttggtgtgatattttatcaaataagacaattttatctatgcattagctcccaaacaaaaaatggtctactatgcagtctgcacatctatcaatgaagaaatttggaggtacatgagagctgaattatagctgtaaaatgtttgttgcataagcttcaacatattaacaatccaagttccttccagacatgtccattccttaatctgagatctcacccaagcatgttaaaggggcagtaggtagaccatcaagtaaactaacacaggaaattcaaaacacaagtacaatcaatataaagatatttttgttcatctatcagaatagcgaagtaagtggtaaaaaacaattagtcttttagatgtttgatagaaagaatttaacatggttgctcaagtcacatttatatgtgctgcagtgcttaaaagtgaactaaaggtatgattgtagaaggtagttatatattcttaaattcattataatccagaaatatatggattcttaacagaattccttgacagttgggcatattgatatttaccagaatttggaaggtggaatagagctttaagagaagacacatcagaatgttgatatagtgatcccatatcttttcaaaataaaaaagagacattcattgcataaaaaaataacaggggaaaaatatttgttcaacttctttaagcatgaattgacaaacttgatcctcactgaacaggagaggaatgccgagacaaagaacagagatattgcacagaaacacacaacttcactaacatggagaagctgcaacagagagtaaatataaatgtgtgatttttacttttactaaatcatcttaaagcctgcaaagttataaaatgaatagttttagcgatttctactaatgtaatttgttgagacaaaaaaaagagcatagatggttgcaatgctggaaaaaaaaacaattcctttttctaattaaacacaacgtcaagttaatttataactgtcaagttgaatgtctttctttgagataaatacgatttaataagagtaaatttaaatcagtgttttaaccaaatatcgcataagacatttaatgacatagccacagccggtcagctactaaacaaaggccaagagaaactgaaaaaaaaaatggcaactgagtgatacttactgcatctaaatgcagaagttttgcaaaactctgaatcctatgctaaaggctaaactgcacatggagaagcaggagaggagacaatttgaaagttatagcccttttccaacctgacttactcacaaaaatggttagctgatatgctagttctccacaaccactctttgcagtttggcctcccctaaggctgtcatttgctttgtctctaatcccacttttgtacagatttttggtaaagcaattactgtaattcagtgtctcatacaccagcattcaggctatactctgaatcagtaacttagaggttttcttaataggaacttcttgacaggctgactattatggaaacagaggtacaacaaataaaaggataggagtctgattacaaaaacagaatagatcagagccttcaagtgcaatttgtctaatttgaaatgtaatggaacttcttgaaatgcaccttgctttgggctccaaaactgatacttataaagaagcgaggaaagtggaagagctgatatgaggtaccttgatctggtgaatccttcctaaatctgcaggagaagccacagcattactttttagttcatgtatatcctgccaaaaaataaagcctcattcacaaaagctattatatgttagctcattagtgtcgaagtaccaattacgcataatatttcagagcatccacttgataaatatacgtaccaaatttcataacatcgattgataaataaggttagcagatgctgaattactaaccaagccctcatttctatatgtcctcaatgctatccatggtttcatgcaaaagtaaatgtctaataatagcatcagccattgtcagcaaatgttagtttacacagctatagataaattgttttagtgcatgtgctattttcgtaggtgataatccaaccctacttgcattgtgttactccctccgtttcacaatgtaagtcattgtagcatttcccacattcatattgatgttaatgaatctagacatatatatctatctagatttattaacatcgatacgaatgtgggaaatgctagaatgacttacattgtgaaacggaggaagtacatgatatagagagaagacaaacttgagtttgttccttcaaattcactagatcccaagctcaaaactatgatacaggcaacctgggaggtacaaatttacacgagctcatcaactcaagaagtacttatcacctccacagttacaattgtcaactcatttgtctcagaaggagattttctccaagagctacttcagctctctggttatctggtatacgctttctatcaaaagacatgacacactaccagctcccagctttgctgaggctgcaactccctttgacagcaaaatcatgccaactcacagtggtaacacagcactactggagcgcccattccgtgagaagaagaacccctgcccactgctcgacatcgatctgccaatcccaaaccgccctgcctgacaagaggaagaagacgtccctgttgcatccttctctttcacgctgaataacttcatctcttgaccattcggaaattttcgatcaccccgcatggcatcgtcctgcgcttcaggcacaaccaccaggaataacggtgagtccatggacgccgagcgccgtattggcttgggcatcaccctcccaccatcctctggtgaagctgctgtgtcctcactttgagtgtccgaagaggtgtcagaatcctcggagacatcggcacgtgattccgatagcgagatttcatcaaacacctggtgctcttccgcttgcccaccaccctccgcctcaccttcggtagccgtggcggggagatcggagggaacgacgactggggatctgcagagcgggcagttgacgtgtgcgcggagccaggtgtcgatgcaaggcgcatggaacggatgcgagcagcgcgggaggaggcggaccaactccccgtcgcggaactcgccgaggcacaccgcgcagtcccctccccacccaactccggcgcggtactccgcggtggctatggacgtgatggtggcctcgtccagccccaccgtgcggatgtaccacacgtggtgcacatccccgccgccgccccccgcctcctcatccccgtcgccgaacccgtcgtcgccggggagcggcgcggtcgcggcccggcgccggcggcgcaggacgacgcggcggcggtagagcaggatcgtggagacagagagcgagatgaacaggaaggcggagaggagtgagacggtgaggaggaggcgtacggggaggtggtggtcgtcgacggccacgtcgacgcgcgggaccaccggcgacggcggcgggggctcggcgatctcgtagcagctgccgcctgggcagaccgggtggcagtcgagcgggtaggccgagcagtcgacggtggccgtcccgttgacgcggctcggccgctccgggtacaacatggcggcgcggaacacctagcgacgatccggcggtggcagctcggcggcggcgacggcggcgcgcatcggtgtgagtaccccgcggcggcggcggcggcggtggtggtggaattggggtggagacgtggagtggattggtcgttgttgttgggtttggtaaaggtttgggggggaatgcgtggaggtggagctggagagcacacacgctacgagtgccaaaaaattaaagcacagaatgacctaatcttttgtatgcagtcactgatactgtgggtccagattgccaagacacaaattggggcccactactcagtgacaagcaatcggttttgctgtaacgtatggtcgtgcacatagcagcaggcggcgacctcggtttacggaaagtcaaaggcgataatcctaattttgaatggaaacactgcaggcgaaaggaaagctgaaggagttattctcccgtatctgtagaacggcagtagcaagttgaagagatctaccccgttggttttggcatctgacggcctcagttcgttggtgagagaggcagcgagatttcgttagtggccctatttggggccatgacagtgaagtgtcactacttaatactacgagtaatggagaagacgacgactgcacgggttaattatgtggccgacagtggacgactttgtgacgccgccgctgtttagggtaatttttgtccgacggaatcgggttggctctgttaggcaatatatttaatccaaatcctaacgcaatcagtgggagatcaatcgcaaaatcaccatcatcgataagctttttctgaaactttccaccgccaagtatttgatggtctctgaattctccttgcgattttgaaacgacactgctgcgtttgactgggagtactggaccaagaggggaggactaaaatatgacccgggccagcataagaattgctgggccgtcccgaaggagtacgtgccaagtcggcccatcaggcccacgtaaacgggaggtaattaaggtctgcgtcacgaaagcgattgattgatcatcaggtaatcctcatgcgtaaattgtactcgttcctcttcctcctctactactccaagtcgtttttatcgaatttttaatgcggatgactaatcacttcatcagaaacacgatagaacacggcaataacatatgggtcgtttcttccctccgtccacctaccgcttgttcccctaattgatctctccccatggcaaccctcacgctgccggcgaccggagccgccgcgcaacccggccaggaagacccaaggtatgcgttcccttggttgcttatttctaaagaattttacctttaaccaaagttggatgtgaaatcgagtgatttgttggatttgctccgtctcgatgcagcgggatcaagaatcctggcgatggtgcgggagattcgagcggcatcgactccgggtatgtggtctctgagcaagaacagcgctttctcttgcttgatttttggagaattttaggtcaagggcttgtattaagatggttggtttgtgtggtcagatgggttgttctggggaaatctgacatagttccggcggatttggctgccgctgccgctgacgccggccaccgacagcttgggttctcgccgttaccgatgcttccaatttggtaggaattgggggaagaaataccgtattgtactgctgttctgagaaccattgcgattgatatctctcgtatttttctcagggtgcagatggtgcttggaggcgtagtctacacggccgtgccgttctacaatagggccaggaaagccgaaggtgcaattacacaaatccaatacctggttgctttagagtttagacccaatacaactgctaatttgcaaatgttataggagtaaatcatttccccttagctcattaattgtttgtgatcgctttagatccatacaactactaatcttgcaaatggcattggagtaaatcattttcaccatagctcactaattgtttatcagttattcatatcaactaccccttaaatggcatacccatataactctacttgtgttgctatgttagatgaggtgacaaaaaatgtggaaactgcattggaggttgtggagcacgccgcggaggtgacagagaagttagctgctaatgtggccaatgctctaccagagaatggtaccctgcataagttggccgaggaggttgagtacattgctgagatagtggataaggatgcacagaaggttgaaatcatcataaagaaggtatgtatgtcaattgttgtgtatatatatcatcatgtcaaggatatatatattagtaatgagaatgttatgtccacggtacatgattagcatgctttctgtttagatgtagtagaagttacagttagaaacatcatatgcaattacatgtttctgaccatttcagactattgaattggcttttgactaaaggttagtttgttgttgcttgcaaggaaccatggacagattcaattctttttttcagcagcttcataaactatgaattggacagattcaattctttttttcagcagcttcataaactatgaattagacatggctttgggctggggaaagcatatgttcactttgtactgggaaagaaaacaaagagagttggacatggcttctctcgaaacaagctttggtagctcaattataaattttcaagagaactctagcatctagatgagatgaaaaacagcttgcttttgttactgtatacactatacatagtttcttgttgtcattacctgaattatcaatattaaatttgactgtttaccattatcctgttcatgttgcagattgaagatgtcagcaatcggatagacgctgctgtggagcctgtcattgaagagctcgaaaaggaattcaaaccatagccaagcatctggtggatcagaaggcccaaaattattcttgttgtaaatatcgttattttctattttgttctttctaagcatctattgtgtacatatatattgtgatgccctaaaatgaaaccacgccgtagttctagcaagactaggtgatggtgtgttggatgctcgaagctgaagcatcctgtaatctcgttgtaaaatacaactgaagatctaaaacagtatatcggattgaaacttgaaagaacatattcttctgctgttgtttcatgcgtgctaaattactcttttgatgttgctaattattttttccctttgtttgaagggaggccatgaaatattaatcagggttagcacactcaaaattcagactgattggattgtagtaactcgactatcaattgccttgccaccaaaaatctagtccagaaatctttatgtaaactggaagagaagtcaatcagatttattacttcaatattgacattccaagatcatacttctcacctagcttatgaattcaactgctcttctcacttcaaagtttcaggcgaaagagactctgtaatgttttccgtttcagatatgcaaagcatgtctttcaatttgcatgcgtggtacgatcaaatatgttcacatttgtggatggtatatttgacctagagatctggcatgggaacgaaccctctacgacgattagccaagattctcgtttgtctgcctgaaggaaaaactgtcagatgcatcagcttcataaagcttgtcaattcaactcgtctgctcatttaacagtctcagcgtgtctgtcgagtgaaggagacgagaaatgcctaggggtcttccggctagctccacaaggtggtgggctagacgacctggattcaaagcctcacccctcctaattatttgatattaggtccttccctaatattctagtttttcgagtgaaggagactatgccatgtttgtttttctgatatgcacaacagcacaagttgtcttctttttgcggtcaaatgcagtatgactatgagcagacatggttatattatagacttgaaatgtttgcattggtgagtgatgacaggcgacgaggagttcaatctgcactcactattccgccgccagctgccggagcaagagctcgggccacatctcagaatagtgaggtgttattggtgttgacgacgatggtcaaggagggcggtaggaggaggatggccactgaggtggaggaagaggacaaagcgctgctgggatggaaaaacggatctgggagatactaatatttagcccttatgcgtcaagatcatccctcacacggaatccctaggctacgtatctgaagcgcgcaagctcgatctaacagacaaacaagcgaccggttgagagaaatcccatcgatatgagttgcacgtgagagccatctccaacagcctccctaaatctcactctccaaatatctatttatcaagtcaaaatcgttgtttgctccaacagtctttccattcaccctctctactctaggtctatagaaaaaaatggtggaataatttgcatgggacccactagcaataggtggagtgagggagggcatgggcaatggtggagagagaaaagggaaaaagatgatgggcccacagatgtctagttcgtgtggatggccaacggctggccaaatttggctagcttgagcccatctttagccattgctattttttggctagggggatagccattccgttggagtacattttttgtccaaagttgttaaaatttggcttggagagtgggatggggaggctgttggagatgctctaactacgtaagtcgacatctcaacgcacgtaatccacaaccccgttgttaatcctccaataatccaactccctttccgacccaacaaatatgggcgcagctggttagtcgaaacctgttccggcctaactaaaatgggccgcacgtaactccgaataaaggaataagtttatataggtctcttaacttgacggcgcgtttgatcattatcattgaaccttaataccagataccatgaggcattcaactgtcaaaaccggtggacggcacaggaaagccgaaagctatacaagctcctcgccagcctacttcatcatcgccgtcgggcacaccgcatgccgcgcgtcgcgcacggatgcatcgaggtggcggcacgggcatgccacgccattgcccgctgccacaacgctgctatctgacccatcgccgctcctcagggacacctgtgtggtgaggcttgcgtcaccgcacccgcgctctccaacgcgctcaagcgggcgcgtacacgcaccaccgccgcaccggtagcgatggtgtcaagccagatgaccaccacatcggcttcgagatgaagagggatgtgtcgcttacatgtgaagccagagcagctcggcctcacagcttgcgtggtcgctaccaccagtgttgccgccgacgttggcactagcctaccccctttgtcaccctcctcgttggcatggatgccctcgccatccaagtgaagagaaaaagagataggtgaagagagagaggagtaaaaaggccttgacatggtgaggcccacgcttacttaacgctgttgctcgggtcaaattgctacgtcagacaaaccacccgctatattgtcatgggacctatattacaccagttttgatagttaataaacccattgtatatgttattgtggttcaagaatgagtatcgagctcgttgtcaacttaacgtgtgggccccacatgtcaggtctccacgtcaactctctctttcccctcctctctttctctgtttctctcctttctccctccctctcgctctctgctctcgcagggcatggggatgccggcgctagggcgcccacggcggcgcgcgcggccggggttggcgtcgtcggcggcggcgggaaatgggttgtcatcgtcgtcgatgttgtcgaggaggctgaggaggtcgtcggccgtggagatgat

SEQ ID NO: 60182 - DNA, 7706 bp, Oryza sativa
ttttacgaggccaccgagccgctgaccaccgggaaggcgatgttgttgggcgacgctggaggagctcaggcggaggcggcgctggcgccagcgtcggcctcgcccgtcaccgcgtcgtcggccggatctcctctcccgcctcacgcccgttggcctcgtcaggctctccgtcgaagaggttgcggcgaggagggagtcggtagagggggggacgggaggatgtggcggcactcgatctctccgcggcggagagtgcggacgggaggatgcggccagcggaggcggcgtgcgagcgaagcagagtggagcggaagcggaagcgcggcggacggcggtggaggcaggcaacgccccacgcggccgcggcgctgtcatgggcagcccgcctcctcccgcgcgccgccccttctccccgccggtcgccttgtccccatcggctgccggcgccgctccttctcccttccccttgtcccagttggccaccgcgtgccatccttctccccgccggtcgccttgtccccatcggctgccggcgccgctccttctcccttccccttgtcccagttggccatctcgtgccacccttctccccgccggtcgcgccatcctcctcgccggcagccgcccatctgttcgttgtcaacttgcagagaagcgagagagagagatgaggaagggagagaagaggggaaagagggagaggacgctgacgtggacacctgaaatgtggggcccacgtgggtcccgtgttgactcagccgccacgtagaccaacactgggttaaaaccaccgaaagacctctggtgaccggttttgcatagttaagggacaccgtatatctggttattgcggttcgaggatattttttaatcccgatgacaagttgagggaccttcggtgtaccttttccaagtcttaatccacgttcaagggccgcatgcaaccggcccaactattatggtcgatccaaaactacgggtaccaatttaacatgtttctaaggtgtctaactgaaagaatgcccaggagagtccatcgtggccatggaagctcgatcggacggcgcttgtgaacccaattgtgtcttcctccctcccccaccaactcaccatggccgccgccatgtgtcccctaaccgacaccgcgaacggcgaacacccgccggttcgatgaatgaccacctccatgtcttcccttgtcatcgatcgcatcccgtgagaccggcagccagagctcctgccggtcaatttgacaaggcgtgcggcaccggtcggaggccggagatacgcagagtcgtcctctgacgaagacatcgaagtacatccatcgtcagcggaagtacaccgttcgccatggccaccgccccccttacgtcggcgaggttgacggggatcagaaattcagaaccctgtgttacacattgtcctttcgaacccgtacatcttggcgaaagtttcgccgtctccgataagagcgtcagcgagcagccattgctgatgtacatactacacacagatcacaagaatcttggtaacaagtatatctgtactaggggttgcagtggttgcagctgcaccggtgtccgtagagctcgggagtccttatctagcgtcgctgctgtgagccggccgtgatgtcatgtacctgcacccggtggcgttccggcgtgtttgtcctctgcaccactcacccgccggtcagcgcattaggtgaaaccgcgaaagtgaaacagtgctggactactgctagtatgctcgatatccgatcgatcgagctgcccccgtccgcccgtccgtcctgcagagagacacatcaccgtgtgtggaacattcagagagctgcggcaaagctaaccgtagacatcacctaacccatccatggctttgtttgatcgtatctctggcgctttggtatcagttccctgaacagccagcaaagcgtcgttcagctgcgtaacatctccttttcagttttcatttgccgatccgtggatacatggattgcttgtccaaaagcttatttgcagctagaaaaatgtggtatatgttcctatcatggaaaaaataatgcgacgggggtgtgactctgcgtgtactgcacagagggagggaatgctaccagctactgaaacaactttgcacctcctggaagctttgagttgcaccaaaggcattccaattacttttttttttcacatctgagcaaatttatagtggtttttagaaagaatccgatcggaaaaggggattgacaattcgacattggccaactctttatctgtactttgtcacttgacttattctctggccgtgcgtataaatagaccctgcctacaacctccgggcaaatgtgcagcagcaacagtatagctgagattggtcatctgacatccttatctccctctccctccaagtgcctaacccaactcttcccgagcctttttctgatcattggacaaatggccgtctcttcagccgttctcgttgggctactcgtcgtgagttgcgccgcggtggccgcagccacgaggtacaccgtcggcgacggcgagggctggacgaccggcgtcaactacaacaactgggccaacggcaagtttttcagacaaggagacgaactcggtgagcaaagctcagctttctctcatcactaatacatactccatctatcccataaaaaacgaatctagaatcaaatatgacatattttagtattacgaatctagatatatgtatgtctagattcatagtactagtaagtgtcacattcagtactagcttaattttttatgggacagagggagtagtcgcttgcacatatactcacagtctcacacacacctacgtgctgggaaaacacatgtgttggtgcagtgttcaactaccaggcgagggcgcacacggtgacggaggtgagccagaccaacttcgacagctgcaacggcaacagcccgctgagcaacgacaacgggggatcgaccaccatcaggctctcctacccgggcatgcactacttcatctgcaccatccccggccactgcagcagcggcatgaagctcgccgtgaacgtcaacggtgacccgtcgtactctgccgcctcttcgccggcggcggcgagcgctgtcgccgccgcggcagcgggggccctgatcaagctcgcgctgttctgatggccgcggtgcatgcgagccagggtagagacagtgcgtggaagccatgcaggttcttgtcgatcggccgttgcacgttggtgactcgtgcaatgaagctgaccgtgtttcttctcgtttctcgtgtgatttggtcaccgtgcaactcgtatgtagtaatcaccttagtttgttgtggtgattctaaatttgcttgtgccactggtgtatcgtcgtgtctgggggctctggttatgcatgccatggtttgtgttggtgaaatttcttatggtgggtataaataaaaccaagcatgttaaaaacatgctggtggtaatggtatagtcgtggttgtataactataccgaagtttaattacttgacctttgtaatcacagcttgacccctcaactttagcctttgctctctatacttgttccagcagttgaatccctgttgggtgtatacatccaagtgaatgtagaagccagatttttaattcattttctaaaaaaaaattccttgttaggccttgtttgtgtaatcctcagtcacccaactagattaagggggtttcaaggggattagttaattccacactaaatcccctgcaattctatataatccctttcttatgagaataaacgtataaggccttaagaataaatatttccctttactatcctccagcaaatcacactacacgtctttttaccgttggtgttctaaactctcgaagggttatcctcccgttatttgcatgacatccaaatggttatgaatttttttaaaaaaaaatcaacaaaacatattagtatatgataattcactcaacaaacacgcaagttaaaatttaacttctacaagtttcaacgaaaaaacaaattaaactatggctagttaacgtatattcgcaataaaatttgtttttttcgttgcaacttgcacaagttaaatttggtcttatatgtttgtggagttatttaacacttattaaccaagtatcttgttgattttttttcaattttttcataaccatcagaatgacatgcaaacaacgaggtgatagatgtcccctcgcgaatttaaaataggttcctgtgtccataattatatatgcccaagcttgtccaacacacctaagtgccaagttgcaaactatttgtgttctttgaagatattatatttatttttctattatatgaaagacatgatctcaaatgaaatggttccatcgcaatatcgatcagaaatcgtgaaaaccacaccatttttatgaaactgtttgggatcggttttggctgattctcttacagagttaaccaaaaatcatcggattttgcttagttttaagcaaactgacaacgaccggttttcacaccttaaaagaaggcattgcaaaaccctgcgcatgagtgtgcccctaggcccttattctatgcttaactgaggttgaaccagtggcgaatccaggatgcaaaatgagctggggctatgaaaaactcagtatgattgagacaaacaagaactatatcaacaaaaatattttgtaaatataacccaaatatgcaaatgcatgaatgaataagaacacacttctctctatatttcaacttgctgtggctatataaaatatctaaagaaatttatttattaataaataggtacttcatggtctactaagaatgatctataaataaaatatatctgtctttgccagtttggccttggctgcaagaagtagggaagtagcttgccttgccgccggccaatttttcactaattaatgattaattataattgctaatagctgattggatgcagggattggaggtggggctggcgcactaaccagccccaacagtggatccgccactgggttgaacacaagtggattctaatctctcgagtggatgtccactcgtgtatctttttctttaaaattcaatgcaaataattatgaaaaattctgaaaaaaattgacaatatagagtacagtgatatctactagtccaccgaaaatcaagttcaaattcgatctacacatcgagaaaaaaaaagagacaaattcagatataaacagtacgctactattcatacgctgaatttgtcttttttatatctcgacgtgtgagttgaatttggacttaattaagattttgtgaagttgtatatatatgttctatgagtgttgtcaaatgtttccagaattttttataaccgtttaaatggtttttaggcatcccctcgaggaatcaaaatagtttccctaaaattcagaaggaaagcccaaccttcattctttggcaaaaaaaagtatttatgctcgaggaacatattttcgctgttggaagttggcatgcaataaaagagtttgctcaaataatgctgctatgtgaatggtagcaacctagaaccgaacaatgccatgcgaagtgttttgtaagctctctctctctctctctctctctctctctctctatatatatatatatatatatatatatatatatatatatatatatatataatataggacactcatatggggcaccatggtgcccgggcaccatggtatcaaatatacaaaatcacacaaatttttcaaaattttcaaattgtgagtatatacctagttataataactcgattcatacctatacctatcaacaaaacaactcaaatttaactttatttcacaatccatgattacatacctaactaattatatgtatagatgctatatacctaaaatcaaaatctaccaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaactatatatatatatatatatatatatatatatatatatatatatatatggggggggggatctgcatgaggggcgtagtatccattttactgggatttattgcagtaaatatataacttttgtcaggcagtgtagtgtgtagatgctttcctatgctaaataacatcaaagtgattcagaaagagcaaactgtattcaattagatagaagatgtacatgcacagtaaaattccatgttctgcgcatgcatatgtagtccctcataggctcaacacacatggtggctaatataaagataaacttttgaactaaaaaaatcaaatgtcgaagacacccacttgtgccaaaagcaggggtatatatgtaggatttgaacggtagattagtgtcgtactggcctacaacactatcaatttgtcaaatagcaaatcctaatttgaaaaaatgaaaatcgataggttacaagccttacaacctattccctccatccataaaagttagacatgtttcacatttgagtttttgaaataaattgttcctattggtagtctttatatattcaaaacttaaatgaagagataaattaaatgtttgattagaacccaaggagtcatctaaatactcattggttgtatgtttgtatttacttcttgattttataacatctaagattaatttcttcttggtcttgatgacaaaagtaataggtgtaacttctgtgaatgaaaggaatacttactatatagacacacaagcttaaaattctctatgtcgagtaagaaaaagaatgcctatatatgtcgagtgacataagcgttttgcagatagaagaaataattttttttctcaggtgagaataatttgggcggctcatttggggcaaaagtagaatcacagacaaaaagaaaaatcgagggcatgaacgatgaaaggggaaccggtctgttggatgcatacgcgtggttatattagaagtctctaatgctgtctgcaaaaggctcctgcttttcccaatttgccctagattgcctcagagaactcttgtgcttttcgtcatctggcaaacgcttgcatcgccaactctctcaaaagatagggctaagatagaacgtgacgtcaagttacaggggacggaacagaacttcaattcagaagcattaattctgatcaactacgaactgtaagcatgaatcttcattcaggtttgcaaagggaaaaggaaagtagtgtctagtcaggttattgatcattagtcgtaggttcaggtatgaaaaactcgtagcaaatgcaaccatatccatacgctgatatgccagatccttgtacgattactgcgagcgcaataaaagaaataaatggacctaatatagtattaaagcccaaaagaaaggccttgtatagttgtatgaacgctagcctttgtaagcccaccagtgagacatgaaaagaaacaaatatttttaggaagtacctatacatctttcgaaagatttttatgatcgtatcacacggatttttaatctttggattaaaatccgatagatataataaaaagaaaaaagcaattaagaaacaccttaatggacactaaattaccatatcctcaacaaaaaaaccatacccgcatacaaaacttaac

SEQ ID NO: 60183 - DNA, 3624 bp, Oryza sativa
ttcaaaaattacaatgtaatttacaaaagttacagtgcaagtttcataaattacactgtaatttacaagaaaatgcattgtaaatttgagtgagaaaatcgagtgagagataagaaaaaaatctttcgagtgagatatagcaaaattgatatttttacgcatgggacagccgttgtgctcacagctcttgcagtttataaatttacaaagtttatgaccttcaagaaagaaaaattataatgtttatgtataaattctctcttatctctctcccatggatctgatggcgacttaggctgacaagatccatgacggtcaggattcatagtcgatgaatgtgttacctcgccaacgagccgatcgtggtacacaccaactaggcccctcttttctcccctccaccgtgctagttctcttgttcaatcccgtttgatgtgtcacgtttttctagccaccgctactcggaagggaggggtttgtgaagagtatagcctcaccgaatatggtgcttgagccatgtctttgctcgtgttgtatctttgcaagccaggacaaccttgttttttaaagggtgtgtttagttcttttgggtgtaaagtttttaagtatacggatacatatttaaagtattaaacgtagactaataacaaaacaaattacagattccgtctgtaaactgcgagacgaatttatgaagcctaattaatccgtcattagcaaatatttactgtagcattacattgtcaaattatggtgtaattaggcgcaaaagattcatctcgcaatttacatgtaaagtgcgcaattggtttttttccccacatttaatgccccatacatgtgtctaaatatttgatgtgacgttttatgccaaaaatttttaatctaaacaaggcttaaagcactagttttacacactctctctctcctctaaggcagctcaccgcttacgtgaccaagctaaaaccacacatcagactggagcattgtacataccctaacttcaaactagatttttttttattagacaaaggacatccaagatttgtctattcagagaccaacctgatcaccaatttggcaacatttactctgccttttcttgtcaccccttttctggaaaagcgttagtgatagaacctgaaactctgaaagatggttcgcatcagttcccccagtgtctttcagatctctcctggacggccggccatttgtttaccacatcgaaccaccaaaggtaaacacggcctgttaattagtaggcgatgtactgtgagccttaccaccttggatgctcctggcccctctttctcccttcatcgcatcgccacatgggtcacacgttccggacagggcccaccctgaacggcggccgacaggtgggcccctcaatctcacggcagaacggaacatctgctactagctgcacctctcgtcccataaatcccatctcagcttcagaatttcagtgtgttcgtgggtgcaggctgaagaagctagaaaaagggagatctacacgcacagcccggtggtttcgctgaaataatgctcatcacatgctgaaatctctctctccccccccccccccccccctcatcactgagtgagaatgtgagagagatcgtcgtggcggcaggaaagccaattccccaatcagctgcttctttatgtttctttacagctccaaagtcagcaacgcgtgatatgctagctaaggtcaccctgcgttgcgtccgagctgtgtggctagcttaagcaaatgcattacgcttgtaaagcgagcgtacaaggaccgctcgcactaaaaggcgaggagctgtcaggtcacaaaaaaaaaagatggcgtgggtggatcgcattcaggcagccagacaattggcatcattcccctcaacgtcgattagcccatgaattgcaaaaacaagggcattacttagcttggaacgcatgaatttgacggcacagttggatcccggattctaaccgggcagaagccaaagctagtgaaatgatgtatggtattggttgccctgcacagcattcccttcctccgaaatcatttgcgtgatcagtagtgatagtagaaaacagcgatcacgacacacacatggcatggcatgtgcacacgtaccaaggtatcgtcccgtaccatccctttcaccaccaacctggctcgttgagtcgtttgtaccatcgtcgtcggatcacacatctcatcagaccgcgcgctctaccactctgcttccgccgttccgcggctgtgttcgattacacttgtcgtgggtggctaattacagcatggttagttagaagttaacttaaaaaacttaaaacttaattaatatgatttttttcaaccaacatttctataaataacttttaaaagaaagtattcacctcgttttaaaatataagggattttgtttctccatattcatggttttatgatatgtcacatccacctaagttttagaacggagggagtattatttagattgtttggagaatcgtgcgtgtgaaaaactaacgagtactccctccatccctaaataaataaaactatttaggtaaaaatgtgactttagctagtacaaccaaactgaaatcgcattcacatcgattgttttttttggacgtgagtgagtaaaagttagaaaaggagagagaacgaactacctaaacagctgacgaccccgcgttgcatctgctgtgctgctgcttgccgcgccgcacgcagccgtccgtgacgctgcccccccctttgcttgcctacagctaaataaagccgcaagccggcaccgcgcgcaaaccgccgcccgcacgaaaaggacgggagaaaaaacacagcaaaaacaccgggaaacccacgcgcgcgtcgcgtcgcgtccgcctccgctcgcgttgcgcctccgcctctgccgtctgcgggctgtcgctgccgcgaggatcgggcaccaccaccggcacgtgccgcgcgggcctcgcctcgtctcgacatctcgccatcgtgcggcgcccccaccgaccgacccggtgcccgtaatctatcgctgcctttcgctgctccccagctggctagctacaggccttttcacctcacgggatcgacgcagctgagcgaaaatcccaccggaaatgctgtgaaatactgggccagcgtacgtaccaataattcctcttatttttagatgggagtattaaaggagatcgaccagatctggagcacagtgagtgcatcatcagctcagatccatcggtacagcaacggatcgatcggctgcagtacgtgtacataacccaaacgaaaacgggggctcaaagatctgatctgctggtacgatgatgctgcaaggggtaatggagaaagattaaaaaaatggggtgagtgcgcttggggaaaataaaagagagtaaaaagtccaaagtgaaaggaatattgaacaacgggagatgtatagtacaatggaggagcagcacaacaccaacccaaccaaccaatctgtccacgccacacgcccacacacctactgaatcgaatgcctgaatggaaaaaaaatgcccaaaaaaatggaagaaaaaaaagatagagagagaaataaaataaacagctcagggctgcaggaa

SEQ ID NO: 60184 - DNA, 1039 bp, Oryza sativa
gtggtgggggcgtctcctcatccttcatcgcagtagacgccggcggcggcgctggggggaggggtcacctcggcggtgggagacggggccaagcctgccggtgacggggctggtggcgagctgatctccggggtgggagccgcggccgcgggcacgggagccggagccgaggccttgggggcgggagccggagctgaggccttgggggcgggagccggagccgggggaggagtggccggggcctgagccgggggcgctgacaccggcgcaggcgtcggcggcggcgtcgccggaggaggggacgccttgggagcgggcgtcggggtggccgccggggcctgagctgatgcggcggcgaagagcatcgccatggccaaggccacgatctggaagcgcgccattggagtagagtgagagagctagctggtgctagggtttgggaggagagtgtgtgcttggggagaaggtggctactagcttgaggtggtgtactgtaatggtgtccgagacagtagaggtaggggagcttataaagaagtagaactgtaggagatgtggtttactacatgaaaaatacaggtattatcagggggtttagtgctaattttccaacactctccgttggatcggaatttgacggtcgagatgcagttttgttgcagattgtcggtttggattttgcaagcttttaaacctttcttttcctggagacaggaagcttcatccgaatcatcccaagtgtgttacggccccatcgttgggattattgggggtataagccaaacagtatatttacaaataaaaaataatttgtatataaaacttttatatactgtttttagcgatctaaaaacaaaaaacaaagtttaaaaaataaactacgatgaaaaaacatctaaaattaactccaaatctaagattaaaaagtcaaatttaagtataagaaaaagatgaggctggaagctcctcaaaattgtagaaaatctttctcacatgttttctatctcaaaaattgttttatatatttttgcgtgattat

SEQ ID NO: 60185 - DNA, 10509 bp, Oryza sativa
  unsure (1)..(10509): unsure at all n locations
ccagtcatgccgaacaactgttttggcttgatgacgtggtttacctagttagtttaatcctgtttaggacttaagatgctcaaagtgctttcaccaggttaaattatcacgggcaccacctaaccaccaggttttgttgggttaaatttgcttatcaggtttttgacgaatttatataaaaagatgtcctgttcttgcaggtctattacatgttagacctgaacaaaaatgctgaactactgaacttctcaggctgcggtaaaaccatggttcctgtactcgtatactaatttatttgggactttactctatatcaataactgtttttactgcaatctaatactaattctgcttttgcttaagaccttaaaggatgtaatatatctcagttttacctatggacatccaaataccaaattattaattatattttctgttaagcctttatttatacagctttacagctggttacttttaagaaaaatgctatgatttatttctgaaattactgcttgtgtatcttgctgatctaacatgtttaatgactagatacttacatatcacatgatttgttcaaaattttgaaagtgtaattgtttcacttttaagtcttaacggtatgttttggttcaacctagggaatacactgaactgcaaccatcctgttgtcaaggagctcattcttgacagcttgagacactggtatggacaacttgcagctaaaatttttctcataaatccaattgtgtgtagattcatccatatttctttgtttcatcttgactatgtcggcattattcataatcaagtgtcaaaaaatatctatatcgatttgagctttcatgttggtatgatcagaccaagatgatgtatcgacagcctaaaattattcaaaatttcctctaggctatagcacatgcttgtagctatttggcttgtagcaagacagttgatatatgagagatagttcatggctatgtcttattgtgaaccttggaaaacaagatagccagaaactgcaacaaaaacagttatttttatacaaataactgaattatagcatgcatttttattttctctttgacaatggttttgtcatatttcaaatgtcatttctaatctccatgcttgttttaatgcatcaagggttgaggagtatcacatagatggatttcgatttgaccttgcaagtgttctttgtcgtggaccagatggttgtcctcttgatgcacctccactcatcaaggtataatgtagatgcagactttaggtttgaacactaaatatgtatggctgcttaccaagcctgtgcagaccgaattttgtttgtctaaataagtgaatttaatagatttcatgtaaaaacaacccgtacgttacattatatggatgattggatgcaaattatgatgtactgaagtactgaacttccagcaatcaattctaatcaactttgcactattgttgattgttttcttgtttgcatggttttgttcattgaatacatatctagtgcaagctcacaggaatgcaatcatgaaaatttgcaatgtgggcagctatataagatacagtatggactagatgtagggctcttgaggttcatttgaaagtttttttagtgacccccctcaaacgttagaaaattgtatttatgacaaattccaccttttcaagaccatctaaatcctaatccatcaatctctggtcatacaactcacgttgatgtatcgagactagtggcttttatgtttcttcatattaatttatttggttgtaggaaattgccaaagatgctgtattatctagatgtaagatcattgctgaaccttgggattgcggcggcctttatctcgtagggcgtttccctaactgggacaggtgatttgaacacttctatatttctataaaaagaatttggtggtatagatgttttatccttgcttcttttaggactaaagatttggtgatacagtaacacaaaacagtaactattttctgttatggataatatcatgctgagatgctcattcctaaagtacttaacaactgaattcttgaaatgagagaattattgctagtatcacttttctcattggacttggcaaacatgcttcattgtgcggttcagtgacctttccctaccatgcatacacagatcagttattctataatgagtttcatttatttttaaaggtatggtgatcatgtttaacattcctcttgcaggtgggctgaatggaacggcaaatacagagatgatcttcgaagatttattaaggtaatatgccgggagagaagattttttagaaaatacagataagaaaaattgtactcacctgcaatttatggtagagatttcatcatggcagtatatcaggaattactgctgaggaataggattgttatgcccttatgctaatctatcattcccttgcctcatccctttctgccagagtattttaattaaccatgccataggatagttattttactgagcatgttaatgaagtttagcttctcactgtacctatatttagttttaattgtccttgatggtgtatgaacattagcggcaaacttaggttattgtggaacagccaatggctaggaaacatggagattttgttaaatgtttaactagatataggatcagtacccttgcaaaatcagtattttatttaatttaatgggcaattctgaagcatacgatcacagttccgcatattatttgagaaaatggcaacatacttttatgcaatagctctgtaccagttgtgtaaagattaccaggttactgaaacataggggtagaattaggtggctgcagtttcccaaactctgatcttggctatccataactccattcttgagccaaatatttagatgatctccttcagaacttgagcataattttttttaaccatttcaaacatcagtgagttttttcaactgaagatctgaatttactgaacattctgcattttatcagtgcttgcctagcatagccatgagaattcttctgtttgtgttcttttattcttgtttctataataacgaccgaatgactgattggatgctgctaaacatttggagttgtttctcagggtgaccctggtatgaagggggtgtttgcgactcgtgtgtctggatctgctgatctctatcaggtccccctcttttagatgttattttccctttactgttattttttatccatttgcttaggatatcgcttgtttttgaactttgatccccccccacacacacaaaataaataaaataaaaatccatttccaaacaagagcggcttccaaagttattgctaataagtttaggtttaattacatgcttgttacttttgtatcactgttagagcataggtcattatcaacatttagcgtgccccaaattctatcatgtcaattgtgttagttcagtaggatttctccagtatccaattgtttaatggatataaatgtattcagggtctagtgacataccatttgatagtgcaaaacacagtatggtatgatgccacctattatttcattttgtgaggatgtgtaaggaacctctgtggacaaatttttaagaactactgttacactgaaggggttcagactcagttattttttgtcaagaaacaaaaatatgtaaaataaaattcacctgatgtggcaggtgaacgagcggaagccttaccatggtgtaaattttgtgattgcacatgatggatttactttatgtgaccttgtttcttacaacttaaaggtaactggagtaagctaagcagtttagttaagatcatttatttatactgtgaagtgtatgctaatctgccttctttttatcaaaatcatatagcacaatgatgctaatggagaaggtggctgtgatggatgcaatgacaactttagctggaactgtggtgttgaaggtacctgctttaccgaatatctattttcttttgtacattgaaatcatgattccatgaaactgcaaaaagatgcttattttcatatcccatcaaattgatacatctgactgatgtagggtactgtaaagatagaaaacttggtcgagtttattattaaaacaaccctttgtatgaattaaaggtatagtcataaagagaatgacatagtttgattttgttgaaatttagtgtcttgtattgattttgttgaaatttaatgtcttgtaattcaacagaactaaaagattgcccctagtagtgaagcttcaatgtcaagatggatccaaatagctctatgagctgtgcagaactttccaaatgcaaccatagatggctatccctctttgaatcagaaataattatttttagggttaattggatccatgccactgcaaatgtggcaaatcaaaaaaatgccacacatatttgcgttatcggctggatgccactgcaaatttttaaaataagaaccatgccactccatcacgatttccgtccaatccgtcacattttccgccgtctccgtcttcgtcctctcgtcgtcctcgtctcgacggcagcaccagcacggcagtacgaaggcgggcgcggatggcagcacggcgcacggcggcacggcagcacggtggtggatggcagcacggcaccggcgacggtcgtgcccgcgtccgctccccgcgcccctccgcgacctcctcgccgacttcctctctctccaccgttgcagccgtcgtcgttgaccatttccgcggtggacccgccgccgttgacctcatctgcgcgggagagctcgggagccgccgccgccgttgctgtcctcgtcgtggtcgtcgacgagccgcaccgcctccgcccagatctggcgaggagggccgctcgtcgttgctgccgatggaggaggcgtcgagcctcgaactccgccgctgttggccccaagctttgtcactagtgctgccgacgcccatctcctctctccacatgaccatcctcggcagcagctgcgccccctccgcgacctccccgcgaagcgtcctcgtcggcggcggcggcctcgctcgcgaccgtcctcgccggtagtggctatgcccgcgtcccctccacggccgtcctcggcagcagctatgccccctccccgacctccccgcgagcgtcctcgctggcggcggtacgcccgcgcccgcctccgtgaccttcctcggcggcggccatgcccctccgcgnnnnnnnnnnnnnnnnnnnnnnnagatcgatggttgtatgttgattggtttagttagctagctagctagcctcgcgcgctgcatctgtagcagctagctagctactccctgagcttgttgggtgtttctgcctgagctccattccgcgccgaaccccgtcaggcccggccgcgaccgcgccgggctgtcctccgcccgtgccagccgtcgcgccagctccccatcctcttctccgttttgccgcgtgaagccgatgcgttttgtcgcgtgcgcctcatcggcttcgactccggtggttgagctgctcacacgcgtccgggggcagcagaagtgagagagagagagaggaggacggaaatcgtgatggagtggcatggttcttattttaaaaatttgcagtggcatccagccgataacgcgaatatgtgtggcatttttttgatttgccacatttgcagtggcatggatccaattaacccttatttttaacctaatgctatgcgaaatgtttgatgttagaattgatgctcttgttctgtaacaggagaaacaaatgatctgaatgtgttaagtctgcgttcaagacaaatgaaaaacttccatgtagctttaatgatttctcaggtaaacattgtgaagtaacctacagtttattttatgtgtgcatcatgtataaacttatcacataatcaccattttcatatatcagggcaccccaatgatgttgatgggcgatgaatatggtcatacacgttatgggaacaacaatagctatggacatgatacttgcattaataatttccaatgggaacaggttgcattaccgtaactattttagttttcaaccaggaatatgtttatgaatttggcagatctatatataatttgttttctccgaatccatgtgaatatagttggaacaaagaagagatggccatttcaggtttttctcagagatgataaagtttcgtcacagcaacccaatattaagacgagacaggtttcttaataaagtaagtaatacctagaagtgctatcattgcaattaactggtttattgaagacaatcatttcatcatcttctcaaaaaatagctgctggtgtctgtcgaaattccaagtatattttctcagtcaagtctgattagaatagtataatacagcaaatatacactttgcagcttttgcagttgcatctcttagtttttttttcgtctcaaatgttcttcattgtattgtgatcttccttgttggtagaacgatgtcacctggcacgaggattgttgggagaaccaggaaagcaaatttttggcattcacgtaagtttgttgatcactttcgtttatgcaccttattatggtatttgtttatgatgctccaaaatccaaattcttggcttctgactttcattgccattttactgtagagtacatgatcacaactctggtggagatatctatttggcattcaatgcacatgactattttgtggacgctgtaattcccccaccaccacaccataaatgttggaaccgtgtggtatggatacttttcagcattgctaaatttcttacgtatagtaaagtaaattcctacataatcctagcatggtgtggttgtaatttctaaatatgtagaagtgctgccagtactcattctgaattttactacattagacgctcggacaaataccaactcttaaaagaagatatacaagtttccacaaaatttctcaggaatagacataggtagtactgatacagttctacaaccaaaagctgtatacggttgttacttgtgctagcaatcctgctaaaactggtttggagtttattgctcattagctacttttaatttttacaatgattggtctggctggatttgatcactcttttctcacacctttccgctcctattgtcattctaaatctgctctaataatctttttgtaggtggataccaacctggaatcaccaaatgatattgtaccagaaggggtgccatttacaggaccaaaatacagaattgctccatactcttccattctgctcaaggcaaagccttagaaaagttagtagttgagagcataaaaataatgccaccaatgctggcttggttggttaataacaggttgatcacattagcagtctgcacttcaaaaaggcaacaggtatagagaatgtctaataacaactgccgaatcatagttggctttggcagatgaggccacttttggcattcaggaatttcttccagttattactgtaggaatgaatgggctagggcttagggccctctgggggcagcaaagctcgaggtgtcgtctcggtttcatgtgagcgtgacctggctatggtcaccctatcatttatcaaggtcctgtttcgtaataatgtgtcatcaaacactcaactcccatgagaatgtatgccagcatctattttgctggaaattcatgaaaaaaaggaacaatgctattagtcccatgaagtatgaacatatgtcagtgtgtatttcttgcatgatgcagaggctgcgatattctgcgcctgcacctcccggtacgggctgcggcggcaggctcccgactgacggcgaccccggttggtacggagggaaagcttccacatgtgcaacggcggcaagctacagtgttcccaggcaggcacaacctgttctccaatgcagccaagagaagagccagcttcgacttgacaagataacatggccatttgacagagctgggccagccggtgctgctcttaaccaaggcatgtgaaaggttaactcgcctctcctgccaatctcacctgaatatcaagcgcctacagtgcagcctgagccaggtaaaaatccctcctatctcaatcattgtcaaccaccttctatcagctaggttccaaacagaggggaaggaaatgaacggccggtgtacttagctcagctgtcctgttgctgaagggcccagaccctgggggtgggacatactactcctttgcaagctgtgggctgtccttatgatttgctagttatatatgtcgaagggcagccgctttattagtgctaaccaccttttagtttatggagtatggaatttggcaacctctttaggaaaatattcctaatcattcatcaatgaccaaggaaccaccctagtgcataattatgtcagtctggtttcccaactggctttcagggggaatatataagtccttcataatcataccaactgctaaaaactttacactgctagtaataaaattgataacaagctttacacagcttaatttgctggtagaggttgaaccctgtctggtggagcccggcctgaggttttaggctctagaaaatagcttaattaggtaccgagtcaaggtgaagatagtgtggttgatccaaatccagccttgctccctaagttcctcaaaattactaaccggcgccaagcagctgaactcaagctttttcaataagaatttagtgaggtatttgaggtctcaatataccttatgtcagatagctgccaagaaatacaagcaagaaaacataacatatgcccatgcatgtcacaccttcataactccaagtatctagattcggtactattccttttgaaatactcgaaccacccaacgaattggttattcctaaacaagtcatgaaaggaatgacgaacatacggataagatttactatcaacctctcttttcgcgttttgttaggggcacactcacagtcacaattcatcttccgtataatcgagaaagaaaaaacactatgcaaatcactaaatagagcgactcaacatgcttggggataaagatactctagtgacctgtatgctgacctctaccagactctaacatccgccgtccacgcgtcatcgccgaaatattccaactgtaccacaccatatacatacatactacagtcaggacttcatgggcgtacaggccatggacaacatgttggcacaacttatatgatcttgcagagactttgtggttgtcacgtagccggctcggcgccacgaagtcgtacgttcacctggtaggatagttggtacatcggtgtcacgtagcatgcactggacatccctgctggaatattacaccctgggcatagcccacgttgatagaactgatcgaacgaactcgtgcttttgaagatcgatctgctgttcttaatttggttgttaagttggacagattgcgatgtcgatcattccatggacgatattttcggatcattctgaagaatttgttttttagaaggatcataccgaaacatttgtagcaactcatcatgtgcgacaacaataaaattgtgattttgttgtcgaatccggaaggttggaagcgatgccaaattgcgcgtgatgttcgttgctctgaaatgcaaggtttcttgcaacgggcctgcttggaataaggacgaccttacgctgctcaggaatatgaatattgtgatggagtggaagtttaggtttagtatggttaggctggaaatcactgaaattatcttgtggatcaagttgaacattgtgaaagagtagagttttaggttctggaaggatttaggttggaagaaactgaataacactctataccttcccttttttgaaaagcttggatatactatatactttatgggttgagttgagttttgtgtgggagtggaactaaaggttttgggagggttcggttaggttggaaagtggaaacaactgaatttatctttgggatgaagtttttagtattgctaacacaagaaatgttatgaaaataaatacacagcagatacatgattcttttacatgggaaactcttacgaaaaaacaacacgtaccaattagcaatcatcattatttaggagttggttacaaatgcatgaaaataattgtataacaacactcctcccgtacaacatacaagaatatatataaagaaaaaatcaattataattggtaaagatttgaagttctattaaaaaactaatcttgtagtaccactgttgtaagaacacattcttcataaggggaaaaggaactttttaaaatcttggtgaacacaaatgagaatagaagaacttgtaaaccaatcaaggtgcatgtgtcaacttggttaggaaagtacattattgggaaataagtttggtactagcaagatactcaattccttcttttgaaatcttgtaggagtatatgtcggtgtgttttgtgcatcattttgttctctcgaagaaccaaattattttgagagaagggcaataacaatcaatcatctacagattcatcaaataaaaattagaga

SEQ ID NO: 60186 - DNA, 4198 bp, Oryza sativa
agaatgtaacatgttaccgtggaaaggacaagctaaaattacaggttaatctgtaagagattatttcaagttttcaaccaggcttacactccaaatcaactcacgatatggtagtctgaaaaacagaaaagtagttttcctttcgagcgtcaaatttgaaaaatgaattcaaaatttcatagactctatgtcaaaggcataacaactgcttaatatcgtgtagtaaggtcatgaaaaacaagtttgccatatctcgtaagagtatgagacctaaagtatgttgagcaagttcataaaaagatgacagcaaggagatagatgacatgcaacaaaactgccagttgccatagttgagactttaagagaccagaacccacaggtacacatataatcagaaaaagaaaaaccagtaaggtcacaacagttttaggaaaaggtaaagctatacctcccaggaagctttaagcagagaatgacagaagaagcatgctgagagaaaagtgcgaagttcagcccgccttcaacttgagacactcctaatgggaaggctttaccagaggaatatttaaatggcatttcagtatcagacattgtacatcctctttcctgtggttacataattaaaaataaggaaaggagaaggtgaacacaaagttagaaaaacaagacaaaatggcacatcctagaatcagaagcaaaattaaaagagatggcaaaatgtggcatgatccagtttatagatacagaacatgtttgcatggagctgggaacatacaaacataccatgattgtgtcaagcattgcgatccctaaaaacgtacatatggatcaaatcataatataaaggccagcaactgcaagcttggtgagatacctcggtcatgcttctcccagcgttcccgttctgagctctcgccgtggtgcttcgtacagaatcaaatcgcctaacctacaccagccaccaattacgctcggatcattacacccaaatcaacatggaaacgaggcatcgacgcaacagagatagagacacctgccttctcagaacacgctctgagcccagacgcgtccccgaagccgatcgtcgccacacccacactgcactcaggatcaccatgcgcagaatcagaatgccgccgcctcaaaaaccgagggaaaaatgcggaggcgagggagaaacacacgctcaccggttcgtactcgcgacggagcggcgagccgggcggagcgcgatgcctcgacgagctgtcacggcggcggcggaggaggaggaacccagcggggcgcgatttataccaatggaatccatccaaaatggggacggggcggagcgacgggtgggggggagatccgggacggggacacgggtgcctagttatagggcgcgcgctccaagaggctcgcgtcgcgagcggctctcgaagagaggagagtggaggagactggagagagagagaaagagagagagagagagaggcggatgggggaagaggacgagccaacgaggaggaggcggaggagacggtgatctcgcatggggggaagcgcgcggacggacgggagagcgggggtggtgggagtgggacacgcggtggagcggagcggccacggtggacagtggtggatagagaagtggacggacgagacggtttctctctcggtcgcggccatccccatggacgagatgaccgcgagacggtttcaatgtgtcatctcgtcatgcgcttctcgactgcccctccccgtcgcgtgacacgcggttgctgctttacgtgtgagctgggacgtcacctttcccacggaggcggcccatgtactggaggtgcgataaatgggccgtgcccatggttgcgctgcctcttgtacacaggcccaatcctcaaactccccaactcgacaaaatggtgggctgatggggtatgaattttcacgccgatgatgacattataaatagtgtctagaaaatttaagtcatgttagtaaaccaaatttatttacataaaacttttcccttctctctcttaaggcacctttaaatcacatgaatgaaaaaaggaggaatagaaaaaatataggattctgacataaatataagtgtaaaacagaggatttcgaaacacaggaaaaacatatgaatgactgttgaaaaacacaggaatttgaggagagataaagactcaaaggatttcttccatgaggtagaatctcttgttaaaattcctccaaaacttgtatgagaagagacattccataggaattttataggatttcataggattcattcctttgattcaaagggctttgtaggaaaaaatcctatagaaataaaattctctaaaatttctataaatttcctctaaatttcctataaatttcctttgaattaaagggggccttagtaaatttcatgacacgttgtcactttaacatatgtgacattaatgaaaatgatatacatatgacgttgccgttgaccaaagcaacaaagaaagcctcacacggtagatgattcacgccatgataaatcttcgtatacgcttgttagctgtgtttatgccgtaacacggccagatagtaatcagatggcaccatcgtacatatagcaggattcctcatttaatgagattgaaactcttggcataattctagatccaagattttataaagctaggtatttctagttccacaaatccttatatctgaatctactatgtcagtgatacggaaccgggggtatcaagctcagagagagaaggctccccctggtacccacgtggcactcccccgaggtaggacggcggccgccccctccatgccaagggtcgcatgacgccgcatgtgcagggttaggcggacgaccccaatgcttacctgaccacatttaaggtggtgtgagcgggcatgctacgccgcatcaaatacaacgtgtagtgcacctgatcgatctatgactggtctgtgacgagtcgaatgaccgatacgactagggtagtgcgcctgcgcactggttgcatgtcaggtggcacgccgccgcctgacatctcctgtcacatcatgatgatgagaggttgctttgcctctcattacagccagagttgattcatctaacccagccagagcaggattttcgtttcccggtgcaagtaaggacccaaaagtcttcccccattaaatggtgaatgacatgcgtgtccccccatgtcagccaaatagaattgacgggccccatgccgtggcggacgtgcgaatggcttctgaggcaagcaacaagacgtgcatttaacgtgattatcctccctttcccctaggcaaatttataggcccatgtagcagccccttaagatataaaaggaggtccaagcctagtgggggaagagagattggttctttggctaactcacgtttggttctcattggctcaaagcctgaatttcttagtcgatcaatcaagcacaggagtagggcattacacttcttagcggtccaaacttgtataaaccgtttttgtctcatcgctctcgaggggcccgaggccctctacaccacacatctcaccgagttctcgattttcacccgctgccccagccgaactaacaaggggggcctcactgtcccccacttgaggagttcaccctccgatgtactattacatgcatagcaattggataaataaatttgttcttattctagatgaaactttaaattttaaaccactatgaatatacaaacatcaaatataccgtggatttgataactggatctctgtcaaataaggtcaaatgaatcctgcactaggaataaacctatgttaatttcattttgcaatcagtagtagtgttctttttactatgattcccaaccatttttaggtggtcgtatttggtctgtgcgaaaaaggccgaggggagtgaatgcaacaggacacgaagatatggctcgatcaaagagttgaatgcacggcaatcgagtcggctgtatttttctatatttttttccgaactactcccgagatggtcggtgcatgcgttggtaattgtctcaggcgtgttcggtggtggtgttaccttttttaaaaaaagattaatttaattttttaagcaactttcatatagaaactttttgcaaaaaaacgtaccgtttagcagtttgaaaagtgtgcgcgtggaaaatgagcgagatgggttaggaaaaggggcat

SEQ ID NO: 60187 - DNA, 9871 bp, Oryza sativa
aaaatgagatatgtgagttgggaaagttaataaccgaactcaaccgcagtttagtacatagcaaattacaagtttcaaattatccatagtcaattaatatccaatttatacaatatttacctataaatatatattacactattaatactttgtcttacctatcatacacacattgtgtcttaaagtccgtactataagggaatatactatgtttatccaagcacaaactccaagatactgcgtaggactacacgatgaggtgggggagagaagaaagatgagagagaaataatcacctctcatgtaagaggtaacccttacacaaacttcaataagcatgtgagagtgttaaaaatattggggattgtatgataaatataacatattgtatatgttacctcttaatttaatggtatatgttatctatgaaatgagatgtgatagtccattgctcttctcttttatcttttatcttctcgatacgtgtttataactggtttatagtatgctattgtacctggtcttggaccggaatgggcaccttgttttgtgagtgttttttcttttactcatgaactttcatttcttagccaacgtcaaccttgtttttgagactatggccccgtttagttccaaaaaacatcccatcaaaattttggacacctgtatagagcattaaatgtagattaaaagaaaaactaattgcacagttaggggaaaaatcgtgagatgaatcttttgagcctaattagtccatgattagctataagtgttacagtaacccacatgtactaatgacggattaattatgcttaaaagattcgtctcgcggtttccaggtaagttataaaattagttttttcatgcgtgtccgtaaacccctcccgacatccagttaaacgtctaatgtgacatccaaaaattttcatttcgtgaactaaacaagccctatgaatcgtatttttggcaaaatttccaccccactgacgtggtgttgctccgcggccgcgccaaccacgggctttttttttccggtggggagcaatggtttatacgtacacaaccatagtagtaccatgggcttcaaaagtctacttcttgtactcttttttggtcctctattttcatagctcctgatgtaagaatttttagagccggatgtccgtagctctatataaattcataaatttatatctacgattacgttgataatattttgataagttattttatatcatttttaatataattttaaattttaaacaattacaatttaacataaaaacttcaaatccatttgagatctagagttgtgtcaaacaaagccttattttctcctctatatcatattccaattctttttttctaaggggacaagcagggagttagtacaatttactatagaagaagagagttgatccagtttataaggaaaaccggacccaaaaaccttacaacggcatggttaatttatggaaaaccggcgaaaaccccagcattgatatactgaacctaaaactaagaacaacagtccagcaagggataaaactcctaaaacgaagccttcaagaaggacacgccgacagaacgacgacatcgttcgatcctaacgaatctaaggttttcacccggagaaatcccttgatgtggagtttgaacgagggctccaatagcaacgccttcaaaaaggtaaacgtcacccaagggagtcgtcgttggtagcatcggcaagccgagcaaggctttcacctcagagtcccatccaaatatagcgtctgcgtcggaagccaccaaatgccacctgcacacggggtacctgtactatgcacacaaccacctgcacaatggccggacaaacgtcattgatgacctgctcagccacctcgccggactgatggagcaccactaaactgcagagctcgtcggcaccaccggaccatcggcgccacacaggcccacccgtcgtcaccaccgccattgaggtccggtcctcgcccaaccccagcttggacacgtcagatctggacctagagggccagatctagccgttccccatcttgcagcgctgccaccagccagtctctcacgctaggacacgcgggaaactgcggagctcgcccacgtgtagccctcacagtcgtcgctaggcccctcaaagtccggatcacaccagagtcgcgtcagatttggaccttgggaggtcagatctggccgtccccctcaccacctgcccaggagatgttggtggtcgccggcgtgagacgtggaggaggaggaaccaagcccggggccgacgcctccgggaagcctcaaacctagagaagaagggagggaggaaggagaaaggaagaaagagacagggagaaagaggggagagggaggagggcggccctgccgtcgccggccaccaccgcagacggtggcgttgccggcggcggtgaggcagacggggcgtggcggggttggagctgggcgtcggcctttcgcctcccgggtcaccagagaggcgacacgggagtcatgatccaattattccaattctccgtatttcttagttagcacatgacaggaggctttctacaatctaaatttccaatattattcccacacctataagaaaaaatcccattcacacctcacacgattgaataggatttgaaaaccttaaaatgcttataataaagagaatatgacatttaaccaaacacaagacacataccatatgagaaaatttggtgcttgttaacttattagcaatagccaacatgtgattttgactttggatttttttcatcggtctgtttttcagttgtggttttaaaacaataataatataaatatattacccatagatgtttttttcttgctatgtttatttcctcatggttcattagcctgcccagaagcaggaggatgcaaaatggaaggcatcgaatgaaatatgtcatagatgagggtgttccatgcaaaattcccattcccctttttaaatcggtgctgggcttccgccggccgccgccaccaaagtcacgccgaagaagaaccgcgttagggcttcctcccccgccgccggcgagagtgggctttgactcccctcggagccgcctcctcttcgtctcatctccccgcggccttgttcatccccttctacgagccttagcgccgcaccgcaggttggttggtcgcgccagattccccttccgtatcgcgttcaatatcgtatttggcgccaaacgggaagcgcgtctcggctgttctttccgttgcttcgagctaatctctgagctgattttgttaatacggacgcgcaggttccagctcggtggctggagtttaatttttatttgttctccatggcgcttcggttcgaggtttgttgaagttccaaatgggtgcatgttctttcttcgattctagatgatttttccctagtttgcttgtgcgtttgattgctgagatgcgaagcaaactcaacggtttctctggtttgcgcatacgcaaactaggcgtccggctgaagtttgtggtgattaagtggataagatttgtacttctgtctgtagttttagtcgacaagccattacatgtgattttcactctaatcatttttgtctcatacgatcttctgggagtacagattcccaattaagctgatactgttttattttaagattgcgtttagtactctggattagtaactatttagttaaagaaggtagttgaccaatgctgccataggcacgtgccttctcagtgttgtaatttgtcattgcctagctctacactctacagttggtgctacatactgtattcctgttaatcctgtactttgtttgattaaatctcttgagttttctttgtttattacccttcactaaggttaagctaatatacctatagtcctattagtggtccatgtaataggaaaataatagaaaagcatgaatgtgggcatatgtaattgccacgtggcacgtcctgttagagtggcctagtacctctagcactgtcactctgtcagctcatcatggtctttctgtccagcctcatcgtcggtattgtccaactgatggaaggtggctggctgacatagcggtagatcttatatgaggcattgagcataatgacgaaacctgaagtaaaaattattcttgcttgcaggtattaggaagattcaatcgtgctcgtgcagctcgattaacactaccccactttacttgtcagacaccactgtttatgcctgttggaactcaaggtattgtgtctgttgctttaacacttgttcagtctgaagcagagtttttcttgtgtaaaaaaaaaaagaagcagagttttcatgttgtttagttcacagaagttcatgataaatttctcaaaatgtttcttgttctctgaattattgtatctcatagcattttaatttctgttctctctactcaggtacaataaaaggcctgactactgaccagttagaggaaataggttgccagattatacttggaaacacctaccaccttgaacttcgtccaggttctcaacttattgacgacttgggtggccttcacaaatttatgaattggaaaagggcgttgctgactgactctggtggtttccaaatggttgctccaaatcttcatttttttaagacattgaatatctatgtggatcgttataacataaataactaagtcatcaactttaatgttttgccattgtatgtaaataccttctgctgtattagtttaaatacatcactggtaattgtcaagtcttgttgctttgataatgttttcccatgagtaccattttgttatagtgatcccaacaaccagttgctccacacatgaaatctgaattgcacttaatttgatcacttgatgtaaaatacaatgctgatttttaaaagacgagaaacctattgatgctggctttaaaggaaaaaaaatgagatgacaatatcttaaatatcactggtattttttcttaacagcagatttaatcaaatttctgttttatttgaaagaagacagtaattgttcaagatctctatcaacatgagcacatacttgtttccaaagtgcttactcctttccaatgttaatatatattccctgctgaaattttactgatcggaaacatgctttttaggtttctttgctacatttggctgacattactgaggaaggagttacatttcaggtagatttgtgcaggctactttgtgatgcttctttcttttacagatgtcaacttcttgtgcactgatgtttatcatacttccaaatcaaattattcaaatgtgccacagtttataattatttattgataacaatgtccagctgtccatgtgttatcatataataatcaggaggcatgcttgtattactgtggaggtttataagatttttttaatcttcttaaagctgaattgagactgttcaaaactaatggaaaatatactgagcaaggataatatttctgattgtactgggcatcccctgtagtcttgttatttccctgtaaactgctatttattacaatgatgaaccaaaaattcttaagtgaacttgtgagactaatgagaaccacacggttagctgatggttttcgacaaacatataaatatttcttgaatgaacagatatatattgccgtttgatctagcagatgttgcatagtcaagtgttgtggcatggtatcatatcatatctatgatgttagtaatagaagccaattttttttcttggtggttcttttgcttaattatgtgtgtgaggcatcctgtactttcttccttggaattttacaactgctgaaaatgcctccctctctgtatcttttatatattttttttctcttgaccaatcttcagtcacctgttgatgggaagcccatgctcttgacacctgaggaatctatccatattcaggtgcatccttttctagacaagatttgtacttgtaaaagttagagttttgcgccaatagatttggtagttttacatcttatcatgtgtatgcttatccattgaacatgaatgcagaacaacattggagctgatataataatggctcttgatgatgttgtgaagaccacaattactggcccaaggatagaggaagctatgtatcgtacccttcgttggattgataggtgcattgctggtatggttatcaatatgacttgccactgcccgtatttcatacttttctggcgtttaatttcactatttttgtcgttaagttagagcttagcatcattttgattatgactctaattctgctatgtattttactggcgttaagaaaagaacatttacaataatgctaagcatgtttagctaaggtctggtgttttcttttgtcaatacatatagctcataagaaacctgatgtccagaacttatttgggattgtacaaggaggattagatccagttcttaggtgagttcatccatctaatcatgtaatatatcaatcctttaaggcataattgaaataatcaatagtgtttttttttttgtaattccagagatatctgcgtgaagggcttggttgagcggaaccttccagggtatgtcatagtctaatatttctctcaggatttctttccatgggtagcaaatatgtaggcaagttttttacatgcagccaaaaacaaattgtttgtcttttctgtgattgatgcatgatcttcagatgttgtgcctgctttatatgcactctttatttatttgtcggtggatgcacgctatattatctcatatctgatctacaattcaatggctgataccacttaccgtgatattttgttgccagatatgccattggtggtcttgcaggtggtgaagataaagactcgttctggcgtgttgttgcccagtgcactgctggactgcctgaagataaaccacgatatgttatggtatagtttcaaatttctcaaagtactcataaagccaaaagtgatattgtcttctatgattcacaacaatttgaaccatgtagcttccttgggttgtttggctgaccttgctgttatgctaatttgcagggtgttggctatccacttgatattgtagtatgtagtgctttgggtgcagacatgtatgactgtgtttatccaactcgtactgctcgctttgggactgcacttgttcctgaggtatggaacttatctatccatcaaagtcaactatacaattcaagctagagaaaatatttatgtttgatcttcttttcgcactgataactagtgccactaatattttacatggaatgatttgatggtcttagtgatattgaacaatttattccagttagcataatctatgagagtattaacatatggaagcaagctcacaataattttgtttctcttttcctctgagtttgattctaatcttagcatttgcaaccttattgtgatatctcctagggtgttctgaagttgaaacaaaacgcaatggcaactgatgaacgaccgatagatccgacctgtccatgtatggtaaggcttcgttctactgggaacaaagtgttaaactgcttcgaaattttctttttctttttctgtttctatttcgtgttctataacttgactatcttttcaggtctgcaaaaactatacacgtgcttacttgcattgtcttgtcacaaaagatgctatgggttcccaactgctgtcgtatcacaatctatcatttatgatgcgggtatattaatgaatatttccacataacttttctttttaagtgtcaccgcttgatcatccacttttatttcagttaagtagagacctccacatgtcaattctggaaggacgattcccagagtatgttatcatccagctaaattttgtgtcatttgtcagttttctcactgtgttggtgaataagaaagtttccatgccatattgtagattcgtgcgaggattcttgaggatgcaggtatatcttgttccctaatattatatataaactatcagcaccacaagtaaattctgtcattcctgactctgagatgtctaagctgcctccttgataatatgtgctacccattccatctacaaaaccaaaattacaatctgttttgctatttccttgatgattatcttactggctggtcgtttctcaaaccaattggtgacagttcccaaagggcgatgttccgaagtgggttcgcaacgcaatggttgttgctggcattgacatatcggagtgctgcacccccgcgaagtatcctcgtgatgcaatggatgctccgggtactgacatacctgagctcttgcctcctaccaagtgctcctgaggcagagaaccaagaattaagggactaaccttataactgtttaccacgacacgcgcgattggagtgctgtcgcatgaaggtgatcccacttctttaacaaagtcaagttttcacaagaatcttattggtcatcaactcatcataggtgtaggcctcactgcttcatcagcatataattttccccacagtatggtgtaaatatagctgatgggatttgaaccttttgaaaatcacaagggtttgtgatctcatcttttgggaccccagggtttttacgggattgatgcgcgtatatctcaaaaagcctctcatgtcgtctgtagtgtaagctgttgcaaaatgatttctactggttttaatgtagaagcattatctactcattttgttaacgaagaacattctattccatacaagatggcatctcttcttcctatatagttagtacccacagctcgccacgtcattaacgcatattaacagtcagatcttgatcgaatggccttcaaacattgcatgtattcagtttgctgtggcaaaaaaaaaaaaaaaaaaaaaaaaaaaaaaaagccggaacgaacctctccgcccagtgggctgttggcctagcaagtaacagaagaaaatattttcgttctttcttagcagccagtggacgaaagcggcccacttgataaacacgtacttccttcgtccccaaaaaatacttaacctaagtacaagtacttccttcgtccccaaaaaatacttaacctaagtacaacgaatctggacaaagaactaagaactgtctagattcatttagattcgttgtactagtaggggtcacatcctccctggtcacatcccctcctaaggtagagttttttttaggatggagggagtactccacattattttgtcggaaaaaaaaacacgcaaccaatgagtaaaaaaaggaaacacgtgaagattgatcaacaatgtttctcggtaagaattctcaaatcccgctgcaacgcgcggggcatccactagtttttcttgttagtaggcctgaatatgatgtctatttttttgaggaatatggtgacggagtattagtcttgtcactgacaaacgggtccactcctgctggtttaccacattactccctccatctcataagggattttgggtggatgagacatatagacttgttgtactaggatgtgttctatccacacaaaatctctatactaggatgtatcagatccacccaaaaatctttgtgtcatatccacctaaaatttcttatattttgggactctatgtgtcatctccgtcaaaattccttatattttgggatatttttgggactgctgtatgtgtccttatattttgggacttctgtgtgtgtcatatccacctaaaatttcttatattttaagatatttttgggactcctttatgtgttatattaaaatatttttaggactcctttatgtgtcatatttatctaaatttcttatattttgagatggagcaggcctcctgtgactatcccacgagcgctggagcaaggggccacgtgagaattgtggcga

SEQ ID NO: 60188 - DNA, 16960 bp, Oryza sativa
tcgcctcgcaaacacccaacccggaggcggacagcccggcccccgccggcacgaagctcgccccgctcctcgtgtccctcgcggtcggcctcgccgtgcgtttcctcgcgccgcgcccacccgaggtgagcccccaggcgtggcagctcctctccatcttcctctccaccatcgcggggctagtgctgggcccgctccccgtcggcgcctgggctttcctggggctcaccgccgccgtcgccacccacacgctccccttcgccgccgccttctccgccttcaccaacgaggtcatctggctcatcgtcatctccttcttcttcgcgagggggttcgtcaagaccggtctcggcgaccgtatcgccacctacttcgtcaagtggctcgggggcagcacgctggggctgtcctatgggctcaccatcagcgaggcgttcatctcgccggccatgcccagcaccaccgcgagggccggaggcgtgttcctgcccatcatcaagtcgctctcgctctcggcagggagcaagccgaaccacccgtcgtcgcggaagcttggatcctatcttgtgatgtcgcaattccaggtaattaagtgataaaatttctcatactcgcatgggatctgttcatatagatcgattgcaaccaggattttctgatcatagcaaccaaattttggttttagcaagggacgattgctacttgcattgactattactgtgtcctgccgttgggctctgcacaagtggagtgggagtgagaactgggtggcacattggtgcaataagcagaacatccttacctagtaattttgggttgaaatcaggcaaccagctaggccattgtcagatcaacctagtgttttgttagcctgcttacagggtaaattacaatttgatgtattttttaatcataatgccaccattgatgcatgaatggtcgtaatattatgtgactgagttcatcatcaatctagcagaagggtgaaggttttggaaaagagaggattcatctggtcataagacaacgatattttatagtccctctctaatcgaacagtaagaatgcagaatgactttgtgcattttgctttcttaccgtttccattaaacagtaagaatgcagaatgccggttataattctcttgggtttagtaccattgccgtgtttaatgtcatgtggtgtgtcatgcatgatgtttctgtgcatcctatacttctgttattcattgtatacgcatcatcttcagaaatgtttttacagagtatctagttttcttctcctattttttaacaggcagctggtaactcaagtgcgctcttcctaactgctgcagcacaaaatttgttgtgcttgaagctagcagaggagcttggtattatcgttgcaaatccatgggtagcatggttcaaagctgctagtttgccagccattgcttctctactagcaacaccatacttgctatacaaaatatttccccctgaaacaaaggatactcctgatgccccagcattagctgcagagaagcttgagcgcatgggtccagtgactaagaatgaatgggttatgattggtacaatgctccttgcagtttcattatgggtatttgggtaagcttctccactacacatcatcctcaatcttaatattacgttgtcacattaatccaatcttgcagcatttaaatgtttccctttatttgattatattgatataccatagtagagtacttaatagtagcatccttaggctgccttagtgatccttgcagtcccatgaagagtttttgggcaagctcctcctttagtacaagtgctcccacgtataatgttgactttgatatcaatacaatgttgcagtttgtgacataattttctttgttgctttttggttgactaaaactttccatggaatgcagctaattgcctcctgctagcaagatacttaatagttgcatcgttaaaatacttgtgtgatttttcattcatatttgagtagggagcagcttgttccagttagctttcctttccctgtagacaccaggtcaagtattcctgtattaatcacatttcatttcaacttttgattctgatatggttcaccattttttacaagagtctgtcagatttttaaatgttccttaattattagtaggatttttcatataactaacatatgatcttgataacaaatagaaaatgagtgttttttcttttgatgataccatttgctttaatctgtagctgcaactgtcttgcagcttgtagttttttttaaaaaataaaataaaataaaaagaagaaaagctaactccgaccaattcctagtaccaatcctagtttgcatccagatcacctgtgttcctgtacttttagtatgctaaagggtaatatagtgaagacaatagcattatgaatcaggcagttgtttcagaataccgtacatagataatatgcccttactatcatgctcttgtttttttgcatatttattcaactattccctaaatatcatgtaaaatgacttctgtgtagggatgctatcggtgtatctagtgttgttgccgcgatgcttggactctctattcttctcttgctaggtgtgctagactgggatgattgcttaaatgagaaatctgcatgggatacattggcatggtttgcagttctagttggaatggcaggacagctcactaacctgggaattgtgtcatggatgtcaagctgtgttgccaagctgcttgaatccttctcgctgagctggcctgcagccttttgtgttcttgaggcttcctacttcctgattcactatctatttgcaagccaaaccggacatgttggagctttatactcggcatttctggccatgcatgtagcagctggtgttcctcgagtgctgtcagctcttgctttggcattcaacacaaatctgtttggtgcactaactcattatagtagcggacaggctgcagtgtactttggaggtaaattcatgttctacttttctggatttcatttcattattttcatttacaaacgggttaccctaaaaaaaaagagcagaggaagcaaaaacaacatgctataacagataaggcatatagatatagaatgagaaaacctgttatttccttctatgctgttgttccttttatatttggttccataattagtctttccaaattcatattctcactactctgtaatttgttgctttctatctgcagcggggtatcttgagcttccagatgtattcaggatgggtttcgtaacagccttgatcaatattctgatctggggtgttgttggaaccttctggtggaaacttttggggctctattgatagcggctgcctgtaaattgaccaaagttttccattggagctcactgaattcggaagggatgtttcttttgtggcctgtcgatgagagttcaataacagaataactttgttccttcaaaatgatcagctcggccgctcggttagctcagctgtatagtaaatgtaaattagggaactaagagagtaatggaaaatcaggtcaatctgattacctcaatgcgaaattcttagctatgccttcttttaaagaattctgttataaccgttctgtgtctttcctttgcaacgattgaacttgcttagtcagttagtctacagtacgtacacttcagatcatgtccaaagtgattcccccggcggtccaactaggctcaaatgcattgtgggagaagaaatttgaagaggtgtggtctcaatctacgtacgtggcatataggaccccttgtaggagggtcttgcaccgcgaatggtgtgaatggtcttagtgcaaggagcgggtgtttcatcgaggaaagggtgctcctgagaacaacatggggacacgcctatctgaggagacggccgcagcttgtgtatgcgatttccggtatgccatggattcatgtcaaagtaagtgatagggatggtcggatggcaatgacaaatggaggagacgatcgaaggttttggacactgtacgatagctgctacgagggatccagcaggatttggacactgcagacacgacacaccgaatggtttgagccggtgatggtcgtaggcgagaagccggattataggagcacggttgccataatccaatccaactccagttcctactcgtgccctactccatttgtaatgtttttgggcctagaaccaacccaactcaaaataggccctcatgcaaactaccgttgttgggccgagaaaatatgtcgcgccgcagctcccaaaataaatgaaaataacgccattgcttgctttggggtcgaaacaaaaacctattccacctcagcacagttaatcggaaaaagccatatcagtgaccccggcacgtacgtctctccgtcggcgctgaatgctgctgatgcatgcacaccaccacgcacatcacatgtacgatacgctcgcactgttcgagacgaaagcggagccgagccgcatggtcccagcccctcccccctctgctcttggaccacctgatcataaccaactcaaaagcagacgcgcgcagcagcagccaaaccgcgcggtcccgcccctgcgtccgtccgcgtcggcgacccgcccgtccttcgctttctccacggaacgcgacgtcgctcgctcgttcgcttgctgccgccacgcacgcacccgctccccggtccaacctactacccaacccagccgcgcgcgcgcgctggtactgtgttcgttggtgcgtggctgcgagcgcgacgccggcgaaaaatatctcgcccgtccgggtctcgcgcatccaccgcgcccacccgcgcggaaaactacgcggagcgtgatgtcgtcgagaccgacgtgcatggcgatggctggctgccccgaccggggcgtggtttctccacggcttgaatggtacatgtaccgtaattttctctcttctggtgtggctccatgaagttgagatagggtcaatacacaggaccaccgcgatatgcatgcatctcaattcgaacgcaactggcgtcacgctggtcgctgggtagggcggtagggggcacctacgcgctgctctctcgtgttgaccctgtatatgtaggagtagtatgtgccgcagtacatacgcacgagtaacctgacggatggatgccggacgaaggaaaacgcgagcatatatatggaatgcttccgcgctccttttcgcggtgttgaattgacgctaccgaacagtacccaaagtgaaataacttttgctccgatcgatcaatcctcgcttgtacatatatgaccatgaaaaagaaccgagagggagagagagagatacgaacgaccgtgacaactgagaccgagaggtgtcctagctaagcttagctacgccaaatatgtctctccactaccctacactagctctctccaaccgcgttaactgctaatggaaaccgaacgccactctcatgcacgatgctgcacagtctatcgtccgaaagcgtgaaagggaaggaacttttcctccaacttgacagtatggtcgcccttgacaaaagagcttttagcatcctctcgctaacttttcctactcacctgacagagttttattcaggccccaacactgaaccgtgtaaagtttcagtcatctacagtgaaagaaactcacgaaaaaagaactaactctaacagatgaatccatactacagggtttcccaaaccgtcaggaccaggttaccgcacctcggcggtaagcaaggtaaccgtggtaactatgacaaactatacgaaaccgtgtaaaattgatcaaaattttaaattattttttaaatttacttaaatttaaataggttaccgtgatttttcttttaccgtccttcattgtaagtgtgataactacggttatcgcgccgtaacgccaaccctgagttccatagtgggtgaccgggtgaccaaatgaaggccaactcatcgcatcgatcgacgatcgggcaggaagaagagaggagagagaggctacttaaagccgtgagcttttgcgcggatcgccggccagccgggctgtgcgtgtgcatgcatgcaggcacgcacacacgcaagaaagcgaaggaatccgttcgctattcggtggtgggtgcgtgcagtcagtgcgtgtgtggggtttggaccggttgttcggtccgtgcaggcatcgccgagcgccgagctatctagcacagtagtacgtacgtacccggatggatggacgtggagctagaaaaaggtgttcaatatattgggccacaccatgcatcgctttcctagcccgtccggcctagctagatgcaccgcggcacgacgccttttgggggcagcaggtgccgcgctttggctccttgccgagtcgtttccgtggcgtggcccggcacgtccccttcatttcccttccctctcctctcctctctctctctctctctctctctcacacacacacacacactctttctatctctctctcttctctaggtttactagacgattccctgacaggttggaaagagaacacggcagtggactaacgagacgcgacaggggggggaggcccatcggcggtgtgccggtagttcttccggacggacggggtagctaacgtgtgctgaaaaattggggccctggtccttgaatatgtctaaaaaaattcattggatgcatatgtacctgtcatgaataggttcattaatctttacggtaggcaggcatgactgcctctcttagttgactgccctgttggactgtttgtgtcattacgtggagattttagtttacataacgatctttaactggcttgcattcaaaaggtaatttgctagtagctataatgaaggcagacacgatcgaattgtagggcgtgctcggtttagctagctgtgggtgtacaaccgttactacagcttgttaagagtatatatatgatagttaattagagcaaaatgtaattcacttgtattgattatgtgcctttttattttacccacataatttggatatatattgtcacgcgaatctcagtacactacattcactattcaactagtatgatctcatcttttattgttaaatacttcctccgtttcaggttataagactttctagtattatccacattcatatagatgttaatgaatctagacacatatatactagaaagtcttataatataaaacggaggaagtatgatattagagcaactacattcttgagttgtcttctatcccttccacaagtgtttccccgagagctccatgacaatacctagagtttaacctagtcagtcgagtcgatcgactatcatagagagttttatctcgatcattaatcggttttgtctttctcatcaatctattggtctaaccagctcaaccgtgttattatgaaaatgcaaatgaataagccgtaaaaagaaagacaaggcgctacactatatgttaaccacactttactgtagaaggcataactttttcgtaaaccctctcgtgagactaaatttttatatgtgcactggtggagaaaccatctttggtcggttcacccaaattcacaatagtcccggttccattaaaaatcaggactaaaaagtatttttagtgccagtttataactgtaaggggactatatcatctttaatcccggttcgtgtcatcaaccgggactaaagatgatttttagtcccgagtagtaacactaaccgggactaaagatcatctttagtcatgtcagaggatgccagtccctagagttctttagtcccagttgatattaccaaccgggactaaaatcctaactttagtcccggttgttgtttccaaccgggactaaaaatcaaatataccatatatatataatcccttgctgctatcctcaaaaatttctatctcgtattcctcctcctctctcacacacttatccttatcctcttctcagtctctttctattcttctctctcaacacttagccgacgaggagctcgcccccgaagcgcggcggcggggacccgggcgcggttggcggcccgtaccgggaggtggtggcggccgtccgcgcaggaggaggcggcggtggcggccgcccgcggcaggaggtggcggccgcccatgcaggaggaggtggtggccgtcgcccgtggcaggaggcggctggatttttcttgtttttcttttttaataacttgtgattcattggatctagatctgtgttatttaatctgtgatgtatttgtgatctgtgatgtatctgtgattgtgattgtgatgtatttatttttttagaatttgtgatgtttttttctgataatttgtgatgtgaatattatgatttgtgatgttgctatttgatctggggatattgggaccatctcgatttcgatttggaatttgtgattgattttatgattttggagagattggtgtgaaatcaatattcaaaggaacaatgaaaaaaaaactaggactaaccctttaccgggactaaagattctcctctttactcccggttggtgttagactaaagatcgatatttagtcccaggtatttgaaccgggactaaagattgctatctttagtcccagattgttactcccgattgaaaaaccgggactataggggggtttccaaccgggagtaaagagcatttctctaccagtggtgaatcgattgaaatttacaaacatgacccactaaaacataaagcaacgatattttacattacaagttaaaattcctaactctgctgccacttcctttcaccagtccgtttcttcaacatgagcatgaaccgtgtcatgcagtaaatgtaaatggagaaggtgttgaaagaaagttgaggtgctacacaacacgtttaccacccttgtgttaccggagaagaacatgtgtgtggtggaggcccccacaacctttcctcgttgctgttgggttttctccatttcccagtgagatcaccaatcaccttttggtccccggtccttttgttctgtaaggttgttactgtgcccaaaacactgctgctgcactacagtaaaaacccggtcccttctgccggccgggcgccctttcgcatcgagttaaccttaccgctgctatctcaccagcacagtaaaacgcatgtacagaatcgactcagggtgtgtttgaggagaaggggattaaggagattgagaagatacgtaaaatgaggtgagccattaactcatgattaattgagtattaactattttaaatttcaaaaatggattaatatgatttttttaaagcaactttcatatagaaaattttttaaaaaacacaccatttaatactttggaaagtgtgcgcgcggatgtgtattctcactctatcacctaaaacgaacgcagcctcaaatccacttgtttaaaagtcaatacgttagccactactacatgcatgtgtagactgtagagtagtgtatgtcacgcaaaactagctgacaagtgaaagtttgcacggtgaaatatggctatgctccgcgagtagacgcggtcgacgggcgcgcgcggcgcgccggcaacggcgcgaggagaggaggccggggaagaagaaaaaggctagcggccgggggccctgcggctttcagctgctgaccaccgcggaaggggaccaggctctgccccgcgcccggatgtcatcagcgcaggcaggcaggcacacacgcaggcgcaggcgccgtccgcgcgtacaccaccacgtacgtacccgccccccaccacgcggccaggccgcgcctagcccaacccaatccacgtagtacgccggaatgatggcgagatgatatcgaaatatcgatacccttccggttccacgcaaaaaacttcacgcccatcccctcgcgtcgcgtggtaggagcacgtaccgcacttcgcatcgcacacagaaacgcccaaacctgcacgcccaatcgtggaacggaaagcgcgggggtcaccaacttgatccaatgcaaaggtgcgacgatgacgacggcacgcagccgcaaagaaacgaggaagacaggagggggataaagagaaaaaaatcatcaggacgagtgaagtgggcaagttgcgttgcgacgcagcacacagggtattttccccaatcccggtgagcatccgcctgtttccgtttgtcgctgtaagcatgtcacatcattgcgtttgttttcttccggaatctcacggcgtacggttccagacatcccagacgctccacttttgtcttctccggcggcaggcaggaggtcaggaggaggtatagcggacggtgcccaacgccaacaggtgcgtgtactgctactacttgtacgctgcccgtgagagatcgagacgacctgaagggatcatttcacggcaacctgcaccgtgttgttatgcgagtgggactgcgcgaggctgcgactgcgcttgtgtacaactaagtagcagaccctggccgtcactgtttcgtgcattcgtgtatagtacattagtactggatcaagtaagtataccaaatttttattctcgagtcatgcaaatttatgaatcattcagcacatctagctgctaaattacagtctactccaggtctccagcagttgcaaacttgcaatggtgcacaagtgctgcagggcattgggcatacaaaacttgagagctgctaatgagatgggatgataccggttagatattaggtcctgatacctaaccgatatcagacaattcctatcacgtatcaggtgatatctatcagttatcaagcgattcctaccacatataggtgatacttgagaggtatcacgcgctaggtgatacctgtcagatatcaggcgattcctaccacgtataggtgatacttgcaaggtatcaggagccggacaccaaggtattgttgccggtggtcccaccgtccacgtctcacgccggagctcatcaccggtggctgcatcctccaccgtccacgccacatcggagctcggcggcggtggccgagtcctccgtcatccacaccccacgccggagctcatcgacaacggtcacatcctccaccgtccacgccacgtcggagcttgtcgccagcggccgcgtcctccgccatccacgccccacgctggagctagtcgttgatggccgcatcctccaccttccacgccacgtcagagcttgtcgccagtggccgtgtccttgctccgcgtctatccactccgacgacagcaccatccccgactgtcgcgacaacccatgtccatcagctctgacgccaagctcgcgttgctccttaacgcggcacctccctttgattcagcgacggcagccaagccccgcgcatcatcgtcgtcctcagctagcgttagtagctacgcagcgtgacgtagatgctcacgacctacggcgacggacgccacactgtaacctcgaacgaaataggctccgatcaaccacaacggccaccgtgaaacctggttgtttccgcaccattcttatccgaggctccgatcaaccacaacggccaccgtaaaacctggttgtttccgcaccattcttatccgtagccgcatgaggctgggagaggatgaggatcctatcctgaatactagcaagagggagtaaccgtgtaggccatacgatggacctacctacctagatatatataaatataagtttgtctagccatccagcttcagccaacaaattgaccacactccacacctatatcagtggccctacttatacgtgatttattttatccaaataaggccgttaataaaaatatgcaaagtgatggacccaaccgggatcctgattttttctgacctttttataagtgctataccgttttcatctggaatttcggaagaaattaacatgagtatcgtcaacctatcattttttttaaaaaaaaacttaaccacaaaagtattaagtagtacttaattaatactttgaatttttactagtagttgtatatgacgctaatttaaaatgtaaacatactgtgactatccttatgacagtatgttgtttttgaggctttatttcgataatttcgtttcaaaaatagtatactacagcattactgatatcgttattggtgtacgtcccaatttggtttccgagaaaaacggtttgagcattttccttgactattgtcatcccaagatactactatctgcaatcttcttcttttcaagaattctttttaggcaaaatttgttacataacacccaaaaaaatatgtaattagctgtgggacaccgcaaagacgtgaatttgtccgaggacactccaaaaatatggtaatttgcttcagaacattagacgcattaaaatataatattcagtcaatggatgagagagaaagcacgtaaaatgacaattttgcccttgtcttcttcttcctctcgatcttgcccaacttagagtagggcctccacagctttgtcgtgtggagcgcgcatgggcacaggcaccagcggccgatcgcttggaactcctccacgccggcctacgactgggtccgcttcgcctgcgacgctgccaacgccactgtccttggtctccgcctacctggcgtcagcctcatcggattctacctccgggtgctctcccttcgatgcaaccacctcttcggtgatgtcccaggtgacctcttttcccttcctggctctgtcccgcctgacgtcgccaagctcacgggtgctccaacaccttgctcgcacgcttctcgccggagtccttcgccgacaacctccagctctgcggtaagccgctgagccggccatgcgtgcgagtcattcttcctgtccccactaccctctcatgctagcgcaccgacggatagcggtcgttccgtgctagtggccgaaaaaaagaagtggaagaaaaagatgtctggcgcggcggtcgtgaccacaacaacggcgaggagtccgtggcggcgggcgtggcctgtgaccgcactcgcagcagggtacgcacgcaagaggatattcagaagaagaacgagagaagggagaagaagataagagcaaaactgtcattttacgtggtttctctctcatcaattgactagatattatattttaatgtgtccagtgtcctgtagcaaattatcatattttttgaagtgtcctcgagcaaattcacgtctttacgttgtcccacaactaattacacattttttgggtatcctgtagcaaattttgcctttttttataatctagctgatgtaagctacaatttatttgtttaatcttattggaacttataccatttttgcctttcagctgttcctagttttgacaaaggtgattagggtaatgttagggaagcttaaaattctgagaaatatctagtgagaatttgaaaaatgtgggaaactcaacttctagcttattttttagattctacaaatacattctcagaatctggatgaaaatctggactatttaagagagtttatggtaactgaagattctagtagaaactgcagctgttagaagctccccaaacatgccccccatcttattggaccttatgctttttttttttgcaaagaagaaattaatgcctttaactattccaaattttgacaaagtggtcatctattcttcttgtaaatatgtctgaactagttcaacattttactccatgtaccttcatgttgagtggcatgtgtcaaggcctggactcttcagttgttctaatatgattgatgtgatgtggttggttttataggcacataaggccacatatataacttcaaagaaatcaatgaacaaacataaacaaaagacgcatgatcacaaaataactccatggctgaaattctgcaagaaccttttgctagctttacaattgtgaccgtgatcgtacatcacaattcacaaagggcacgaaccaatggaacatccaaggaatccagcttttacgattcatcgttttcgggacgaattctatagtcgcgcagatcgattaaaaaagtccctagtcttttgcgtccagggattcgatggagatttgggaggataaaaaatgcaattaaacagataaaaaaatgaggtgttacgaaagccgctactgctttttccacaacgacaagctcatagaaaacgatttcgggtcgccgtctgcagaaatgggacagagaatcttcggtgattacattaagttacagaacttgctacaagaacaagaataatcctccacccccttgcgttccactgaattccgatgcatacacacacattttaatattctttttgagggaacacacattttaatatcttaagcaactgcaccctcgttacccgccagaatttaattctcttgggacgtatagtgtactcaagttgagattccctcccacacaaaatatactgacttctaatgtttaaaattctatcataaaatataacaatttctcccacttaactcactccttttaacaaatcatcgcgatactttataatttaactagcatggtggcccgtgtagattgcgcggctagcatcattatattttctctcatataatagcatatatgttttctcattatattattcaaatatattaaaatgacatcataattttaaattttgcaataactttacgaaactacaaatgtgtaatattcatattgtattttatatacgtgttagttattaattatttttaacatcaaatattagttatttgtaaattatatatattcctatatggactctagagtcgtcttttaatatttattttttttaatttcgaattttctgtaaattgtatttctatatagactctaggctcttctttcaatattatttatttttatttctgaaattttattatttctaattgtatttatatgttgactctaaactcatctttcaatattctttaatttttaatttcgaattttagttacttctaaattgtattcctatattgactttaaactcttcttcccatgtttttcataatttcgaattttagttatttgtaaattgtatttttatacggactcaaaactctacttttaattttattatgtttattccgaattttagttagttttaaattcctatatggactatatactctacttctaatattccttattttttaattccgaatttctatttctttttcttaattgtatttctatatatggactctataatctactactaatatttcttatttttaattctgaatttctattatttcctaattgtatttctatatggactctatactctatttctaatattccttatttttaattctgaatttcagttatttcctaattgtatttctatatggactctagtctcattttctaatattccttattttttaattccgaatttcaactatttctaaattgtatttctatatgaactctagtgttctcttctaatattccttttttttaattctgaatttcagctatttctaaattgtatttctatatgaactctgccttttctttttctccgattaatgtgagaatttctaggctatgagagcgaatgtggaggctcctttttctatttctttaataatataactagcatggtggcccgcgcagattgcgtggctagcatcattatattttctcacatataatagcatatatgttttctcattatattattcaaatatattaaaatgataacataattttaaattttgcaataactttacaaaactactaatgtgtaatattcatattatattttatatacatgttagttattaattatttttaatatcaaattttagttatttgtaaattatatatattcctatatttctttttttaaaattttgaattttctgtaaattgtatttctatatagactatatgctcttcttctaatattatttatttttatttctgaattttcatattatatttttatacatgttagttattaattatttttaatatcaaattttagttatttataaattatatatattcctatatagactctagactcgtcttttaatatttctttttttaattttaaattttctgtaaattgtatttctatatagactctatgctcttctttcaatattatttcttttatttttctgaatttttattatttctaattataaactcatctttcaatattctttaatttttaattttgaatttcagttacttctaaattgtattcctatattgatcttaaactcttcttcccatgtttttcttaatttcgaattttagttatttgtaaattgtatttttatacagactctaaactctagttttaattttattatgtttattccaaattttagttagttttaaattcctatatggactctatactctacttctaatattccttatttttaattccgaatttctattttttttcttaattgtatttctacatggactctatactctacttctaatattccttatttttaattccaaatttatattatttcctaattgtatttctatatggactctatactctacttctaatattccttatttttaattccgaatttcagatatttcctaattgtatttctatatggactctatactctacttctaatattttttatttttaattcagaattttaattatttcctaattgtatttctatatggactctatactctacttctaatattccacattttttaattccgaatttcagttatttcctaattgtatttgtatatggactctagtctcctcttctaatattccttattttttaattcctaatttcaactatttctaaattatatttctatatggactccgccttttctttttctccgattaatgtgagaatttctaggccatgagagcgaacgtggaggctcctttttatattcctttaataatataatagatagatagatttcaggactgtctacacaacttgtaataaaaatttccatcctaaatcatatgtgtgtacag

SEQ ID NO: 60189 - DNA, 30601 bp, Oryza sativa
tccgataatctaaactcgaaatctatttttatatgcggttgagctgcccgtttgcccaaaagtatctgcaaaaatcgctatttttccatgcgggcggtgcacccgcacgcgaaaactcaattgttgcgtgtggatgcttatgttgtctgcacacaaaaaaaatctagaaaaaaatccccaaaaataaatactcgaaaccttagctaggtgcggtctgccagtaacatcatcgccaactcgtcgtagtatgtcgtcgcttgtcgtctttgccgtcgctgtcaccgattccccgcagctcgtcgtcgtcgtcgccgtcaacgcacctcctcagccggtggatctacgtggggaatggccgccactccgtctttgatgggcctcctccacgggcctccgggcaggcgaggggtgatgccgctcccaccgcaatgggaagagaggagaggggttagaagatgagctcatgtgaggagaggagaggagtgggacaaggagatgataatagaggggtggggagagagtgaggagtggaggaggaaattagatattttagggcccctttgaatcgcaggaatgggaaaaacgaaggaataggaaaaaagaaacacagaatattgataggaatgcaaatgcaaaatagaggattacagaacacagaaaaaacataggaatgactatttgattcggccgcatgaaaaacatacgaaccggatgaaagagatagactcaaaagaaatttttcaataggttagagctcttgctaatttttgctcataatctctatcgaattgtccattccattgaaatttcaaatgataagatatgattcaatcctttcaaaggccttcataagagttttttttgtataggattaaaatcgtccaaaattcctatgtatttcctacaaatcaaagggacttttaatgtggcagacccacttcttaacatacctacttatttttgtatgcgggtatgtcaagaggctcgtctgcgaaaattgatttttgcatgtgggcattttaagaagtcgtatgcaaaaataaaaaagtaggtcgatttttgtaggcatgagtagttacggtctgcctgcattctatagaggccctcgtacacaaaaatcttttctttagtagtgtagaacatacacatttccctaccacgattggtataacaacatatacatgtactccagtgtcctgaaataagttcatctttcactcattccacacataccaataaaaaagaccaatatatctctaatttatcaaatcataacacaattactttacccttgttcaactctaaatgcaattattctctactttcataaactcaggtatatgatagttaaaagtaaaaactttagagatatatgtgagaatctataaacaaacttattataggaaggaggaggcaacaacactggttcacatactcctactctctccgccaaaaaaaagaaatctaggtccggatatgatatattctagtactataaatctggacatatgtatgtccagatttctaatactggaatgtgtcatatttggtactagattggtttttattggacggagaaagtatgtggtttcacctttttttaagggtctgtttggcacagctccagttccagttcaatctctcctagagctagagctcagacaaatagtttcagctccacctaaaataggagcggagttaggtagagtgctatcacaatatgaactacagatgtggagctgaattttagctactccacagctccactctaacccaacttctagagctaaattttaaagttagagctctactaaactgggactaagccacgttaaaatctctctaccatgtgtcgtgcaaacacagctattgttccctcaaatccacacgaaagccactttctcagcacccgacatgtgaggcgtcgtccctcgttgtgggtctgggagctactactcctacaccagtaggggtattaccgcagaatctagggaccaaaccgcaattccgcgaggatttttactgtgcacctgcagctccgcagtcgcgcgctccaccattccccaggaaagctgcgctccgtatcgcttggcttttaccggcacttcccccttttgatgccccgaccaaccgaagcaggcagcagaagcagagcagctgctgccgctgccgctaccatccgcgcgctcttctccacgcctctcgccgggccgcgggccgaaccgttccaccgccgatccgtcgccgaatccgcgcatctctcaccgccaccgcctcgccgtcgcttgcctacgcgcggattagcattcggttggaggagtagttcgtcttggttgccgcctcctagtctcctaccgattcggtgtgagacggtgtgtgcgtgcaagcatgggcgtgaccgaaccttgaccaccgcctcgttccagtcctcgtagggctatataaactttcgaaaatgctatacacacgacggatttgtacgaccatcatacgactagtcgacggcgttatctgtgagcgtgagctgtgattgttgggccttttaaaagcccaactccagccgaagctccatattccgacgtcgattcctcttctcgatattactctatacacatccatgacttttcatcttctacatttcctttctcaccctaaaccctcattctaatccccttcgtctcctatccataccaatcagttaagattaatcagaatttttttttgcggcaaccgcaacagagtattcaggttgaagctaacagaaggtattttaggctctgattttctaggccccatgaacaattctattaatcttttatctcaattcgtttttcaacatctcttgtttttccatgcttgcaaacatatacatggccatatttgatttttcaactgattttggtcataaatatggaaattgaagccatggtgccttgtttttctatcaagtctggtcaatcattttttcttgcatgttatggtttttttaagaggacttgcatgttatggctgtgaaaatatattggtttcatatcctgaaggcctaaactaatctaacatctggagtgaatccttttaatagcaacctaagctatatcgatacatgtctcagccggactagcctctggcctcagtgtatagaaagcacagtacgcaagcaaacaacaacgaggctcagcgacgcgtagtcatatctgacgctgtcattgctcgttttttctgccgtttcagtcgtacatgcgtcggacacatgagttggacgtatagcaaagttgataaactttaggccatgaccaacgcaggaagcacccccaccattggtgagtgaagctaatgcctacgaaaggtgaaaaatccattcgactttggacgctagatcagacgtcgattcagtcgtttttcagtgccgggagtacagtcagtcgtcgtactcgcgctagttcgttcggttgttactggactcaacgcaaagaacggccgcgcctcttcgtactgtcttgcacatgagcatgcaaacgcacgtcacgttaaccctggtcacctcctaaccgcaccaccaccccctctctacctaacccgagcgcccccctctcctctcctctcctctctcttggtctctctcgcctttattaatacacacagggtacagcgcgccgtcttgcgaaaacagaaaggaaaccgagaaagagagagagagagagagaggtagggagggaagaagagtcactccacactccacactctcatcccctggtccctttcttggatcatgagaaaccgcgcaacaaaattgcaattctaggcagcatttggaccggggacttggctacgtggtgtttggccatggatcgcagcgtggaattaagaccggcgaggactcagcgacggaggcacccgcgtcattcctacgcttctgtgcccgtcgtcttctcgcagtgagagagagagagagatcgaccaggcgttcactgaattttactagaactcggcatgaagcgacccggcggtgccggcggcggcggaggcagcccatcgctcgtcacgatggctaattctagtggtaatctttgttctttggttttccttttgtggcaattcattctttggaggtgatggtgtagtgtgatatgtgcgggaaattgagtgttttgtaattgtacatgcgtgttttgattagatgatggatatggaggggttgggatggaggcggagggggacgtggaggaggagatgatggcgtgcggcggcggcggggagaagaagcggcggctgagcgtggagcaggttcgcgcgctggagcggagcttcgaggtggagaacaagcttgagcctgagcggaaggcgcggctggcgcgcgacctcggcctgcagccgcgccaggtcgccgtctggttccagaaccgccgcgcgcggtggaagaccaagcagctcgagcgcgactacgccgcgctccgccattcctacgactccctgcgcctcgatcacgacgcgctccgccgcgacaaggacgccctcctcgccgaggtacgtgccgactgagtcgctgccctgccgtgccgcctgagctgttgctctgcgtgactgcgtcgagcagtcgttcgtttgcgcgcataatgtctgatggcttcttggtcgcgcgaattgtggcagatcaaggagctgaaggcgaagctcggggacgaggaggcggcggcgagcttcacgtcggtgaaggaggagccggcggcctccgacgggccaccggcggcgggatttgggtcgtccgacagcgactcaagcgcggtgctgaacgacgtggacgcggccggcgccgcgcccgcggcgacggacgcgctggctccggaggcgtgcacgtttctcggcgcgccgcccgccgcgggcgcgggcgcgggcgcagcggcggcggcgagccacgaggaggtgttcttccacggcaatttcctcaaggtggaggaggacgagacggggttcctcgacgacgacgagccgtgcggcgggttcttcgccgacgatcagcccccgccgctgtcgtcgtggtgggccgagcccacggagcactggaactgaagcaaatccggcgtaaccgcagccgagagagagagttggaaaacactatgcctgggggaataaagaattctgcaggaaagcagggtcttatctgcaattttgtaaaaaaaatggacctctacgtacttctctagtctcttttgccaattctcgcgcacattagctgtagcactgcagtgtagtaaaatcctactactccattacctctccaatttctagctctcacttccctacttaaactcatctgagctctaatgtaagcatatgccatccaaaatggaccataaatatgtcactagcagtaggatggtaattaggactttttgaggaagtctggctgagcaaggaaggggacgactcaacgaacggcccacggcctgaacagtgtcgctgttcggtgggcccggcggccacgaggagcagccgttggcttcttcctcactgaccgggactctcgcctcgcggacagcgatccgacgacgtcgacctgctttggcttcgcgctttccacggccacggcgccgcctgctccggccgcctccgcgaaagcgtcgttccctttcggaacttggaacaaaagcttgtgatttcaccatggcgatgtgatgggatcagagcacaaccagagtttcccaaaccgccgggactagagttaccgcgccccggcggtaaggacggtaacagcacgaaaccgtgtaaaatttatcattaattattttttaaatttatttgaatttaagaaggttactacggtttttcttttaccttttaccgtacttaacccatgataagcacggtaaccatgctgttatcgggggttttacaaaccctgtgcacaactcccagtagatttcaatactactgcagctggttgtagtaggagtactacgcaggaacaaccggtacggtgagctagttattgtgagccggaacaccagagagtacgacataaactgcctgtgtttacagcagctcgtgcagcgttcagtgccatctgtttcgatgattcgtcagggttgttgtataagctttgctgcttgcatgccattgaagtgcatggagaaggttgatgaatgtgttgcgatgtgttctacttgctactgctactctgctagtggtaggtggtgcagtggaaaactgaaaaaatcatcgatatggttgccggaatattctctcgcgacttttgccttggtgctcctgaccaccgaccacaccgagtggaatattccggtgacgattgttgctgctactgcctggctttgtaattgtagcaggtagaatgtactgcggttgtcggcataattatcggcagagagagtaaaatagactcgctgatctgaacgtcactgcgtttgttcgtttctcgaagcagatcctcccggttctgtaacagcatggagtaataatcagacttactagtaccgtactgtggtttcggcctgctttattcctaaattttttttctagtaacatcacagcgaatttttgtatacatgagcattaaatataaataaaaaaactaactgcacagtttggatagaaatcgcgaaacgaatcttttaaacctaattagtcaataattagctataagtgctacagtaacccacatgtattaatgatggcttaattaggctcaaaagattcgtctcgtggtttccaggcgagttatgaaattagttttttcattcgtgtccgaaaacactttccgacatccggtcaaacgttcgatatgacaaaaaaaatttgcgaagtaaacacacccttctactactagtggtggaaggaacagtgacattttcagtttgctccgcacgaatttgaacctgtcacagtgtcacgtagtacactgtgattgtatcaggcgatcgcgatatactcatctcgttttgcttgttcttcacggagtacgggctttgctatcgcgatagagaagacaaacggggatggaaagtacgagtttggtgaaagctagacgtggtgagcaattcagcagcgacgttcgtgcaacggaccaggtcaagttgtgagatgtacatccggttatactacatctgcaagccggtcatatgttttttaaaaagaaagaaacatttttactggtttcaaggtaccagcattagatttcttgtggcccatgcattttataattggaatattttagatctcggtgcacagaaatatagattagctatgtgaaacctagatggataaacaatcgtgctttgcagtagtattttatagagctcgcgtgaagcacggtcgcatgacgttgaagtgacttccgattaagaacctgaaccaaataaacagtgatataatagtatataaaactattgtggccatgatatacttgtggttgtggccgatcgatataaaattagcaaaaccatacgatatatattttaaggatacagacatgaggactttctgaaccttacaaaagcaacgttatcatagttaaaaggaggtaacagagacggacagattatcctatgctttgtatagtcgagtactgtcagcaatctcctagaatcaggatcattttcagcgaggtttgtggtagtacttcactatccggacgctaatggacggatttttctctcctttttggactgtaagtgtctataacctcttgtactagtcttgctaaacatttcaataaacactcatttacataggaaagtaagtgaactttttgcaaaaacgaaaacttgggtttcttcttgagtaacatgaaagtgacaaaattgagaccgtcaaccagagggacgaggccatgctggcgtgacagcagcctcaacctactagcgaattgggcccccatgaaaaacgtcgacgagacgataaccttttttaatggccgaatcaatgcaggcccagatcgcggaccccatattggaccatggcaattggtatttggtagtccacgtcaggcccggaacctatcaagcggctatccaccacagtgccaggtgggcccgggaggtggtgggtcccacgggcagggagagaccaccggggcagtgcctccgtctcctgtccttttctccgtgcggtgatgtgggctcattggtggtgcgtgggccacggaatctgaaaggcaacgtgacgatcctcggatggaggcccgtcgcctcgtgctcggtgggccgagacgtgccggggattacatggacaagaagcatatatctacgtgactacgtggcagccctaccgtgtgtggtttaacactttaacctttggtttacagcgtgatgaaacggatggtacatacggtatgtcggatcttcaaaatatcgtatggtgtaaggtgcgtgttttaccgctcagtgaaaattactttggccctatttagatccttcaaaatggcaaaagttttaccattttgtagcactttttatcattttggatctaaacactagtagcaaaagttggcaatttggcatttggcatttgctagcccataatagcaaattgtgccaaaaagtgctttgggaccactccctctctctttctctctcactttagtgctagaatggcaaaactttaacatgcatctaaacaccaactagtacttttgcaatgccaaaacttttgccaccaaaatttttgccatttgccatttgccatttcaaatggatctaaacaggccctttaacaaaatgtttcagatgtttgtatcttggagaaaaaaaaattcaatgttcatcacttcgagaaaatgtttcatcgctgggataaaaaagttttcactaggtgtaacacttgaaaactatatattacaacacaaatatatcaatatgttcaatattcattcagaacaaaatggaacatcttaacgcagctaggtgcaacaaaaggaaataatggattacaacatcgtcaaactatataaaaaaaagctacactaccttcttcttctacccaccagagtcgtatctgggccttatcaaggaggtcacaaccaacatcttgttgacatgacaaccggcaaagccgtggagcaaggggcacgggggttcgcatgtctacccacaggaagcagtggtcatgctaccttcttggaactcatggcggtcctcatcgacaagctcctcgatcgtagccaactatcgttgtgcttcgcctcatcgcacttgagccaatggccaagccaccgccatcgctcaatcttccttatccctccgcatctccttctccctttgtagcgtcgtttgtgagatcgttcctagtgacggagctgcgcaagcaaactttagggcaagaggagcacgaggtaacagggaagagaagataagattggaggttgtatggtgatgaaatgcatggagtccctaatgcacccaatattccatcttgtgtcgaatgctcaatcttaaacattttaggatcatttttctaggcaatggaaattgtcgagtatggtaataggaatcttcaaaccagttacgctattattactatttaaatagaatcgaaataacataaatggaaacgatagtgatatcggtaataccggaacataaaaaaagtatcaaggctttgttccgaaattttcgtttttgatattttttatgttagtcaatgtatatatttttacaacgttgtaaaaaatctcatactattttatgaaaaatcttaaatgtttcatgcaaattattaatgaaaatgattcaatttgtgcaccataatgttattccatttgccttaaaaagagagtgagtgtgtaccagccttgcagagggcctataagttgtgttggtttgacgtggaacgtcgatggtgatagtttaacgggtgctaatgccatgcgtcccaaaaaaaaaaaactttaagcaagcaacactgagttcattacttgtagcgggccttcattgatctcacgccaagcgacggcccaaggcaaagtatacaggcccaggggagggaggttgatctcatgggctgagcttaaaatttctcatgctgtgtcaaactgccaattcactcgttggtggtcgacaacttgacatatgctgtctgttttattccccctctataatttggtgacaaactctgtctcaaggtgagataatttttttttcttattatacgtaagatgttttggacactaaggacgtgtttgaataatgggaaatggggggtgggattaggattggaaaatgaatgaagggttaggattaaatataagagggagaatgaatggttagaatttaaagatgggttgaaaatcatttccctttcccatttgcaaaacaccacctaagaagtaagacgccactgtacatgcaaatgacatatgtaagttttgaatgccaagacaagtagacttttcagttcgtgtttgaattatggtttgataagatgataaaaaatgttgaagtgtgcgcaaaattgaacagaatcatgcaataattgatacgcggactggtctgttaagcgcattgggttgcttatcccaatcggcacggcctgtggacccgtaattcttctccgtggaagaattacagagttgtcacgctgaaaaaactgcactagcgaagaaaagcagcgcccacctttgacataaagtttggactttgcactttggacctaccggctttggtatgttctttgctcttcttttcgttttttttaaccctttcctgaattgacttgctctgccttgtttttcttcctagactagattcgtagtggatactggatccatcgcttttgataaagcacacaaaggcagtagccatcttcctcatcctttgatcgcccccactagctttgacgaattggcaaagcaccaaagaaaggaaaaccacacaaaggccctgtttggaggagtagccgagagttattttaagagctatttttttagctcaagaaatagcccttcaatgaaatagcccttgagctgtttggatgcaagagctacttgacctttagtacactttcccaatcataactacccattttctctctttctccactagatcttttgtgcatgtgtcttggtgtggccggctgcatatgccatgctgttgtgctctatcactaggacagtgctctatctcgtatgcttgtagcataaagggagaaaacaataaagttttttctttaaaaaagagagatcaaattgctctgtggaggcgtgtactgctcattccattgcataagcactgatccatccaacgcatccacgccggcatggggaggaggagcatggccggggccgatcaccgacggccagacgcttggatttggatcttcggagaagaaattgaagccaccaccctccatggacaagaaaacaaatcgagcagtggggttcggagaagaaatcgaagccaccaccctccatggacaagaaaacaaatcgagcagtggggttcggagaagaaatcgaagccaccaccctccatggacaagaaaacaaatcgagcagtgggggccggtggtggctcaagtgggggagggcggcgacgtggttgacggtcggcaaggagcggggccggcggcgctggtggggaggaggtgggggcggcggcgctgctgggggccggcgaggagtggaggcggcggcggcgaaaatgccccgcgcctgcgcgcgcgtggtcgtgcggagagagagagagagaggaggtcgcgttttctaatcccgtgagcctatgggagagagaaaagacacttttcagtgggccccactcaaaatagctccaattagcaccctttgggtgagatagtttttttgggtgggctatttccaaatagccctcaaatagcacccttttggatcttttagggctatttaggctatttgagagagggctaaaaaatagccattggattcaaacagggccaaagttaaacacaaacacgagtgcctgcacaaaaaacactagccattttctgaacctaaaagcatgcgctcctcaccggcgtacgggtacaatggctgggccgctacgccgacagcggcacgggcctcaattttgatgcgactacgacatgtcactcacatgtgacatgttggttcggaagcagcgaactccgtggcgcttctggtgctcaaaaaggcccggacaatctctcagcgatggcagagcgtttgacgcgacgagttgccgtgccaccgggagcacgggcgtacgaacgtctgccgctggacaaggattttttttttctaaggcacttgtcaattgccatccaggtcgtcaaggcattacatgttgccacggtttttagggttttagtggattgctagtacactgtacagagtaggagtacatcttacgggaagagatgggagatgcatggttggagttgaatcaagtactgacaggtaaggacgacctagacgagtgtagacaattttcgaagaagagtagtacgctgtacgcgtacacgtccacgcgagttaattgtagcttccccatcggcgcgttattagccggctgcaggccaccgcggaggacatgaggtgactggctgtgtggtggtcctgtttggtttcattgtctatggctaccgtagctagtatgcgtacggagtactacgacgcaaagctggaccctctccaattggaggcaaacgggcccaacacgataggtgtcgacctgacatgacaatatataagctcccccgacatcgccgcgcgcacgacgcagggtccgcctctccaaacggcccccggccctccccgcggcgttgcgccgcaagcggacatgtgtgttagctagctgctgtattcttgaggccgcggcgtgacggaacgaggctagcgaggccgcgccaaggcgcccagccaaaaccccatctcttccgccgcgtggcgcgcctctgcctcctgccgttccatgcatggcacgtacggtccacggtgcacgcacaccgtagcactagcacgggcggaatagctcgttcatatagcccgtacacgctggcgcggcggccaaactccgtgtctccgtctccagtctcctctactccgtccgtccatacgtcctcgtaccagtgacagaacgtagtaggagcagcttgtacgactagtagtcaggtcagcggtcagctatactacgtacgaacggctcaccttgacgactcccccccggctgtcaatttcacgtgccattgtttcctcctcgaacgggggccaatgaagaactactcgtactcccactctccactaatccagtactactactactccctaaagtactcaggcgcaggcatagagtaacatggaaacaccagggagaagagggggtgtacaagggacatgcatcaaagtcaagagcatggaaacgataagaaaaaatccagccgtgtcagtcggcgtacgcccaggccccgaaaaattccagtgcgaggtcacgagtctccatgtagatatgtgcgcgcgccaggcagcgcacggtttgccattgccattgccagccagcttgagccagccagacccgaagcatggttagactgtaggaccggctggtccatgggaagaaggacacagacggacaggaaggcgccggagacaatgggaatcgtgttgttaaatgcgctacagtaggagcacggtgtcctgcatctcgccgatttggtccaaaatttgaggtgtaccgtgtacagtgtgtacacactacacagtctctagtaggagtacttcaattctcttccatgtggagcctctttgagatcacgacagagggtttttcatgctcatgcagccatgcggtcctgcctgaaacgaagaagtgattattcacgtgtggaactccgaaaattttggggcaaattgctgcttttgggaggtggtttggttaacagcatttagggcctgtttattttgatatcattttcaaccttactaaattttggtaaagttacaaaaggtggctatatttagtttgctgtcaaattttggtaactatataagaaatcctgccaaaattttggcaactatgctaaaattttggtaatgctaaaattgaaaatggcatcaaactgaacagggccttaggctctgttcgcaactcttggttcccaactccctattctagttttccacgcacacgctttcaaactactaaacggtgtgctttttacaaaaagtttctatacgaaaattgcataaaaaatcatattaatctatttttaagaaaaaaaatagcaaatacttaattaatcacgtgctaatggaatgctccgttttccgtgcatgctgtgtgggttgggaagccagactaacgagcacagccttagcgtacatgtgtttaacaccacttgtccgcttgtatagggcctgtttggcacaactctagctcctaacttcaacttacctagagccagagctgtgccaaacggtccagattctctgtttttggggtggagttaacggagctactcctaaaaaatgaactacaggggtggagataagtttttactgctctacaactccactccaacccaaaagacatattaccctttaattttttaacatatttttaaaaatataccattgaactacccccaaactctcctcctcacctccccccgctctctcccccgaaacttcatctcccacgggcgggcaaaggcggcgggccgatggcgacgctcctgcggcggcggcgggcgggcgaacggcggcgcgggcgatgcgagcagcgacagcgcacgggcagcggtgcttggcgggccacgcacaggcggcagcggcggcggcgtcgatggcagcgcttcgacggggcggcggacgacgcacaggcggcgacggtgctccgacgggggcggtcggcgcgagcggggacaacggcgatcggcgcatggcctgcgacgggcaacacgccgacgcgggcgggcaggtggtgcaagggaggcagcgcgcggagaggacgctcgggcggcgcacggccggcggcgggcggtgtgcgcagagacgatgctcgagcgacgcacagccgatcgatagcggggattcctttttttttcttttttttttgatatttttcagatttggagttaaaggttaccaaacacttttgggtgggtctccaacgctaataggagctagctccaactggtgtaggagtttagagctgggagttagagtttggagccctaccaaatagggccatagttgcactagtttgaaaactgatattctattccccaccaaaatgcaaagcataattagaggcgagtgatatttacgcatgagaacaatttaagttcatcaagaacacaagagtttaaacaaaatcgtactaatatatcaacttttaggagttcaaataaaactatacaaatataacaacttttagctaggtatctcggcatttaaaaattattatacattagagcggatgacgcggatcggatgtagagtatattaattgaagaatcaacacaattcttactagcaatgtaatgtgctatttgtacttttcatttatcgaaagagcatcgatttaggcaggcatccgtttataggttagtgttgatacatgagaacaccatattaccctattcaactactacctctgttttttaatatatgacgccgttgactttttctcacatgtttgaccattcgtcttatttaaaaattttatgcaaatatataagatataaatcacacttaaagtactatgaatgataaaacaactcataacaaaataaattataattatgtaaattttttgaataagacgaatggtcaaacatgtgagaaaaaatcaacagcgtcgtctattaaaaatggagggagtattatgtttgtcccttccaactaacagatcggtttagttcaccttctttagcaaaaactagctctccccaagggccagggtacattgaatagatttattatttgaggtgcataaatatctactctcttcgtctcataaaggctctattttttggcttttaatctcttcgtcttatttaaattttttttatgattagtatttttattgttattagatgatagaagatgaaaaatactttatacatgactatttgttaatatttttttataaattttttaaataagataaatggtcaaacgtcgaacacagaaacataaaaataaaatctttctgaaacgaagggagtactatacaagtggagaaggtgtttgttagacagatctaatagtcgagacccgtgcatataatactattagtagcattagtactattagtagcatgaactaagctgagggttctttctttctttcttttaactagggcacagtctccttcatgggtttgcacatacatgcacgtacaatatatagctagctcgtcaagaaattaggaagtgaaaagctatctcatatgtgtcacagtgtgcatctatgcagctagctagcgcacagtaccaatcaccgctccatttcactttttttcatgtgacctatagtgagtactccggtacgggagaaatcatgccgaaagcatggtttatgtcttgatgtgtgttctactaaatggtcgcatcccttgggaccagctccaaaagcctatagcagctaagctaagctaatcctgccctaactaatcaccgcaaaacagcagctttttatcagaacaccagcagcacaaacccgttcagattaagattcccatgatcagattacttaatcgctaaccactgcatcaccaattgttaattgctctttacacgtactacttctgctacacttgctcagtccaggccggcaacgcggagccaacctgttccaagcgagccgctggggcgaatgcttgcatgcaggttgcacgtactccagctgtaaagaattggggcgagtagacttgcgccgaatgattgcgccgaccagagaggcagaggccactgcactgaacactgaatcctctacctccagcagaatgatggcaagtgaaagaatgataccaagtgaaagtgccattctttaatcgagcaaagatgccctctttcgttaactggtgagtactccagtggttactgcggtctcagcccgagcagagtatgaaattcttgcaagaattaactcgggctccttttgtactgaaacacaaaatggagaacaacatgaacagtagacagctactactactagtaggatttcttggcagttgcatttcagttaggtagaggaaaggagactaccagttgtgctagttggaggttgcaacgggcgtctcatcagcggagcgagtgctaattgaccgctgcttcaccggaaaatgacgaggcgtgaaaacggctgcccacctgcccgcgagctagggaataatgacatggaacaaccaacgtcaaggcaaagtgtacgaagatggcgcgatcgcctgaagctttcccgaccacttcaaccagtgtgtcgcgatcggcgcgtccgtctccggccggcgtaagcggaggtgggggctaggctaggcatgggcagcaagttgcggctaaactataggacaattggtgaatccctctcattgtattcaaataagcattttaaaattttaattttttatctaacataagtttttcttttctgatggtatctacgagcaggtacaatagaaggctataagccagctataaccacatatcaagaagaaaagtgaagagagagaagaaagcgggttacatatttatagctagctgcaacacggactctaaaatattatttgtgtatgagaggtataaccggatattaatgatgtaatatatttctatagttaactattgtatgaatgtgctattatattagatatatatgatttggagttagtagttggctatactattaaacttgctctaatataagtttctttatacactgaaatcaaagtatttttagccaattaaatgcttagaatttaaaattgaatcacgacaacgatatggttaactctttttggaaatataataccaacacagtcgcttacaacatacacactttcacctatattaaagtacacacgtattctatccattcatctatatgagcacctgaatgactgaattttttttattaatctttactaaataaaaaaacaaatattcatatttacaaagcagtgagtagaggtcgtcactcatcagcccggctgctcctgccatttgttttgattatcagtgtcaactgtcaagtgttccgcaaatggatatccctatcgaatcgagctgacgagactgaacggtgtcgtgttctcattgaaagcgttcacggttgggtggtcaaatgtctggttaccttcattttcactttaattaacgtggacttgttcttcgtttgagatcgctttcgaggctgtgggggagaatgcagcctacgtactcggacataagttctccaattgattaatttgtttcagcttactaatcctcctttgaatgccccaaccacgtcaaaatttagcacttttttctcctataatttatagattattatggccagtctaaacggttaaacattataattattaaaaaactttatacaacttttaaactttacaatagttaattcattcatttctatcctcaaatattatcacaaaatcatacacaaatatagtataatctatcctcccttcatcatattataaggtcacgtttagttgttaaaaatttttaccctgcatgtcacatcggatatatagacacacatttgaagtattaaatatagtctaataataaaacaaattatagattccgctagaaaattacgagacgaacttattaagcctaattaatctatcattagcatatgtttactgtagcaccacattgtcaaatcatggcgcaattaatcttaaaagatttgtctcgcattttcctggcaaactgtgtaattatttttttttctacatttaatactccatacatgtgtccaatcattcgatgtgataacacgaaaaattctgtttgggaattaaacatgcctaacataaaattttgttaagaaatcaaatcaaacatagttacatagatttggtagtgtccaaatcaaaatcataccgggtaatttctcactgtggaaccaaagcagtgagtagaggcagacaagccattaaacaaagtgcaaatgattgactaataagagcccaattaggcacctaaattacagcgtccctgtaacaaacagcagcttgagctcactgcgctgctcaccccgtactcgtcgtaatactttttttaatctcttctcgaacaaactccccctttttatcacacacacactctctctcctctctttctcgcccgtttccccaccaccaccaccaccaccacctcccctctcccattcgaccaaatcggcgaggggaatagcccccccgcgcgccgcgcctcctctcgtcgccggcgatggccgacggcgaggcctcctccggcgcgtacagggagttcaaggcgctgacggaggcggcggaccgcaagttcgcgcgcgcgcgcgacgtgccgctctacggcggcggggtggaccaccacagccggaaggcgttcaaggcgtacacgcggctgtggcgcctgcagcaggagcggcggcgggagctcgtcgcgggcgggctgcggcggtgggagatcggggaggtggcctcccggatcgggcagctctactacgcgcgctacctccgcaccgccgagccgcgctcgctcgtcggcgcctacgtgttctacgaggccatctacagccgcgggtacttcgccgccgcggcgcaggtggtggtgggcggcggctacaggcaccagggcctcctgatccggtacaaggagctgcggttcatcgcgcgcttcctcgtcgtggccatgctgatgcggcgggccgaggcggtggaccacctcgcttcccgcctccgttcgctcgtcgaggagaccaagtcggcataccccgtaagaagcttagctcctctcgtgctttgaataggggaaccccgagttaagtttgtgcgcttgctgttttgtattttaggaaacctaaggagtaaggagacctttttaacttctagattagagtagtgaagaagagtgggaacttgttgatttgaaggttgttttgccgcttggttttgaaattttgatagaagtgatatgtacagtgctcttttttttttctgtataaagaattctgattgggaattttgacctggactgctgcttaatcaagggtttctatttatttcccaattcgattatatgtaatttaaaatggcaaattcgttctggtagtatgtaacttaaaatttaaaatcttactttatttgtggtgaactgaagtaatacgactgttcaatgctcgtcttaccattcggatttgggatattgcattgcatgagtcgtacatttcattaggataacggatttcgaatcatgtatggtttacagttttagctgctaaagtagaatcattctctttagttggtttgataattttaaagttactacgtactaaagtgtatgaactagagcaatttcacaagctctattacctttcaatagcatatatatcacattgttttgtcagtgcttaattgagaaatgatatgttgtttgagggttgaataatgaatgttatgctaaaacgatagcttagcatttaggagcctatgacatgagtgccttgttacatatttcccattttcttgcaatgttatatatttcaatagagaatcacatatttatatcctttctaattaaaacaccttgccatttaattcttccataacaactttgtgacctcatacttcttagaaaaccaacttcaaggaatggaaacaagtgcttcaagagcttgggagattcttgaaagctgatggagcatacaagggatctagatcactgagatatgacaacttgtttgactcttttccgtcgaaccttgcacctattgcacgattccattcaaaaagagtactgaaactgaaagaagctgtattgacaagctatcacagaaacgaggtcacatatattatccatcaataattgacccacttatcttactgtgaaaacaagcttgacattttgtaatatgtaatgcaggtgaagttcacagaactaactctggacactttcagaatgctacagtgtctggagtgggaacccactgggtcttatcagattgctgccaaagagcttacagaaaatggcactataagtgatcagagtggaccctctggcctgattgatatccacctatcatcagaaatatctgatggaaatcttcctgcaaatcctcaaaaggcaatcatatatcatcctacagtatctcatcttctagcggtaggttgtttatgcatgttgttctctttgaagctcagttttacataagatggaaatcaaatcttgatagaatcacggatcttcttttaggagattactcttgaaatgatatattatgctcaccatccagtgaactggatgcgtattttcccctttaacaatgtcattagctttatatcaatacaattgtctggttgacgtttgtgttgggttagcaagtctgtgcaagtcctcatcatgcctggatgttgtcatagttagatcggctgctgctgcacattataatttatttggtggtggaaccacccacttatttggcagtatactgtaccatttctcatgacacaaatggaaaaatgtgagaatatttcagctttgccaagttgcagtgctgattgacaatggggttaattgttgcaatccattggaatgtacttttattcattcacgagtttgatggtccatatgatttgttcttttgctatttgaaccttttttgtagtgttacatcagaaattcgtaatttcaggttctagccacagtctgtgaggagctttctcaagatagcatcttacttgtctatctatcagcatcaggttcccttcttgatctgactctgtaaaacatctagtaacattcttgttttgagtagttattaggttcttacccttctaactttagtgatcaaaatttcaggtttttccgagcagaacattacttctcaaaagtatgcctcaagctcatcatatgcaagggcaacttccgtgtatcccatcgataagccaaattccaatggcaattcagataatcatctatggcttggtccccgtggaagtggaggtaaagcatctgtcttcttgtagggttgatttctggaattatatctcagtgtaatgatatagttcaattaagcccactttttatggtatactaggttagtgtccgactagactgatggtctagtttcttgttgaaaggttgatacagtatgcattttctattctgacatgactgtatctttaccaggtccaaacaatctttatccagaagatctgattccctttacaagatatccactattccttgttatcgatagtgaaaatagtcatgcattcaaggcaggtttgtcagaacttaatcttagcttggtagatgaaaatcattatcatgagtattttgttatttttcagagccaaacttactaccctggattgcccatgccttttgttctgtagttcctatatggctttatttacattcattgtggatgaagggtcttgtattctcatttgttttgaagttcctactatttaacctactgtaatataaagcaagctgcagtagtttttttcaacagagcatatgatttttctttccattttcatagatcactgtattgctaaaatctaggcactggctatccatagtagcttgtgaatccatcatttgattctgtatttttccaagtacattttaaaaactttaaacaaaatattctttcagaaaaaaaagataattaacttaatactacgaagggttttctcttttcattatgtttctaacaatttttttccctgttcttaaaaaaatgggagaacgaatttcttatatgagccataattgcaggctatacataatgcagagaagggagagccagctgccttgctactttcacctaggatagcatcagcaatgcctggtgtggaatccacgagtaatggaagccaatttacgtacttcctcacagctccaatgcaagccttctgccaattagctgggataacttctgacatagacagcgtatgcactttccttgaagagtcgagtattgtggaatattgatttctatattttgagctcttctgcttggttttcaggatacatatgctaacgcggaaatcatacttttctccgctttggaacaatatgaaggaatcctctgcacatctgttggattgaacaacgtctggggacaaattttaccagatccttttctcaggcgcctgatcgtcaggtacctttttccatatatctccacattcaatgttttgactatctgccatttggttggaaggttagcattgcatcatcgcttgaagatagtatcttgacctcttccaaaacatgaaagtggttatttaacatgactagttaatagtacacaacttgagctcctgtccattgcgatatttcctgcaaaccgccggtgggcttgtgaacaagtctatggaggtgtaaaagggaacagtggaaggatggttttacagcaccatacctgtacataatcagaactctccatgttgcattccaagacattattttgttccatatttattgcattgtgccaaatcatattccttcttttaatttgcaggtttattttctgccgagcagttatattctattttcaccctgaggagaatggtgaacatataccaatctgcctacccagtcttccagaatcagtcgcgccaaatgctgaagccatcatggcccccatccttgagtttgcagaaaaccttgttgtgagcgaccggtttcatttccgacattctgtccacaacaataagaaatgatgatcaggagcaacaactcaatccttctgtagatacctccatggtatataatcaagttatttgttgatttgttcgtatttatacagcaaacggagcatgattcagtatgaacaggctgctgcagcagctgcagcttggagagggtgaatgatttatcatttttcgctgcttcatctccattgagcatctgtacaagtttggttaggtggtccttacttttgatctaggcagtgtagggcttctctttccttttctttcggtttgtggtggagaggacagtttgtaagctggaagaggcattttttagtaccccggaaggcaaattgttttttagggttagcccaatattttgagagttagtttactaccatcggatgcattgcgttgcacatttgtctagtgcacccaacgtttgtaattgttgtttgtcctgaatgaagggttctggattattgtctgatgttctttctctacactggtggtgattatagttcgtaaagtactgaaatccatcgctgacgtttcgggatcatctactttcatctgacaactttgctttgagatagtcttgcaataaggatccaaggtgttagctctgggaaggaactatgaagtacctctggaaataccagtgggaagcatgtctgtgcctcacggtcagtcacagctggaaatggaatggcagctcgtttctcctttttgtcacgcgagcgatgagacgggcttggtgtatgttgtactgggcctttttcttagtgagacgcgagaagatgggctcatgggcccttggcttctcgtttcaccctaactaggccgtggggttaggggcggtaacattttttacaagcagcttatcacaatcaccaaatctcagaccactgccattagaagccaccgttgtaatgctaggacatcatttagtccatccactttaactatataaatattatgtgatttaaaatttataccatgatataaatatttctaggacactaatttcaatgcatgaaaatctatatgtttttagccaatgagatgctcggcaatggcggagccgggcctagggcagttaaggtatgagccctaggctcgggccaaaatcccctttgaattctatataaaaattttgaacatatattgtgtctaattgaaatacactgattcagccctacttttgtaattttcctggcgccgcccctgatgctcaggaatttaagtaactcaaaattcaaaatattcatagaaatgagggtgagcatgtgtatgtgagtgttcgtgtttgtaccatgctctcaattttttttttcaaattttgatcattgaaatgactaaaagttttttttttcatttatcaaaatttttccaaagaatatgctcatggagtattttggaacggatgaaatatcatgtacacagaatgtgaatgccattttaaactcttctcggagaggttttcaactctactggtgttgtattccatacatgttcacacatcacagagagaagaccagatggatccctcgggaggtcagagttgatttttttttctgcaaccctggtgcttccagaaggggtattatagagtttgacattgcaatatccaatcagataaacttgtaaacgccatcccatcagctctcgcatgttaccatagctttccgttgtctagttgacattgcaatatccaattatccatacatgatacatcagataaaaccaacgcagcagatcatgtaaatgtcgtcagctctcgcatgtttacgttgcttctgatgttgatttgacgctgcaatatccaaactatcaaaatctacgtaggatatcctgcaaatgccgtcagctctcgcacgtttacgttgcttctgatgttgattcgagagattttcaattccaccgcccacccagggtttgaaattttggttcagaaatttcaccccccaccagcatgctcaaatctcgcccaaaattttctcttttttttatattttttaaatttggtcaaattttaatcaaatttaagtcaaattttcaaataatttcggctcaaaatttctgaaatttcgatgacccccggtataaaaaccaattttgaaattgaaaaccctgtgcccaccggtgcttgaaaactcatgatatttccgtgctcccaccatgtaaccgtgcccatcggttgatcaccagatgtacgccaccttcttccttattgacgtcaggggcggcgtcctccggcggcaggacaactggccgaggaacgaatctagaaataaattgtaggggaatctgaacaaactagataaacttacatattagtagtggaggcttaagcccccacccccataatagatccaccactggccaaggctgacgatagagcgaacgaacatagcgacagggagtggagctaagcatgccccaagtctcctaacctccattgcgacgagggacctatggttgtagaagtttctggaacctttggaatcgaagaggccggtgatgagaactggatcgtgtctgcacctctgcggggttggaaaacacccaaggggtttggagttttcttatccgtaccccttgggaaaagttgtaacgcgtaaataacttgaaaaagagggttcgttttgaaaagtttccgcacctcccagcctcaccggtcccaccgtcgtcattgccgccgtcggctacggccgctggtgatgcagatcgtgagttcgcttgcagttcatgcttgtttcagtcgatgaactgatggagtgatggttcatttgagtatgtaactgtcgcttgtttcagtgttttgagataagaatgcatgtttgatgagtgctttagagatgatccacaattttctacgattccagaagaattacagcttttggggtttactggaagtgtagcgtggctcagccttctatctctcgtttgttttgagtagcctatgtttagcagtagcctcttggtttttcctcccccacctcccggcataggcctgtttggccgattgcgttgtgtaattaaaactatttttcttctaatatattgacgcgtaatccctttgtgcgttcggaaaaaaaaagtactcgttgctctatttgctgttgctatgtttcatatataattttgtcttaaatacgactctctaaattcattcagataagtagttcaccaatcatagattgattttacggtcgcacttgtctcaagactgagagacagagcgtgtctgcgcctctgtggggaagaagagaggtcagaggaggactacatgtgatccaatggttggaaaataaccaatggggttcggagttttattttccgaacccccttaggagttgtaatgggcaaatagacttggaaaagagggttcgtttgcaaaacttttgaacctcctgcatccccaattcccaccgtcgccggcagatcgtgacgtggtctgatctttagactttggtgctgcaatgcttgttgctatcttccgctgatgacgaactgacggagtgatggttcatccggtaaatatctgactctcgcttgtttcagtttaccgtgataagaaactattatatcgtacgctttgatgaaagattgtggatgagacacagttttcaacgatttcagaggaattttagcttagggcacccacaatggttatctataggctctctacaagagatccatatcagcatatttttctacttgaaagagattaaatgaagagagagagagcacaactatctactaacctagagatagtctatagagaaaaatgagggaatggattagagagctatagatacccatgtagacatactattgaggtggtttactattaatctagtctattgctgagatgtacatattttatagagagcaccttattttaccattgcgggtgctcttagttctgaacttctgatatacatgtcgcactaattgccgctatcaaattcagagttttgtccaaacacgtctgtccaatttcagattagttagggcatgtttagatccatttggaatggcaaatagcaaaaattttggtggcaaaagttttggcattgcaaaagtattagttggtgtttagatgcatgttaaagttttgccattctagcactaaagtgagagagagagaaagagagaaggagtggtcccaaagcactttttggcacaatttactactatggactagcaaatgccaaatgccaaattaccaacttttgctactagtgtttagatccaaaatggcaaaaagtgttacaaaatggcaaaatgccattttggaggatctaaacaaggtcttagttcaagcatgagcaggatttgctagaagcggttcccaatcggaacagtgatcacgggaaacggagcagtctattagcgcgtgattaattaaataattgctgatttttttaaaaaatggattaatttgtttttttaagcaactttcgtatagaaacttttgcaagaaaagctgcggtttagcagtttgaaaaacacgcgtgcgaaaaacgagggagaggggttgggaacatggggattgcaaacacaccactttactccagcagctcgccgccgtccgccggagccggaaaccgttgccagcgtcaccaactcgccgttgcctcgccaaccaatgccacgttttgcaaaaatacacgcaattgtgttaagttaagccacgatctgcgaccgtgcacccgtaatcggatggttataaagtagccaaaagctactccgaacccccgcgcgggacgaggcaagaggctcgcttggctggaacgcgagacggcgcggcagggagagcgttttgccgcttccgcgtgaatcggaaacggtcggcgacgacggagccgagccgcagagtggttgcgcacgacacggcgccggtgttctcgtcttccgcttcggtttcttggttctctgtctttgtcctcttggagttgcgttgcatggcgtaatatcatgggtcaatctgttgtccgatggatgaactttgtgctccgatcgatcgccgccatgccaactgcaaacagggcagcgaccttgctccagctccagagcgtataaaccgctctgcacgactgcacccaatggcttgctgctaaaactgaattttttactcaaaatcttttttgaatatactactagtattaaactgctgcccaagaacgacccggtctgtgagtagtattatcccagcctgggccgcatgcttaacggataagcatgcacagtgcagcgttcccatggttttgtaatcttgcatgccgatcgatataaaataaccgacccgcagtagcaagttccaaccaggcaaccaagcatccaagctcgtctgcccctcttcagatcaatcaatcccctgcaagaatttagcgtacattatttttacgccgttttcaaactcttttcgcagaaccgaacagcgacgcccacatggaaaaaccgaaaaataaaatggcccgtgtggccgtgtccggattccatgcgaccaaaagttcctatttacccagctgcattcgccgattgtttagtatcgcgaacagtagtttcgtgatgaccgtatcaacggaaaactatttttaactctagctaatctctaattatttgcatgtcatgaaaataattaaaaaaattaaaaagatagattaatatgtgataaattatttcacaaatatgcaaggtcaaatttaacttctacaagttatagcgaaaaaaataaatttgactgtgaatatacgttaactggtcatagtttaatttgtttttttcgttgtaacatgtagaaattaaattttaacttatttttatagagtgatttattatatattaattatcttattatattttttaatttttttcatagtcatttaaatgacatacatataaacagaaaatatcttctcgaggatttaggatccactctcgcatcgatcaagccacacaatatgtacacgagcagaggagatcgcacagctcgcctaccggtgcgtgcgtgcagagcgagccagccagccccctgtaaagtcgaatcgcccacggtttgtaccgccggtaaacgccctcgcgacccttcgatccccttgaaattcttgaattcttcctgcctcataacgcacgaacgcacgtcacgaagctaggtagaaagcttcgtagtcactacacgaaacacacttgcatttgcacagttatctctcaatcgccacgcgcgctcaccgtcagctttctgcggtcgcacgtatgtactacgcgctggatatatacgtgtgtacaagtgcaggttgctcggttgttttgtgtagtgtagatgtgtgaaagttaaaaccagccgggtcacttcgcttcctgtggcagcacagctagcgcgtggccatggacgaccaccagagcaaggtgcagcggctgtacgacgcgtgcgacgccgtcttctcgtcggggagtaaagcagggttgccgacgctcaagcagatcaggtggctgcaagacctgctcggtacgttatactcctatctttcattgcatcttggttcatacgtgtgcaaattaattaatgtgttggttcattttgctgattttgcagatggcatggaggcggcggacgtcgggatcgaaggcggcggcagcggcggcgagaggtcctcgtcctcggaggacgacgacgagaggagcccgccggggcggcggtttctctcggcgcgggcgttcacccggat

SEQ ID NO: 60190 - DNA, 755 bp, Oryza sativa
ccaccaactcaccatggccgccgccatgtgtcccctaaccgacaccgcgaacggcgaacacccgccggttcgatgaatgaccacctccatgtcttcccttgtcatcgatcgcatcccgtgagaccggcagccagagctcctgccggtcaatttgacaaggcgtgcggcaccggtcggaggccggagatacgcagagtcgtcctctgacgaagacatcgaagtacatccatcgtcagcggaagtacaccgttcgccatggccaccgccccccttacgtcggcgaggttgacggggatcagaaattcagaaccctgtgttacacattgtcctttcgaacccgtacatcttggcgaaagtttcgccgtctccgataagagcgtcagcgagcagccattgctgatgtacatactacacacagatcacaagaatcttggtaacaagtatatctgtactaggggttgcagtggttgcagctgcaccggtgtccgtagagctcgggagtccttatctagcgtcgctgctgtgagccggccgtgatgtcatgtacctgcacccggtggcgttccggcgtgtttgtcctctgcaccactcacccgccggtcagcgcattaggtgaaaccgcgaaagtgaaacagtgctggactactgctatatccgatcgatcgagctgcccccgtccgcccgtccgtcctgcagagagacacatcaccgtgtgtggaacattcagagagctgcggcaaagcgggctgcaggaa

SEQ ID NO: 60191 - DNA, 1450 bp, Oryza sativa
ccatttctcctaaaaataagttcatttttagagtaatcaatgcgtcagaattgtgaaagtagaaaaataatagtattgggagtagataaagtaactagtaaggaatagttgcattgggatttgataaagtaggggtattctagtcttcttagttttgtattggtatgggtaagatggatgcaaaatgaacttattttgggatgagggtagtacctaaatatcctagaatgaaacattaactgaaagaaaatgaatttcatctccagattttttgcttatactccctccgtccctaaatatttgacgtcgttgacttttttaaacatgtttgaccgttcgtattattcaaaaacttttgtgaaatatgtaaaactatatgtatacataaaggtatatttaacaatgaatcaaatgataggaaaagaattaataattactccctccgttccaaaatataaggcacaaccacccttactccaaagaccaagaaacaattattatcacctcctaatttgtatcaccctaataaataacatgcatgcacccaatagaattagagatcttgatggtggaggacttaaaaaaatcataatttaatggagaaaagatactaactaattgcatacatgcatgcacgccttatattatgaaacatctataaaaagtagttgtgccttatattatggatcagagggagcacttaaattttttgaataagacgaacagtcaaacatgtttaaaaaagtcaacggcgtcaaatatttagggacagagggagcatatgaaagcagggaagaaggaagtgcacagagataaattaggtgaaaatgacaccacatgaaaacatatgcataacaaaaacaggcatctgtacatgtgcactacaaaaacattagtaatcaactgtaaaatggcatctcaatgggaaaagcaaaataagactaattagatgcatttggatagtggatcaggccaagaaccagctcaacacatatcaccccgaaagatgggtagactctgaatcagttaatcacataacagaattgaaagtggcattcttgaattaaattgtgttatcatgcttaaacacttcaacttcatcgacctaaacaatagtaataagcgacaaaagtgacaaaagtcagactgccagtacaatcctatagtaagctgacaataaggtccgatatccatattaacataatattttgaagcaagttgcatagaaatagaggattgtgtactcatgttacgtcaaatagcccaggccagccaaaaagccccaaaccgacccaccagaaaagaagttaaacttctcatatagaatttacctaatttttttagtacataaaacagagacccctttccttcatggccaactaaatgactcacatacttgcaaggaccttccttataatgctggatatttggggtgattggccacagtatt

SEQ ID NO: 60192 - DNA, 3427 bp, Oryza sativa
  unsure (1)..(3427): unsure at all n locations
tctgcagacaaagaaagaaaagaaagagattagaagttaattctctcagcaaaaatggcagttccagataagagagaaagcaatgtataccagagtcaacagcattaacttccctaagaattgcatcaggtgacatcagtggatttatgaaaaattgtgcaaacctaaaacgacaaatgtgaaggaaatgaaacagagttgcaaagtaaaaaacaaaggtgtaaggaaagaaagaagtagaagttacctatccaaagcatcatccaggcaatcattgttcacatcaaaaaaaaagtttgtgtgttcacgagatgtgaaggcgttccttgaaccaccatgctaaaagaaaacccatatcacacaattgatgattcaaacatagaggaaaaacataaagaccatgatattatttatacaaatttatgaataattatggctcctaccaactgcatcagaggctagacagatggttttctaattagcacagttaataattaaagggatcaatctctgcttgcagaattccagtagcagcataacatgtgggagggaaatcatggttcaaggcttcaagcactgcaagggacaaagcttcattgcggccaacgttggcccacccaatgattgtacagtctatatgataacgtaattgtatttaaggcattttacttattaagcttcaaattggtcccatctggattaagccactcgtgcacattagtgttcgaccactcactctgccaccgaaagcactggtgcgccgcaacagacttgcaacatcaaatatatgagttcactaacaagtacacgtgtctattatattgcgaccaactggtaatctagggaaaaaagggcagcaacccatgatcaaacataaactagattagctttacaaatactgaaacactctaacggcactagccaagtacctccaaaatgtggtgcaagtctctagacattgccaaagtaaattgggcgtggactagacattttgcaaagcctacagtatgctgaagttcagttgacactctcctgaacaaattgttctcaagcattttcactaagttttgagatcaatttaagttcgatcaaacaaattattgaccacagtaatatcaagatcagttagaaagatactttttaaattaacagaatacgtaagtagatctgccctggcaaaatacatacctctgcaatatactttgagtaactgtcttctataggatatttctcgctagcatagaaaagcatatgctctgtaaaagaggatccaggcataagggaatcaaacaatacagagctacacacatgttattactgcaatacatgtgccatgaagcttttcacatgcaatactacaacccaaccaagatttaaaaaaaaaacaatgaggttntgaagagtggttctttatgaattaatactctttaaagggacacactacaaattataaagagagcaatatacaacagccaaattaaacatatactaagcacagtgatagcatgacacgcaagaaagttgtgcttactttacctgaccgagaaaaaaatagttacaatgactagtaagtaaattaattttctgattggataacagtggaacattatatttctattgttcaccttaagtatccaaataagatgcttgaaacaatacttggcctgcccgagaaaaaaagttagaatgactggtaagtaaattaattttctaatcggatggcattgccacactatatttttataatcacctcaagtatacaaataagatgtccaaagcactctggtgctgaaatgaactttctaataatatacgtcatccatttcagtacagaggcaatataatgaacccacattagcatttataatgtattacagtattagtataacagttttcagtcacaaatggcattgctggtacctttgatcctttaatggcatgtgaatttcacataagtcattttaaggcccaactgttttttttctcttaatgccctttcacatatggactttgacatctttgcagatttatcaagtaaatggttagttccaaacgttattatgcaactcataaacttttcaaggaatgggccgcttattagctagatattgtgacagcacctatcaggagatagtagtgttgaattgatgttgtacatgtgattcagccattcgtgtgttttcctggccatgctatatttgttttaatcttctcatccagagatactcagtatgatttggaaaatttattttgagatgtgttgcatgtatttttacagctattgatgttacccaaaaatgaaaaagaagcatgctgctgtctgtggacttagaagtattttttacttgcacattttttacttgatgggctctgagaaaaatatagatatccaaatttcgaccttcttcctctttacatgaccaattcagcaattaaacaactaaaagcgcatacacgtattagaacagtgccagccacagtgcacagcctaaaacaaccttcttgtaaaaaccgcagaatgtagtggtagcctaagcaggcctgacgcaacataagtgcatagagatgatagagagatcaagggtattaagcaccaaggcctgactgcactaagattatcgtcaccaacatcctgtatattcataaccatttaagggaagcagctaactacaactaaaatcacacatccacgattaccaatttctcacgttttatgcaacaagtcaaaacaggaagctcaccaaggaagtgtgcaagcccagggagcccctcggggtcgcagaagtagcctaccgagacgttcatcgacgccgccgcctgcaagcaaacaaacaagtcggggttcaagccaaaaaaccagagagataccaaaccccggcggcccatcccgatcgaaggagcgagcgaagcaggaagaccttatcggtgtcggggtcgctgatgacgaggcactcgagggcgttggggagcacgacgcggcggtacccgcgcttgtcgttgcggggcttcgtgatctccacctcgccgttcgccgcagccggggccgcgccgccggaaggctcggcgggggcaggggcttcccggggcctcgagtccatcgcggccgccgactcgccgccgcgggcgtggactggactgaccgagaccgagtccgcgcgggcaccaggcgggcgaagagccgaagacgaggagttggcttggcacgagcacgacggtgtcttcgcggcggagaggggtggggaaatgggcttgggccggatgagccacagcgacatcggggcaacattttgttcaaagcccaagtcaagtgtactcaagtcaacagctacgtaccgctccctccattttattttcatatatagcaagactttctagtatattcatctagatatataaatatggataatattagaaagttttacattgt

SEQ ID NO: 60193 - DNA, 2155 bp, Oryza sativa
catccacgtctctaagagggaaagctacttaaaaagtactaactctgcaattctgtggtatcgtgtagacccatataaattcaggctgtgtttagacccaaagtttggatccaaacttcagtcatttttcatcacatcaacctgtcatacacacacaacttttcagtcacatcatctccaatttcaaccaaaatccaaattttacgctgaactaaacagtaaacacagcctcagctggcattcttatggctggttttcaaggataggttaaatactgaagccaatatggtcagcaaaaagtggaatgatgacccccactgccctgtttgccttgctcttgagacagctgatcacatcatcctaagatgcaaaaataccgacaatctctggagaaaactaggactcttgcatctggcaaacaaagcagaaacaatctctgatttcatccaagcagccattgacaggaaacaacacaaagggtgataccaatctgatttgcagtctgcgcttactctctgtggaaatcacgcaacaacatgatttttgacagacagatggacaatctccagggtatcatgcaacagatctgtgattccctaaatctctggtgtgtacgaagtaatgaagacactagacacaaaattcgatcatggtgtgaaagactgtcctaaacaacagcctaatgtttatgcttctgtaaattctttcttttcccccgtttttttctttcttccttaacctctataactctttttccacttcactcttttttattccttcttctccctacctctctcttaactaataatcttgtaaccctaaacctcatttctataaatgaaatgactataaggtagagcgctctaccttcttgcgttaaaaaaaagtactaactccatcccaaaatacttgtcgctttgagtttttgtttgtaatgtttgatcattcgtcttattcaaaaaaattatggactattatttattttgtttgtaactcgctttattaaaaaatattttaagtatgacttatcattttttgtatttgcactaatttttcaaataagacaaatggtcaaacattgtaagtaaaaagtcaaagcgaccactaatttagaacgaatgtagtaaagaataatgaatatattaagtctttattgcttcccgagtcaaacatggcaccctcaagcagagaagggtggacaccacactaccacaccacaataactctattgtttacttaaacatggcactgaggtggtgtttttttgtgttgtagatgaagataaagtgttttacgtaaaacgaggttgtattagcgtgtgattaattgagttttaattattacaaacttgaaaaatagatttatctgatattttacagcaactttcatatagaaagttttcgtacgaaacataccgtttagcagtttaaaaagcgtgccatgaatatctaaattttcatccaacttttgttagagaaaagaacaaggcctgagcccctagtgatatgaactgcgtgaccatatagcaatgttcccagcgccaagtatacaacgctaagttgtacttcagtaccaaagatgacaacaataaggttggcatctttttaatttttttttgcgagattcattcttcaaataagttttaaagacggccaaatgtaaaatttcaaccatctataggtagggtacgtgtgtatttacataaacaagactcaattgtcctaattaatactctttccgtttcatattacaagttgtttgacttttttcctaatcaaacttttttaagtttgatcaagtttatagaaaaaatgtagtagtattttcaacacaaaacaaacatactatcaaaatatattcaatgttaaatttaataaactaatttggtgttacaaaatgttctaattttttctataaatttggtagtttgactagaaaaaatgttaagcggtttataatatgaaaggaggattaggctaatttaatgatatccctatttcatcatgtcttgtactaagcgcacgaggtaggatttgcgtgtgatctaagtcttccttctcttcttattagctcacttgatatatcaagttttttctactccctccgtttcatactgtaatactttatagcattgctcatatacatatagactagg

SEQ ID NO: 60194 - DNA, 1413 bp, Oryza sativa
ccagatcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaacttctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccacttggtaattgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgataaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacattctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccaacttcttagtggttttctccactgctacctcttgttcttcaccagcagcctggtttaaactaatccctggcttccgcggcactggagactggaaagttaccacctctccttttgcattggtcaacttgatggtgcggctggcgcaatcaatcactcctctgtgccttgtcaaccaatccattccaagtatgacgtctaggtccttggattcgagaagaatgaggttggctggaaaaatcgacccttgaatttcaactgtcacagatgggcagtagtgagttgtgg

SEQ ID NO: 60195 - DNA, 2270 bp, Oryza sativa
accgtgacgtcccatcgtgaaacgaggcttctgactcttcccctggggagtcctgaactgagctgccttcctcttacggtttattttgttaccgtgctcctcctgacggatagccttatccaccagcttctcaaagtcctcataatctctagagatcaactggttagtcaattcatcatcaagaccagacaaaaacttctcctgcctctcggcatcagtacgcacgtcctcaggggcgtagcgcgcgaggcggtgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgctgctgtgcttgccgctgcacctgttgcaacacctgatggtactgttgttgcatctgttgcatcattattgccatcatctgagtctgattgtccaacacctgagcgatcgttgggttctcgggcggtggggacggactgctattaggtgcattgctggcacgtggtccattgatctgctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaagttaaacaaagcaaaagaagactcaaataaataaccgagcatgatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctaattttttttaaaaaaaaatccgatccgaataaatgaccaagatttttcccgcaaaccaaagaggcaaaactccaaattttcccaaaacaaatccaagtgaaaaagggcatatgcatatgaaaaggggttcagaaggctgttaggtgttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcgggaaagataaaagcgagctaaaccgggaagcttgacttcagcagcgagcgactccactccacaggcaaaccttgacggcagcgacgaaacaaactttggcaaaacagctccaacaaggaagatcttcagctctggtgtgggggaaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaatcactgtccaacgctacaccacgttgcaacaggcccaaccaaccacctgaactacgccagttcattaagctaaactaggggtgagactaatcacggtgaatctggttgatcgcccataaccgcgggcacggctattcga

SEQ ID NO: 60196 - DNA, 6499 bp, Oryza sativa
gatctttgggaccagccttaatgtgattgaggaggtcaaagactatctgtctaagaattttgaaatgaaggatttgggagaggctgatgttattcttaacatcaaactacaaagaggagatgagggtgggattacacttgtgcaatcccactatgtggacaaggttttgagtcgctttggatatggtgactgcaagccagctcctactccttatgatcccagcgtgctattaaggaaaaaccgaagaatagcaagggatcaactgagatactctcaaatcattggctcattgatatacttggctagcgcaacgaggcctgacatctcatttgctgtaagcaagctgagccggtttgtctcaaatccgggagatgatcattggcaggctctggaaagagtaatgcgttatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccctgaaaagggctcatttccatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgagatttgggcaatctctagatactcatgaaaggcctggagcttaacttatatgctccaaacagaggggatgcgaacggcagcccagtaccagtcaaggttctgagtgaaacctgatcacacaaaacttacaattcaaggcatagtccattgttaagttgtggtctggtgtagctcatttcctaggtggaagttcaacttaacagtctccaccaaaaccctggtatatcaaacaggcacaacattgagaacatttcttatgagccttgaaatttggtggggattgttagaataattgggctaggcccaatttattctattaaatctcaaaggcccataataaatgttaaggataataataccacctcaggatttaagcgagaaatatctcaacctaaatagggagttattagaggctccctgttgaccagttgaggtgggggtcggaatgccacacgcgcgcgcgcgcgcgcgccgggccgggccgggccgtgggcgtgggcgaggcgtggctggctggcggcgtgcgtgcgtcacgtcacgtcacgtcgctatccttttgcagccactaacccacgttcccacgattccctccgcaacagcgcgtccacgttctttctcctgatagaaaaggaggccgcgagtctgatccgatttcttagctgcttccccggtgttagtttctcccctgtgcctgagttgctctctcccttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcgggaaagataaaagcgagctaaaccgggaagcttgacttcagcagcgagcgactccactccacaggcaaaccttgatggcagcgacgaaacaaactttggcaaaacagctccaacaaggaagatcttcagctctggtgtggggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgcagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactgacacccatgcggtggcaccaatctaaagctatgctcatagtcaaagtctatgtaataatgtgatccccatttgtgtgctagttgaactaagcatggctaagcatttcctaggccaacatctagtcattttgatacccaagttatcaatggcatatggtaaacaataaatggctgagtaataggacccatcccacattacattgtaaaaggatgcaacatttaatagaaatgcgggatatttgtaaattgggtacaatatgatcaaacgtattgaatgacttgccttgctctcgcactgatgagacctcagcaacgtcttcgagaaaccgcggaacgacgaaacggccgaaacctacgcgacaaacagagcacacaagcaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcactttattgcgcaataaagcccagggctgacgtcatccaaggggggggcggcgccgacaggtggggcccgcatgtcagcggttcaagagagaggaagggggcgccggcacgtgggccccattggcagcggcacaagggagggaggtggcggcggcatgctcggcacggctcaagccggccggccagccatggggcggcggccgaagacgacggcgcacgcgcggagggcggcggcgctcatgggagagagaggaaaggaaggaggagaggggattcctcaccttcgagcacggcggccggcgcgaaggaagaaagcggcggcgacgaccggtgatgcggaggcacggacgggcggcggcgacaccctaggagaagatggagaggcgttagggatggagaaagcgaccgcgacgaccaaaatggccggccggagatggaaacaatggcgagcacaccggcgacgcggggaaatcggagctccggcggtgattcgcggcaacgaagcggcggccgaggtagctctcgcggcggcgaagctaacggcggtggtgggttggcgcggcggcgaccctagcggcagtgacgcgcggccgaaggcgacggcaagcggcggcgctagcaacaagcggcgcgagcgcgataggaggcacgggagagcgcggcgaatgagggaaaacgaaagagggggctcgggagagtgcttttatgggcaagggaggggaggacgtggccgggaaccctcccgatttggccggcgacgtggggaggagagagagagagaggggtgggattcgaaatcgaatcccgccctctcaagcgcgcgcgggccgggagatgcgggggaagaggcggcgacgtggggaggacgcgggagcggcgcggcgtgggcgcgggaagagcggaggaggcggtggcgtggcggattcggcggcggttgccgtcggaggcgggtggctggaggaaggggacgacctgacaggtgggccccacctgtcagcgtcccggagagagggggaaggagaacgggccggcccacaaggggaaggccgagcgggagagggatgggccgacggcccaacaaaggaaaaggagggaaaagaaaaaaaagaaaaaggattttcctgggattaaaattgcaccttggtgatttttaattggtaaaaattatttccaaggctctgaaaattccactaaaaatcctgttaatatattgtgacatgtggaacccaagaaaaaaatcccacaatgccaattccaattattaattgcatttattaattatggaattagctctaggttaattaagataatttcttcggacaaattatttaaccaatttttttaaagcaagaaaaaggggaaacttccgagcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtccttctctcgctggtttcgaggatacgagtcggcttctccacatacgtcagatcttcctgaatttcgatgtgatccggacttgcctgttcctcaggaactctcaaacatttcttcaactgagagacgtggaacacgttgtggatgccaagcatgttggagggaagctcgagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaattggcgttcccctgtctgatcccagaagagcggagtacgacattttcgtccatacagtgcttcaaatggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagggttctgctaatttcttccctgagtaggtagtgtgcaccggaatgaagtgagccactttggtgagtcggtcaacgactatccaaatagaatcatgccccgatgacgtcctgggcaaaccggtgatgaaatccattccgatttcttcccactttcattctggaatctgaagtggctgtagcaaacctgctggcctttggtgttctgcctttactcgttaacagacgtcacagagtgctacgaactcagctatttcccttctcatgctgacccaccagaacttttctttgaggtcttggtacattttggtactgccgggatgaatggaatattgagtttgatgagcctcggttagtattcggtcttttaattccttgttttcgggtacacacaatctttctcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtaactcttcctgctcaaggcatctgctacc

SEQ ID NO: 60197 - DNA, 2602 bp, Oryza sativa
  unsure (1)..(2602): unsure at all n locations
cgtgcgcggctctagccccctcgcggccaaattgggatggagcgcgccggccgcgccgcatcgaggaggaggccgcaacgccgggggaggaggtcgcgcaggttgtcaccagcatcgtctcggccgctcgtctccatctccctcttgccgccgacgctcacctctctccctctcccttgtcgccgccgttctccctctctctcccgttgacggcaaccgcgagggcgatgaggagggccaacgccgccgccggagccacgccgttgccggtggccgacaacgcgtgagcgcggtggtcaacggcgagaaggggaggtggaagggacgagggtggaagaggaaaaacaggggacggagcggtgtcgttgggctactcccctacccagctcgcctcctctatcgctcccctagccgaggcgctcgtagagctgcgtccctttgctaagggacgtgcgcttctgctggggcactgagcggcgtgaaaaagggacagggatggacggcgtgagctagggacgcggcgtggagagccgcattgtacatggccttatagaactactccagctagattgattatagtatctagtaacatgtttgattattttgtaacgaaaagagtactctatctagttctatgaatgcgttcgacacaagaagttcatttcaaccagtcctaagttttcaaaactgcaaaatggggtgttttttaataaaaatatcttaaaattgtttttaaaaattatattaatttatattttaaatttgcaatagttaatactttattaatcattcgttaaatgagatatctcgttttatgtaaacaaatttcagttccctctacacccactgcccacctagcttaaatagttgtaatactccaaaaacaagtttcttattttcctattataatgggaagttcaggcttcatgtcaacataaattagtattatcttcgtccttaaataactttatttcacactcctcccacacgtaacaatataaagacaaaatgattggaattacctccattttataaaattctaatataattgtttttcactttatcaaatcctaatataattgttttccactttcacaaaccctaatgaaatggttgtttgaaacatagagttacgttggaataaataagatggtggaaaagaaatatagattcactactactccatgttgtacgaggtagcgctagcgcttgcacccggtgaggcagcgcacaatgctgatactccatgctgcacgatgtcaagcgcaggccatctcgacagccatggtcagcaatcaagcatgtgctattgtttcctggatgccgagcaaggcgccgcacggcgaggtggacgaaggggagagggtgcggcacttttaggagaaggaagagaccgcgcggtcgcgatatgacttttagttttagtttccccgttctctgtgaagaacgtttctgatgaaattttgtgagggagatctgatgaaatgggccaaatggaaccgggagaagtgaagaaccattgcaaaagcagagcacctgtgttgcgacttgcgaaaccgctgaaaacaaagagaatccaagagcaaacacttcgatcgctcctaggcacggcacgtacgccggcgcaacgaaagaaaattcaacgaaaagaaaaaaaaaacagcaatatgttaaccgcggaagcgggggcgaatcttcgagncccggcgaacgaagcggaggctggccgccggaggaggacaaatgagttccccgatcaccaccggagaggacgagaagacgaagacgaagagtgcgtcgcgggggagtagatgatcaattgcttccaatccaaaaacctgccactatttataggctcacacattttccacattctgctgtgcttctccaagcgtgggtgggccgtgggctccacgtgggcccattcatcctcggcaaccggtggtgccgcgtcaacgtcacgcctgcctgatgtgcattgctttgtggtcgtttttggtttacacgtacggacaccgtgcgggccccacctagttagccaacagtgtagtacagttcagcttcgtctccagaagttgattttttatgagacggaaggtgtagtccacacgcagatcggcacagaagatccaggccggtacgtgtggggcccaccgtccgcactgacgggcgcacagagagatgctgctaaaaccagagaacacacgggcggaccccaccaagccacggggccccaccgtccgcgtaccgacacgtcggcctgatcctggagaaggaaacgcggccgtggggcccgtggccctgtggcgataaggtttgctgggtcgtagtagtagtagcagcgccggcgcgggggccacgtcggatgccgcgcgggccccacccgggtcgcgctccggcccccacgtgcgattgcctctcgccgcctcggtggcttcaaatagaacgtcatcgtggacgccggtgcaacggtggccgtccgttcgcgcgcgcgagagagagagaccaaccaagctctcgtacgtgcggctctcgatggaccgcatgcacgatgcgggtgcgatgcctcactctggaaagcacccaatttcgttctctttgg

SEQ ID NO: 60198 - DNA, 1474 bp, Oryza sativa
tttgtaaaaaaaaattgaataagacgagtggtcaaacgttgcaaacaaaaactcaaaatcccttatattgtgggacggagggagtacttctttcaattcgattttagatttctgtattttaaaacgaagggaatagcttaagtagaaaagcgacttgttaaccgttttgagttgggtttgttatcatcagcgggctcaaaaccgtacagctcgtctgctccccatactattggttcatatgctaatcctaatctactcctaccacagtgtagggcccggctctaggtggaaagctgcagcgtgcaagcaaaggagagcggagagcgagcacgtgcgttttacgcacccccagtctatccatgggaaaatccaggctggcacggcagccggacaccggacaggaggaagtatctcaaaatatctcggccgtctttaatccacgccacacagccgccattattcggtcgacgcggaccatcgttccacccaccgcgagacgatccccgccgtccaatctggtgggccgaggagagcgcacggtcccgatccaacgcaattattcgggccccacacgcgcgcagtccatatgcgcgctcgcatgctgctgcggccttgggccacccctcctgcccgggtgcgtgatcgtgggccccaccatcggtggcaggtgggccacggcgctcggtgcttcggatcttctgcgccgagacactgtactttgtctcatcacgagtacaccgtataataatacggtacgtagtactccgtactagtgtcgtcgagttttccctatctttttaattttattacacatttaatccgtcgagttaattttgtgacactgtcgtagaaatatactgtacccgtagtactcctacgcatgacggcgacgcatgctactactactcccaagtcgtgtaggagtactccagtatttatgggtggggccagtgtgatgtgacagcgtatctttgggcacacgattggctgggccccaccatgtcactttctctcccgtccactacagcgaatagtaggagtactgttcgttaaagctgatgggtgcaggagccaaagctcgaacaagtagagtagggactagtagtactactactgctagggtacaggagtagctggaacaagtcagctgcggtgcatataaatgcaagtccaatgtgagccctctcgttgtgttgctcgtggctcatcgcggccggccttgatcgccaccaccgccgttgcgttcattcgtctactacgactccggcggccggccggtggtgccttcttaggcaggcgatggcggccgtcgcgccgcgcgcgcggctggtggcggatgctccgacgacggggggtccggccggtgtggttcttgctcgatcggcgacggcgagtcgtctcgtgcttttttttccgtgtccctcgtatttggagtttgtgatctggctgaagatggaagttgctgcttccatcc

SEQ ID NO: 60199 - DNA, 2455 bp, Oryza sativa
gaatgggctcgaggcctaacttctcggcgctaatgatgctaacgctcacaccctaacagttgagatgtactagagaggttagagccaataaaactgacgttgagaacctatctataaaaaggaatttctaaaaaggatcatttttttttaaaaaggatgaaagttcatgtaatctgctcgatttcattgttgctttgatattttagatcctggataaacagtaatgcggccctctcgtttaaaagaaaaagacaatttggacagagacatcatgcattgttctcatgatactgtaataactgatggattagtactacagtagtgaccaagaacagaacagttgctaacctcacaccatcatcccctaatccatctagtgctgggtacagttacaatcactccgtggagtactgtaacctgctggggcccacttgctctgctcccaggcccacctggtggtgggccgtgggcccagtgacctgcccactctagcagggtatccagcggggtcagaggggcccccagcgtactgcaggagcggcatcggtgtccgtaattatcgcaggctggtcgttgtcggcgtgaaacgtgtcgactcgacaccggtgctgcagtgacacacgctgtgtagtggatcggactattggcctatgggaggccttgaccgggtatagccggttggttcctggtcgtgtcaaaacaaaacatcctttccaaccacatctgaggtttacaggcgcattaactcatctataatcttcgaataaactaaaaaaaactgatctaatctcactcaccgaggtttttcagaaataataataaaaaagtgtacgaccagttcctaaatttatttcatgcgttatataagttttttaactctcaatatatttttaggtttgtgattttaggtttgtgatttgttaaagaatgtcaatccaattccaaattgccacgacacctctaggatactatgtggtgacgatggcgctaacgtggcatattacctggatatttcaaccacattttttttatttttttccttctcctctaccttctcctttcttttgccatacaaacaggaaggaagaagagagaaaaaggaataataataataataataataataaatgtcatgtggcatgcgacgtcagcgctatgtaagatcccgaaggtgttgtggttattttggaccagaatgacacacttaacaagtttggtgatgtaaaaatacattttgggagtttaggtaactactctagttaaaagtaacacagatgaacaagtttaggtgctaaccatgcactttacttaaaaaaaagtttcttacgaatgattctacccctccagcttcaagttctagaccttaacacatgtgctcttatttataactgatcttattacgagaaatttctctatttcctttgattctaattggggcgcccttcatatttatgtggatgggtattaatttttagtgatatatttcttggctgttttggttagaggttgaaacaattttcaaaggtatccattgagaaaaccttgagttcaaaacttcacgatttttctaattatttttctcaatagtagatgatgtgaaacgtttatagtaataacttcatcaactcaacatatcggttcagttttcatactagtatgtgcttagagaaatatactgtgtgctgataggaatgaatttatgagtgtacagtacgcgcgtgtaaatgaaggcatgcgtgtttaagaaagaaaaatggcctttttgctattgtccgtcagtccgtgcgatgacatagagtaatgtgcgaaggtccagatgtcggtgactgctgacaaaactgagatccactgaacatggagataactggcaatatggcaccagtagttgatgcttcagagtgcgtggcgataaattcacaactgtagcattttaattcacgtgaggaatattgacaatgtagcggtagaacaaggataaggtcaagacctacttttacacggagtacacacaataattacaaaaatgaaaatgaaggacacggcaacattgtctgaaattgcactccagcccaaaaagatgcatccggcaaaatgccggccatcagaaagatggaaaaggctcaagaaatctgtgaccgcataattcaccgtgttagctgaggacattgttttcttcggcttcatctacttcgcaggaagatgaactcaccaatttcaagattaaaacctggtgtctaaattttcatgagttcctgaaaatgaaaatatcaaacaagcccgagtcaattcctatggttctggaggattaaaggattacaggatagcaatgctgatactagtttcagacaagccatttatccttggggcatgcaattgtgtccaacatgaaggaatatcttgtctgaagaaagaccaatgaaagggccaaattacctgttccttctgcttttggata

SEQ ID NO: 60200 - DNA, 2569 bp, Oryza sativa
cttggactaaccatcccttagagggtattgttaaaagatcctcgattcctaatgaaatcgatttagtagtggcttgatggaagcctaacgtttttatttgatccagtatatgggatgtatatcccattccgaaatgatatattaatctgctaataagtcgttcatagcagttccatctatctctttattatgaaagaccagattggcccgttccgccataaataagtacctctttttcggctgagtataattcgacaattcctgagtaggattcgacaatgggcctgagtcagtgattcgaaaacttagttaacttcctttcctaaatctcaatctggattcgtgcggcaaaaatgatgatactagcgaaatcggaatgcccctcgaaaggggcgaatctaacttccttgtttagatagtgtatgaataggcctgactaaatccttgtatggcttcctctatttctctgtaaaaagaaatatgaccaagagtaagactggggtacgtcatgaagctttgtaaaaacagagctagatcatactagtatcatgcatcagcatgatgaaacagatggtcatttgtgcaaaaaagtgatgtttttattttttgtactacttttggttgttgtggaacaagatgaacctagtgcagttcatatctggaaggatcctaccagctaactcgatcgcaatcaccagatatgacatgcttgagagtcactactaaaagctctatcatgttcagttagttatatttcttaatctattccactcctaaaaatccactctctagtgtctagtatccttactaatgactctgactggtgacgactatacttggttagatgtgattgggaatatatgctgttatacataacgataaaaacaataacagcattggtttgacaaaagaaacccacggcaccacgcgtaactatctcaaagatactataaatctagaaccaccaaaatagagctaaacatgtgaaaatcctagagctagctactttgactgatcggatggcatctctccagggcaacaaatgatatgatcgcaatgccaactttccagctcatgggccaaacccaatcaggtgtccacattgcaaaatggcagtttggcaaccctatcataatagaacagcgataatcatagaccctctttctggacgagctatatgcatttgtggttctttgattactctatgcttccaagttccaaaagatggcatccgtgccgtcatcttttcggcccaccaaggaagcctaccaaccaaccatgagattgctcaacagaaaacaatgattcaatgagagcgcatgcatcggtgtgttggccatagggtccaacataattttgacaagctgtggaacagatagcaactgagagcatgaaatatactcctataaagttgtggttgattaggatttgatcatttaattcaatgcaaagaacaaacattaactttcttcagcagaggcaactgaaaaaaagtgcctttggtgccctctttttttaatctcagctaaagaacaagtgccttcaaaatagtcggcacacatgtctaattgtgcaaaagaataaaacgcctttccttaaagcaagaaaagctaatccttacaggaataattgagcaacaaagtactcacaactcacaaggagcgctagagcttaaaaagaaaaacaagtgttatggctgacaaagtgacaaatgactaaggctgtgtttagttgagggggaagtttggattttggttgaaattgaagatgatgtgactgaaaagttgtgtgtgtatgacaggttgatgtgatggaaaaggactgaagtttggatccaaattttggatctaaacacagcctaaggccctgtttagatcctccaaaatggcaaaagttttaccattttatagcactttttgccattttgaatttaaacactagtagcaaaagttggcaatttggcatttggcatttgctagtccatagtagcaaattgtgccaaaaagtgctttgggaccactccctctctctttctctctctcactttagtgctagaatggaaaaactttaacatgcatctaaacaccaactagtacttttgcaatgctaaaacttttgccatcaaaacttttgccatttgtcatttgccattccaaatggatctaaacatgccctaatttggccgtgccttcacgctccaactcacacgcaggcatacagatccttggtgagaagggaaagtactcatctggtagtgcgcgctctttccgaaaccagcatgttctttggtggagaagaaacacaaagaaggccagcgctatctgacgtcaggtatccagatagacctgtttggattcatgccaaaacacggagtactctcgcttaccacaccaaccgcgtgcctgcgtgtcggcgcgccgctacgccagaacgacagatgcgcgtggaacacgcacacgcaccgggtgtggtgcggccgtgcaggccaggcaaacaccgatccggctcgcccggcgaaaaggccggtaaaggccaacggatcccgcggcgccatccacaagccgccgcg

SEQ ID NO: 60201 - DNA, 3509 bp, Oryza sativa
  unsure (1)..(3509): unsure at all n locations
tcccccccccccccccccccaccactacagtctacacaacacaccggcgcaccggagaaaagcgcgaggcaactaggcaagccagccacgcatgtagccggccgccaggcctgacacatggctggctgcccagctaggcgcggcggaccactggctaacggatggtcgcgtcctggcgatatcccactactctgacgatatggcacagtcacaggacactgtcccgccgcagttacacgtaccgatctgctctacacggagtactgatctgcagtccagccggactgtgggcgcgttaaagtaggccgagtttagttcccaaactttaaaatccaaaaacgtcacatcaattttttttatccacacaaactttcaatttttacgtcccatcgtttcaatttcaatcaaacttctatttttagcgtgtaattaaacacatccgtagtgtatagagaacacagtaccccgttacaggatcgggatctgtcctgcagttcgtactctgtagagattagagaacctactagcatcacatgagcagagcactggctacacacaccaaatttgttctgcacgccaagaaatctattgccgggcagtgaatgagactttcgccgcaccgcacgcaccgctcgtgtagtcgtgtgtgacagtgtgagcacgggtatcacaccagccggctatgccggctatacgcagtgctgtatagtggacgtcactgcgtcaaccatattcgaggcatttagcggagggcgacgtcgagacaggtggatgacccaacatgaccaacactccagcgccttctacgccgcacaagactttggagttgaatggcgctaattgctgcgaagtggagctcgggacctcttccagtttctagacaggtcacaagtactcatgatatagcggtggaatactcccgtgtacagttacttgtgtggcttccactcgcaggggatcgagcaagaactccgtgaagagttactgttagccagccgggtgcccgggcagcgggcaggcaccatgtggacgctacagtacgtaacatggttacagcgaccgggtttttactgaagcttttcttttcccttcttctctgtgactgattcgtctgataaaaggctactacttactagattttgtctcaacaacgaacttgcacttgcagtcttgcacatggcaagattcatgttcaagcaacaaaactacaaacgtgtgtcgttcgcaccaatgtttctgaggagataaaacgccggaatgcagcaggaggagcggagaacgcgtgagcgagagggataaactcgccacgaaacgtacgtaccgacggtgtcgccgagatggaacttcttggaggcggcccaggctgtgtagttggggctgcccatgatggtccacccggtcttgtcgcccacctcgtacacggccgccgccgccgtcgccgtccccgcccacatcaccaccaacgccgccgccgccgccaccgccacggccatggccgacgacaccctgctcgccgccgcaccaccacccatgaccgagagcgagaggagtagagagcgaagtgcaggttaggacagtggcgagagtggcacaaaccggccggttaaataaaagctccgcaacttttcgatcccctcgtggggtcgtggtcgtgtctcctcccgaaaatgcccccgcgccgcggccaagctttcctttcggcgtgtgtcatcgccacggtgtgtcagtcaccgcgcgagcgactcgtgggtaaatttctctcgccttttatcatcgcggcgccgactgcgtgtggtgtggcggtgtgggggcgtcggctgtttgttgccgcttgcaagcgttgaatcggttgtgcgaatgccgagattgccctcgggcctcggttgtgaacttgtgatgttggcgcagtatggcctgtagctgaggcgtgatccttactccgttgacaacgtacagcatacgggatctctcgctctttgttccagcaaagatttttgtactctactacctccgtcccaaaataagtgcagttttacactattcacgttcaacgtttgaccgtccgtcttatttgaaaaatttgtgaaaaaattaaaaacatttagtcacacataaagtactattcatgttttatcatctaataccaataaaaatantaatcataaaaaaatttcaaataanacgnacggtcaaacgttgaacatgaatagtgcaaaactgcacttattttgggacagagggagtactactttggtttgtcggattggatttaggccctctttgtttagggttataagccaacttataagtcgaaaagtctaaacctaaacaaacaagcagcttttccgtttggcttttttaaagccataagccactctaacactattaagccaaaagttaggttagagaagtttttttggtttatgtgaggtagatatatgactcaactactaaacttaggacattaaatccaccggcttataaatcatataagccaataagctgacttaaaagtctaggccaataagcctaagcctaaataaagagggccttaatgctcgagatatactaatactactccctttgtttcattttaattgacgctttggacaatgacacgctctacaagatatatctttaaccttatttttctattataatatatacaataaataaatgtatgtttacttttattatagtgttttgaaagacaaaattatatatgtttttctagtttctttatttttaaagttattggtggtcaaaattataaaagtttaacctcaaccttatccaaaacgtcaattaatatagaactagagtgagtactgtcactagagctatattttttttccttttctttattcgagagtttacttttttttttttttgaccagcgtccaaaccaactcactcgagtctaacgagtacgagagacctgatctgtgcggtcgtgaatccgtttgaaaccgagtctgatgcttgtcggtgctaaaacattcggcccaacttacttgggctaacttgaaacggcccattattgatcagttgggcccaagcccacgtgagtccccgacagcataaacccctcttctcgtccctctcctcccaacctcgcttccttatccacaccaatccgccactcccctccgcggcaacccccccgcgctccgccacagaagccgacgccgacgccgcgcgcgtacatgccgccgctccacgccgtctcccccgcggcggcggccgccccgccgcgcgcgctctcctccgccgcgcgcgtcccgcagcgcccaggtaggccgccccccttcctcactcctgctgctgctccgcgcgaggctttggccttggaacccactggaggccgccgaggcatatcgccatcctggaaaatgcgtgacgcctcgttggttgctgtggtttgggttgatcgtttcgctgcggtcgtaactcgtaaccggcttgatgcttccgttgtttctccggttcgcagaataaggtggtttttg

SEQ ID NO: 60202 - DNA, 1924 bp, Oryza sativa
tcgttttggtagttggatatgcctttggttcaggatttcatggccagattaagtttaacgatatcagcaagacgaaatgcttcaaacttggtgggggtttacagtgtgttccccccaaagctgctggggtttatattttcacttagtaaatactactaaacatcagaaaataattgccactcgttagcccctaatgattttgacgcattctttaaaagactcgttctaatggggattgtctagcattcttgttggctgcccagaatccagacaactttggtggtgggtgttaagggcaattgggcaccctgagtgtctgccggtgaatgaaccatcattctaccaatggctctgcagcagtcgaataagaattcgagagcatcttcggcggggctttgacacggtagtcacgctcgtggcatggacaatttggaaagaaagaaatggccggatattcaatcagcaacaaaggacctgggtggacatcgtgaagggaatggcggcagaggccacgctatggcgtcaagcaaaccaagccatcccagctctgatctttaggagggaattttgtagccaaaacagaccgcgagacgtacacctttgatttcctgcttgtatcctgtctcagtcccatgctgctttgtatttgactgtaaataacttttattcctcttaatacaaaaatgcgctcctcgcgtattcctatatgcatggtctcaccagaggatgttgtgcttgacaggttgtgttccagaacgcccaaacattttaagctcctccacaaacttcatgagtctccgtgctggaccaatgcgcttctatagcaggcctcttattcttcaaaactcggacaagaggcaagctactttggatttaaatatttatcccactgatcgaccctccacattaagctttaataacttgtgattatcatgttatcagagcagtattgaggcatgccactattgaagaaattgaggcagaaaaatctgtcattgaagaccaagctgtaagtgcaatgcatcttctcactgaatgggtattttgccttccttttttgtgccttgggggctcactagctgcagatatgcatcttcagagagaaaggatggaaaaggcaattgaaacagtccaaaataacttcaatactgtgaggacagggcgggcaaacccagctatgcttgacaggattgaggtgtgaggacttagccttgttcctttttctgtttgtaagtaactcttgcatgatcacatcttttatcattacactcaatgcatactttatcattccatacacatgctactgttgtgtgcttttcttaactgaacctatgtctgggctggtatttattgtggctggctaataacaaacacaaacaaggaatgaaactattgctcaaataccatatgcagactgtttggataatttgatcgccttctgtaactaaaactagagcaaaggattttctttaggacagaaaattgtgaaaattgaacatcctattatgccttatgtgtgagaattttgttacaggttgagtattatggaactccagtgaacttgaagagcatcgcacagataaacactccagatgcaacttctctccttattcagccatatgacaaatcctcgtaagctgtttattattcccacttcagtgttggtattgagttttccatcaatagtgttgacacaatgacactcatgcggtgcagcctcaagctcattgagaaaacaatagttgctgcaaatctgggggttacaccaagcaatgatggagaagtgattcgagtcactgttccaccattgacttctgaccgcagaaaggtaatgctttagaatttcatctgtgtgaattatgtgtggttacttggtaattctgggtccataattccatatggaaaattttgtttggcaagtttg

SEQ ID NO: 60203 - DNA, 3212 bp, Oryza sativa
  unsure (1)..(3212): unsure at all n locations
ctgctaggaaatttctttctttctttctctaatcatgcaaccaggtatgtctaatgttcaccgtagagttggattgcacgatttactcgattgtttcataccttctctgatccttgtgatccactgtaactgttaggatctttctttctttttttcccctctaatcatgcattcatgcagccacttatttctagcaggtcagtttctggaacacgccatgttacgtgatgaaacacaagaacagggctacataatgtacacatgtgagcttgcttggcgccccagcggtctgcaccacatggactaatccttaattcctcatgccatgggccaggtgaaatcgtcgtcccacacggtacagctacagcattaacactgcagccggccagccttcgccatggcgtccaagttcaaggaaagcatggattcgtatcaatttgcggctcaactgaaaaggcgcggacgtacagaaatttcaggtatggtcggatccaaacttattaggattggtcgctttcttattggatgatactgtgcgagattttcccacaagaatctgtgcgtatacggactttggaatagagtcaatgcaccgcgatcacaccatcacttgtctaggagcactttcactgtgtgaccatatccaatctaaacagaaatatagccacaagaaaatgtaggggggtgctgtttgtcggaaaacacccttatcaaaaacattggtattatcaaactttggtacgataacaaattgaacaatgaaacagctccaactatcatagcgctaccaaaatttgataatttttggaaccttacactaaatctggtaagacctcaaaccaaacatcaccatccctatcgttaccttaccaagtaaagcaaaacttgttaagattattttggcatttctgccctttcgtccgtcgctcttctcatgcggcatattcgactcttaattactcggcccagacccaacgctggccttacaaatctctcgtttatcaaccatcatcaataaccttatcaaatttggataattatagaactttgcattctacatcaaaatctgataaggcctcgaaccagatgtcaccatcacatctttaacatattaaaatttggtaaggtttatttttattacaaaccaaacatgcgcataaatctcatcactctcttcactgtgcccaatttaaacggaatattttagtaagaagaaacatcttaatcttaccgcacaatggaatctgaatacggcttcagtttaactaagttatctgaatacggcttcagtttaactaagttaaaaaaaaactcgaatactccatattaaaaactgctataaaaatccagagatcagttttttttttaaaaaagcagagatgcagatgatgggataatccaactgtcgactggattgcaaatggcactttcagatatactggtaccataatagtactgtttaataactgcagttcctctcgaagtctcacctttgttagtgtgagagcgagctgatgtgacatttgacaaacaactcaatcctcaattcaggcactttgtcctcgatgtgttatttacagctacgcagtaaactcgtcaggacaatatgaaagatcaacacacgttctaatgctcaaactcaattattcaaagtgaaaccgccaaaccggtgggtcacatgccggaatcaaggcggtagggttcagtactctatgctcaagtcctcttcctaaatggtgcattcatgtccttttgtcaaaatattgttaagcacttatgaagccataaaagaagcaggacaaggtgccggactgcagagaaacttcactcgtactcctacatagaatgaagtgaaggaagccactgaaatggtggtcaagcaattacacaaaacaggtagctccatatcttgttcatattgacatacacaatccttgatgatgacaaaaaacaaattacaggcagctcttgtccccctcaccataagctataaggggcagagcaccatccaacttatgctatttacttgttctgtctgtccctcccaactttgcaatacccttatcaagcacaagaaagtaaagagaacaagaaaaaaagaaaaaaaagagaggatatgatgacagtacatcatacatgtggatacaacactaaaacgagagttccacacagcaaccacatcacagcactgatccctgcgtgtgaagcgaagcggtgaacgatcagccgccggcgccggcgacgacgacgacggcgacggcggcgagcaaagcagagaggaggaggaggaggggaagagggtggcgcggtcgctcagaagaaggagcgcttggatggcgccctccccacggccctcatgaagttggcgagctccagcacgcgcgccaccttggtgcccctcttcgcctccgccgacgcccgcttctcctccgccttccgccgcgccttcgccacctcgttctgcgccttctccatcgccttggccctcttctcctccagcttcctctgcaacacacccccaattccatcagaatccagagctcgattggtagaaatcaatggcgattagatgatggatttcgttttggtttcttgttttacctcgtacttcttgagccaggcgttggccttctcgacctggtcgccctcccagccattgatgacgacctcctcgcgcttgaagcggttgttgaccttggcgacctcggcgatctgccacgcggcgatcttggactccacctcctccttcttcacctgccccaccgacacctcgtcgccgtggccgccgcccgccgacgacacgtcgccgggggcggggagcgcgaggtgggcgcggcgaggggacgggatggggttgctgtccgggacgatggcgagcgggttcgtctcctcgagctcatcctccccgatcctccccagcgcgtcgtccaccccggcgcggctggagtcgccgccgttcgcggctgcggcggcggcggcgttggcgttggctgctgcggcgaccatggccgagaactccctgctcatagtagggaagagctcacttggggcggtgtcgctccccacggagcggatcgacgtgtgcctgctccccgccgcggactcccacgactccctcctccgccggtggtacgacgacgacggctggctcggcgtcggcgtcngcggcgggctcagcgcgtggatgtccctgaactccggctcctcgagct

SEQ ID NO: 60204 - DNA, 3004 bp, Oryza sativa
catcggcgtcttgctcttcttcctcctcttcgcttctccgagctgagctgtggtggtgagtggtgagtaggatcggatgcctagcttggttaaataggcgggagaagagggggaggtgggcccgggcgtgtcagtgtcgctgagccagtgcccgccattggaggggcagtttgggtatttccgtttcgatccccatttcgtgtgccttttgggcggcttcgtctcgctttctgattttggaggggtctgtgtgtgtgtgtttatttttggggggtaaggtttagaggttagagtgtgcaaagtgcgctgactcacacaatcatatagttttaacattaacaagcgccgtatgattattttttccctttgattagtagtacaggtttggattggatacgtcacccattttttagggcaaagagcgtgaaggttctagccttctctcttcctacatgtttagttacgtacttccactgtacgatcatgcgtcgccgtaaaatattttaaaatggatcgataaatattactcactccgtcccaataaaaatcaggaaatcaatctatgttgatttttattaggacgctaagttactttttatcgagacggagggattagttgttttttaatggactagattgatgttctaaatagattaattaatataatactccatttaggggcgggacatacgatagattatctaattttgtgatgataatcgactatacaaacgaatgaattaattgtgaaaaaatagataagttgttctaaaatattattctaaacagtttatatatagaaagtttttaaaataccatgtttctaaacttgtaaaacgtgtctacgataatctataatttattgaggaaaagaaccagcctcaaaccaattgctacatgctatagtggtttgggtcaggcggtgatgaggacatcctccactattatccgctggcagagacgctaaagtcgggcggcgaccgtgtgagcctctgaataatcccaccttgcttagctaatcccaccttacttagcttagaaggaggaagccaccttaaaaaggagagccacccttcccctacggactagtcttttagggagattgggcctttccctgagtgggtgtgctaaagaactgttggggtccggacaaccttaagttattgggcctcggccgaccccacctgggccggattgttatcaggcggccgcaatgaccttacacaaaatatatggttaaatgaatataacatcattggcttcgacataaatggtactccgtttcaggtcataagatgtctccgtttcaggttataagatgttttgactttagttaaaattaaattgctctaagtttggctaagtttataaaaaataatattttttacaaagataaatttattataaaaatatatttaattattaatttaataaaactaatttggtaatataaatattactatatttacctataagggcccctttgaatcgcagggtagaaaaaacggaggaatagaaaaaacgcaggattctgataggaattgaagtgtaaaacagaggattgcaaaacacaggaaaaacacaggaatggtcgtttgattggagcgcaggaaaaacgcaggaatcggatgagaaagatagactcaaaggaaattttccaagaggttggagctcttgctaaattttcttcaaaatccacatgcaatgtgccattccataggaatttcataggatttggaaagtttcaatcctttgaatcaagggccaaatagaaaaatttcctataggatttgaatcctatgaaattcctacataaatcctttaattcaaaggggccctaaacctagttaaacttaaagctgtttaactttgattaaaattaaaacatcttataacctgaaagccacggagtactactcatatgatgtcagcgactcagcgtatcaaatatacacatatatacccacccctaccgaacgaactacaagtcggtataaccggcgaaccttcgagtgattctgccgccgcatgcaaacgaagggcctgtttagatgggattaaaacttttaagtccctatcacatcggatgtttgaatattaattataaatattaaacgtatactattaataaaacccatccataatcttggactaattcgcgagacgaatctattgagcctaactaatctatgattagcctatatgatgctacagtaaacattctctaattatggattaattaggcttaaaaaatttgtctcgtgaattagctttcatttatataattagttttgtaagtagtctatatttaatactctaaattagtgtataaagacagggactaaagttaaatctctggatccaaacaccaccgaagtctcgtgcactcctgtcccgagagagttcagtcaaacgcattcccagcggataaaataaatgaagatttggtgattaggccgtgtcaacttcaccccccccccccacccccaccaaaaaaaaagaagatttacgattcaaatgtcatcaccgaattgtttactggttacttcgcgagcagggaggcggtgagttacctacgtagtacgtgtgtgctggtttagagcaacgttgacagcgacgttttattaattcttacacacacgtaagaggtactactaccacgtctcataataattcttacactgtttgaccactcgttttatttaagaaaatttagaattattatttattatttattgacttactttattatccaaagtattttaagcataattttttatttttttatatttgcataaatgtttttgaataagataagtgatcaaacagtgcaaacaaaaactcaaaatttctcatattactccaatttaacagaaggagtagtaattatcatcgtttgcatggaggcgatgggtaatcaaaagacgtggtcggccgcggttaaccccgtctcgctgtcacggagttaaagcgggtgtgtgttagcgaaaggggctgcaggaat

SEQ ID NO: 60205 - DNA, 2858 bp, Oryza sativa
aactacccatacgttacaataagtgaaggctattttaatatattattgttagaatttttgtctaaaaaatatatgggatttttattttgatagtattgatatctaatttggaacccttattaagatgatggtcatatcatgtacgcctgacgagaattctaaagcaattaagaatcagactcccatcctaggtttgcatgtgagtttttttaaaaaagatttcttatatgactccttatatattttcaaaagcgaacaaacttagaaaccaagtcaaatacgaataacatgctaaagtatcagcgaaaatatttttaatttttataataatggagaagagatagagataccaataccgaaagagaaaatgaggggaaaagagaagagattgaaagaagagggagagaattaggattatcgggaaaaagaaaaagagaaaagagtaaaaaaaaagacagtcaagggaagagcacatgacttcgagtggatgcacgcgggatggtacgggtcgattgggttgtgttgggctaggagagggatgggtgggattaggctggggaggaggtgtacagtactccatccatctacttttgataggtatatttccaaatctgaaaaatttacttttgaaatgcatattttaatccaaccacctatcatcttaatgacttctcggatttaatgcgtgactttccattctttcacataagactggttacatgggcatcaagaaatataaatattaatgaatcgattgtttacgatgaataactagtaacatgtttaaatggatgataagtagaattacttatccttggtcattgtgtgaaatatgactataaaaagtagatggatggagtagttattttaggctcgagctgaactggatgcggacgacgtacaacctagacaccgataacgaaataaaattccgacaaaaacatcttcaaattttataatagtagatatatgatatgctctcatttacacataaacttttaagtaattttaagtttagataacatatctgttaatatctgttaacagtgaggtgtttatggtaatttcgtcaaatttaaaatatatccatttagtttcttacaagtgctaataatgtgtccctgtattcacaggggattagtatgcacacatgtatatgaatttgaatatctattgtattgtgcttgtatgagaaaaagacgcatggtcgtgtcgcttgtatgagtatacgtcttttaccctttccacgcgcggagcttcgctagctgtattccggctgtacaacgttggacgcacggccaggggaagaagagtgtagaacacgcggtgcatgcgatgcgatgcgatgagctcactcgaaccgcgaccgatcgaaacgaccgcgcgcatgacgatgacgtgcacgcacgtagcaatcagtcaaacacagccaccaaaaaaaatcacagcataatccaaaattcgtcttgttatttatgcctctactttgcattactttacagcctgtgaaagtgagaacgaatgtttttgtcacctgcatgccgctgatatttgacgcggccaaaacacacccgtctgccaaaataaaaccacacgtttttccctctacgaaatactacaaccgtccaaaaatactcaacttaaaagaggatgtaacctcttctgatacaatgtatttagacaaaaagctatccagattcattatactaagagcaagtttaatagtatagccaactaatagctccaatttatctatagctaatctagtagctcatttatacaatagttacgtactacactattaatacctggtctcacctgtcatacacatattgcgtctcgaagtccgtgctatagctggctacaaatgtatagcccgctgctcttctctctccttatttatcttattaaaatatgtttgcagctggtttataatctgctattgtacctgcttaaaagacgtggttgagtttttttaagaacgaaaagagtactaatcaggaaatttgaatttggttgtgacaagaaaaggatcttgttatcaagggtagacgtcatgagattgagaaggatcacgacatgtaaactccatgtcagtgactcggtcgcaatttcgcagtgcttaggtggtctttgaatttagggatttaactttagttttttatttagacactaatttagagtattaaatatagactatttagagaactaattacataaatgaaagctaatttgggagacaaattttttaagtctaattaattcataattagagaatgttttactgtagcattatattctaatcatggattaattaggcttaatagattcgtctcgcgaattagtccaaaattatggatgggttttattaatagtctatgttaatatttataattagtgtccaaacatttgatgtgataggaacttaaaagtttatagtcccatctaaacagggttagactatagattttgcagggggccagtgctggatacaacggaggaaacaaacaaagggaagagatggcaggaggtagtagtagcaaggatcctctgtaacaaccatatctacaacgatcgttgcagattcgactataatttgactggccccagcaggcaatggatgctccgagtggaggagcagggagttgcaatcatgactaagagaaagctaataggatttgtcaagtttgaagattttcgaaagagatgtcaagtatatatgaaaggcaatactgcaaaaatctaaaaatgtgccaaattaaggtggtacattctctcatacaatttatgcaatatctgatcaaataaagctcgaactctaagtagccgatgtattagaagattggaacccttgatgg

SEQ ID NO: 60206 - DNA, 5478 bp, Oryza sativa
attcctgcagcccttacagatcccacaaaacaattttaacattatagctatcaaactgaaattttgtttggctcttctattagattgatcaaaccaaacactacagatgcccccagtgcctttgccaactgttagataagtgtagaattttgctttcacttttgaaatggaagtacactaatatatttgggaaatacaaagcataacttttaaaaaggccaaatgcgttttacactaaacttagctggtgctctgctccgctcacagaaggtgggtacgcagaagatcattgcggcagggaagtagtagtaggtcatggtcaaccttaaccataccctaccatgacagcagcagcccaggcccatcaatcgcccacagcccctgcaggcccgggcccactcgagcagaggggcactgtgaaaaaggcccagtcggccccaccacgtcatggggcgccatgcacgcaccggtcagacgacgcggttgtcggcctggccggggtgcccagccacgtgggcagcccgcgcgctaccgacagcggccgtgacccgcggggcccggcggcgcgcgctctcgcgcgcgcgcgacgtcgtcgagaccgcgacgccgaccgatggcgagcgcgcccgcgcccccgccccgcgcgcgcgccgcgccagccaccatgcgacgacgtcgtacacgcacagcgcgccgcgggcgcgagcgcgcgcgctctgcagcgtcgccgccgccgaacgccatgccgatcgatgccgccgggcgcgcacgcgcgcgcgcgtcaccattgtgatcatggcgcgcgcgacgtgacggcgacacaagccaatccatcgctagcgactcgcttagtactattaattactccactaactagcggcatgtacaagaagcggtaggagaaatatcgtgtttctgtctaatcttttctgtggttgtacgcttgtttaatcctccttttcgtaggagttaatgacgatagggctcgatcagagaataaaaattgggttggtgcgctgatcactttcgcggcgagtgttgctgacttgcagcaacgcgcgccacttgccgccgttcggttggcctccgcggcgggggatgataataatggataatgctttatgcgagatacggctctgttggttttgcatttctttttcgttagggtggtgagtgcaccggagccaataaacaggtttaggtggaggactcgtgtttttttttaaagctcagccatacgcccatacgataattatttcatttgttcttttagatgtgcctactagttcgtgctagtaatctatagagcacttcaggactagatagcgagaaatctgttttaagagatcaacacgacacccctttgcatgcgaccttgggcgagtggctagctaagcttggactggttcctaagattgccactaaaaacatgtgtcaaatggttgactgaatatatatgtaaggtgtcagacttgtctcaagatataatggtgatgagatccttttgggacgcacctgatcgattctatgaatggactacaactcttttgaagtagcagatcatactagtgagcaaacgcttaataatgtcactcattccctccgtctcagaaaatacaatctaagataggaactgttatatatcctcggacaaccaatcaagacaagcacttaatccagattcgttgttcttgaatgcgtcacattctattctaagttaggttttttttatggagaaagtactttagattataaacaaaacgtatataatgattgagacagctatgtaatatcatttatgtacacagccacatcaactaagaacaaataaaaatggcatgtacaagagacaatatgatatctaatgtcactcctctcaactgtttccttgtaccctatattatctgagatgcctctttgcaaagatacatctcctttctcttctttctttatccatcgacacttcattaattaattgcaatgagtcatatggggtggggggtgggggggggatggaggaactaagaccaattaaggactaaaaatatctagcagtagctggtctagagctgattactggttaccaaacgatgaattcagattttaaaaattcgactattatggataacctattcgatttttatattactgcaatgttttccctccaactcgtaattcataaatagtagggctggccagccagttggcaattgggagtccaactcagaagacaatattgtgcataattcagttggcaattgtccggttaattttattagtaggacaaattcgttatgccagtggcacctagttcggtaacaaattttggtgttattgtagaggttggatatagcgttttcatatcaaacactcaaaagtagtttagaggttttcccctgtgtggatattatgggtaccccatacccatacggcatggttatccgaccagtcataggggataacttatatctatagaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctataatacacccggcggattcaaatccccaaacaggagtagggtattacctctcattgagagggcccgaacctgtctaaatcctttgtctccacatccatccacttttaggtctcgtgcgctaccccgttttattattgccgaaatcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttgatgggcatcgtcatctacaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtctacgacttcaccgccggcccgcctccgtcgccgccgagtggtgcctccgcctacacggctggcctattatgccgccgctgttgggcgtctacgacttcaccgccggcccgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgtccccgcctatacggtcggttggtcacaccaccgttgatgggcatcgtcatcttcaccgccggcctgcctccgtcgccgccgattggtgcctccgcctacacggctggcctattatgccgccgttgttggatgtctacatcctcaccgttggctcaccttcgttgccgtcgactggtgtttccgcttacacggctgacctattataccgccattagtgggcatcttcgctttcaccgtcgaccgccttcgtcgccgccgactggtgtcttcattattattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctaacacccgggggctcgttggatggaccgagtaacgcaaggtgctaagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacaccaccaccggctcgcctcgaccgccgccgactggtgtttccgcctgcacggctggcttattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggtgtctacgtcttcaccgaccggcttgcctttgccgccgccgactggtgtttctgcctgcacggctggcctttatgccgccgttgttgggcgtctacgtcttcaccgaccggccgcctcgtccgccgccgactggtgtttccgcctgcacggctggcctattatgctgccgttgttgggcgtctacgtcttcaccgaccggcttgccttcgccgccgccgactggtgtttccgcctgcacggctggcctttatgccgccgttgttgggcgtttacgtcttcaccgaccggcttgccttcgccgccgccgactggtgtttccgcctgcacggctgacttattatgccgccgttgttgggcgtctacgt

SEQ ID NO: 60207 - DNA, 3028 bp, Oryza sativa
aaggacaagctatatgctcaggggctcatcagctcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattagatacaatatcattgcttttcgccacgtaagtgtgcatttttattgaccaatgttatggcttaggctgattatatattgtggtcattttctaggcggttggtaaatcctttatgagtttatttactcagattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgaccagtcataggggataacttatatctatagaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctataatacacccggcggattcaaatccccaaacaggagtagggtattacctctcattgagagggcccgaacctgtctaaatcctttgtctccacatccatccacttttaggtctcgtgcgctaccccgttttattattgccgaaatcatgtttcgacaccctggttcttctaaatgtcctttttccccattaccgctatgatccggtgtaactgcacaacagttttaaaattaaacatttaccaatattgtgtctgaaagaagtgcgcgagacttaacatggatttgaatcagatgtgatagtgtgactgcaatttatgcaatctatgaccgcttattagattgggtccaatggtcaatatgcaccctggtagtgtagatcactgtggcaaaaattgtttacttttgtgttggcactgtagccaataatctggttcattcatcaacaaaatggatatagtcgcaattgcgtgccatagcttaacttgtaggcggctctattaattcaaattgtgccttaacgtagcatagaggtggacaaaaagcgcaaagctcatggcttagatcagcttgtagcgatctcgactcagataggctcgaactcgtaatcttaatgagtcaggccaggttagatttttaactcataaccttaacgagctaactcgcgagctcctcgtttagcttgttagtacaagatatcaccacatctttatatacttagtacttcttaactagtgcttagatttttaattacatcaaaattattcgtatttagtgagttcttcattagtttgtgtttattattatgttaatatatgataaatttgaaattatcgatatgatataaatgagatagagcttgttaacgagcctaatgagcttaacagctcacgacccgaaccgagctagtcttttagctcaatgttaatgagccgagatgactcgtactaagataacgagttttaacgaattgagccttaacgagtctagctggttcgttatccagccctatttagtggtggctaacgagccaactcggctcgacttgtaaaaactcgttaagttagcgagctagctcgggttgacttgttaacataatgagttaaaaatggaaagcgactcgacttgttaaaataacaagttaaaaatgaaagcaactcgacttgttaaaaagcccaagtcgactcattaaactcgttacatcgaaatacatggtttaaaattcatatacatggggcaaagcgaagtttgtccctcgcgtcgacctcgcgcggcggctcgggggcgaaaccctagccgccaccgcccctcctcctccctcctccctgcttcgccgccgccggagctcgtcgccggcaaagccgggcgacgcgctgggatggcggcggcggggtaatctccctcgactccatctcgccccggcgcgggtgtggcgactatggcggcgggacggcgaggtcgcggcggcgggac

SEQ ID NO: 60208 - DNA, 2921 bp, Oryza sativa
  unsure (1)..(2921): unsure at all n locations
tcggcgtggccggcgacggtctcggtcgacgccggcgccctcggacgtagcaggtggccagcagcttcggcgcggtttcatcggcgacgacagcaccgggtcggcggcggtgctccggcgccggctgccgcgtggtcctggccaggggctgccggcctgctgcggcttttgccggcgacggggaaggcgcctccatctccctccctcctggtcctccagatccggttctccccttcttcagtggtgtttcttccggtgctctctgacggtgcggcgtccgctcccctcttcttaggtgctcctcccttcttaggctaggctgcttccagtcgatgccggggagttccgtggttcggtaggggtggcgtgcggagttgtttcggcatcctgttcgctggtcgtcggccgcgccgttgtttccctgcagctgggttcctgggtgtgaggtggtctctggtcgagctgcagggttggctgttgaggtggagttggagctgcttgtcttgcaagctcggcaacgatgaccctcaacgaacgtcccggcaacgcgacgagggttttgaggtggagcagttcgagagagccttaggtgaaaaccttgcctagtgtcgtaggctctccagaccttccattatatttgagagatgaagtgaataattcaagtcatcaaacaagcataatgaaacatccgacgcctcgagagaggaattttggagacattgctgggcccttagcctgccagtcaacttcagcctgagatgtgcccgtcaaaccactcaaaggcggcgaccagatgtgttacacattcaggagacttgacaaaaatggctaaagatctacaacctctcaaatattcctaactcatactcatgtgaatctagttcccaggatgtgcactagattcacactttcatcttaagcatgattatacatagcaaacacaactaagatgaaagaaacttaagacttacaacaacttaataattacataggccaaccggccaaatagacttattagagaacagcggaagcttgactacccaatcacaagcacaccgactaggggtttaccctattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctactatactacatgtaaggcatatattcaaaggaaggcaatatgtagttcaatttcagcatatagcaagttttgttttgcaagtcttgtgtaaaggagttgatgcttcgattaacaaagacaagtgctaagattcattattagcttattcataattccatcatacacgatctcttattgccatacttcacaataagtcataatgtatcaccacatacacaactcgacacatttatcaattcaaaccaatgtcacatgatcacatttttaaaacatagtctatactcatgacacatcaccaaagcgatcatgaccgtgagcacggctaatcgattagtttaaagaactctgcagagtttgtacagctttacccacatgatatgaactctctagtttgttttgagtttgcaagactccaccacactcttcatgttgaatgtgatctagaggtcataacgaagcctttacactacttagagcctagccttgcaccagcacgatacgtgttcctccatcctaggcatacttggaatatacctggaaccgttaagtggcgggcccacgccttaaacttaacgccgtggtagcggacacgacgggaacccaccacgtggcacaataccgttgtattggacacgcttagtcacctaaactaccacgtcggggtaaataggaagctcctctgaattatacgaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactatatgcacaccacttgctgcccaagtgtaaaatcacattttacacattttagttcgcaaatacccatcatattcattttattccagcaaaggttcaagtatcaaaaccacattttaattatagatggaatgagcatttgcatatttctaagcatggctaagcaagtaattgcacatagagcatatataaacccatatgagcacaaagagtgtactctaaccatttctagggttcaaacagcaagaggatcaattattcaaggtgggttatgcagcaaataggtcataactaccttaacccagtttcaaataccgatatagtctaagttcacatgcaactttgcaaacaaatattttcattcctcaaatcatgggatccaatgtgttcaaaggatgggaggagaaaacttgccttgatcagagaattgttagcacctaatccacttcttcaccgattatgcaattatctagataaaggacacgacatgcaattaaacaccgaaagagctgaaaatccaaaatgctctaaaatgcattaattaaacncgtcnngcgnngcaagcnnnancncnnaatnctttatattatgggacggagggagtgttgttcttttgtggctgatgtcgatgtggtaagacactcttatatcccacacgaaataaaatatactacctctatattatatttcaatgtatgacgccgttgatttttttattcagcgtttgaccattcgtcttactcaaaaaatttatgtaattgttatttattttattgtgacttgatttatcatcaaatactctttaagtatgatataaatatttttatatctgcttaaaaatttta

SEQ ID NO: 60209 - DNA, 1288 bp, Oryza sativa
cgccgccccgtcgccgcacggcaacgccgccgttggccgctccgtcttcacggccatcgccgtgtccgtgctctccgtcgccgccgctggcctgaagttgatctagttggggggttggggggggggggtggggttaggatggcgcgcgccctgtgaattgtgagcttttgcgtttggagctgtgttcatcttctcttttgcccccctcctttcgtgtcgtaattaattaaactagtatgatcctgtggaattgctgcaatttgaggatctctgccggttgtcacctcatgttttggactttggaattgtggtttcatctcagattagatcaatcgattgaacaatcgtatgctgctacaacacgtgcctgtaacagttttcagtttatcgtagtacaccacactcaatacacatgcttaccatattcatataaacaccttcaagaatagtatattttaagattcacaaagttattataggtgtctccatttttcatgcattactaagatttacgaaattatcataagtgtcttgttgtcgatacgttgtttatcatcaaaacaataatcagtcataaatataaacgcacatgttatgttaagtctagaactcgaactactttcatccaagaaacttatgttaagtctagaactcgagctactttcatccaagaaacctaaccagtgagattaaactcattttgcttttgttaacttttggtctcaaactaaacttatcctaatccattggaccatggctccgaggagttattaatctatttggataacagcatgtatggcagatcaagccgtacgagtctgaatatgatgtaggagtactccaaaataatcatcgcgggacacaattattgaaggcgtcagtacgatcaacaattttcagagaaaaagctgcagataaaatgcggggcggcgtttggtccacaatgcaaagctgccaagactgccatgtcagtatgtcactagcgatcaacttaggggctgttcactttggtgccattttcaaccttaccaattttagtaaagttgccaaaaaagtggctacatttagtttgctgccaaattttaataactatataagaaatcctgccaaaattttggtaaagttttttttggcagcaaagtgagcagacccttacttgaacttgaactgacaggtgtaatgccccccgacctgtccgtcaggccggcctgcaccatataacaaggactcctatgctcagtgacctgatctggctatgtttggacctgttcactttgatgccaaaaaa

SEQ ID NO: 60210 - DNA, 738 bp, Oryza sativa
ataccccgagaatggccctccgctggatggtgaggcagaattgcctccgttgttgtagtcgttcacggcacctcctcctggcgcaccagctccggatccagctcctgtcggcggcggcgcaccacctccgccagcaactccagacatggcgatgagcagtcgtgcaggaggcactccccaaaaacctgatcacccgcctacccggtgcagatctcaggcgaaggtgtggtttcggaggcactgcttcttccaatctctcgtgcgcgcaagagatcagaagcggggaagggatgtcacgcccggaagtttcccctttttcttgctttaaaaaaattggttaaataaattgtccgaagaaattatcttaattaacctagagctaattccataattaataaatgcaattaataattggaattggcattgtgggatttttttcttgggttccacatgtcacaatatattaacaggatttttagtggaattttcagagccttggaaataatttttaccaattaaaaatcaccaaggtgcaattttaatcccaggaaaatcctttttcttttttttcttttccctccttttcctttgttgggccgtcggcccatccctctcccgctcggccttccccttgtgggccggcccgttctccttccccctctctccgggacgctgacaggtggggcccacctgtcaggtcgtccccttcctccagccacccgcctccgacggcaaccg

SEQ ID NO: 60211 - DNA, 1988 bp, Oryza sativa
  unsure (1)..(1988): unsure at all n locations
gaagataactatttgctggttctatagaaactttgttcatttcatttggactaaaaataaattttctacaggttttacaaattaatggctgctctatgttagtaaatccttatatgaatatttagagacttttactacacagcaagtatataatcttatttcataacatggaaatacatgttttagtgatcctacataacttaagtttattcaaattgaagctaaattgggttctacatgaatttctaaagtttagcttatctaaaactaatcattatagagataatagttttagaggcatttgatgcaaagtaagtaattacttttatttcacttaatcagagactgtatgatgatgaatctgtagaatttgattttgtttcaaaatgagttgaaatgaattttctatgtattttataagtttgtacatgttttatgtataacctatcttagataaattttagagacattatttgtacagtgagtgtcaagttttatattcctggaataaagttcataacttcaagaatctacagcaactggaataacttcaaaatgagctatatttgattttatatagattttacaactttgtgcatttttctgctaaacatatatttgtttgggcattttcctaatttttcttcagattttaaaggatgggtccacatggctgtgagggaccaatatgcacaaaggcccttgaggtttctaggaatcaacccgcaggcctaggcccatatgtcagtgtgtttctacaattgtaaacagatccctgcacttaatctaattcacggaagtcatccctctgctctaggcagagcagagctagccatggctgagctcgatctggagctcgccggcagcaaacggtggctcgtttgaggttgaggtcaaaagataaaatgaagagcaagctctcgcgattccattcctctagttttcttggttagaggacatcggagtagcgccgatgnnnatgtgagcggcggtggttttggggtgaaagtgcatgtgtgcatggaagtcgattacgaatgaaaaggatgcatgcatgtggtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgtgcaaggaatcgaacaatggctcaccgaggcagcggtaatcgacgatgacggcagaggcgatcctagattggcgccggtgaagaaaaggatgtgttctccgtgttcttgatgtttccggctggggttcttgaggcgttttgaagaggaggttgaggtgatgacaatggcgcagcggctttctctgaggtggatgagaatggccggacgacaacgatggttgaagcggcggcgctccggtgcgtgctccagggcatcgtcggcgtggtcgcgttccggtggctgtgatacacaaaacgggaggtggtcaaaagagaaatggttcggcactgtgtggagagaagggaacgcggaaaacctggagatgacctttacccaatcagcgatggcgatggtcgtcgtctccacggccggcggcaaggtttggggcgatggagaggcagagaacctcctccctcggtttcttcggctctgagtggtgaatggagaatggcgacgcgtctaggaggagtagagagcgagaaaaaggaaaccgagatcgacgacacgttgcggccacgcgtcggctcgctcaatctctccctctctcggctggagcagtggaggaagtgatggacagagctgaacctagcctaaggcactgacaagtggggccaactcgatggaaactaggccagggagagagatatgggtagaagactggtaaactggatttttagattaattttcggaattattttct

SEQ ID NO: 60212 - DNA, 2865 bp, Oryza sativa
ttggctctcaaaattggagaaattaacctctaactattttgataagaaattttaagtcctaaaatttcgggtatgttacacctagtctatcctaggttgatgatatcgacgcttgtgggcgccgtttcctccttggaggtgtcgtcatgttggttctctcttccttcaggtgaaaaccgggttcctttcggaacgggcgttgacagcatccttaatgttgtttccttgttgaaggcttcgctcagaaggtatttgctccactagaggatgtttggtggttctggagaccttgtcattatgttgtcgaagctgcttgccttttggtaagctcggtaacgacgacttctgtgaggtctcattagttgtttcttttcttttctgtattggtttttgccggtttcccgtttaattaaccgtgcttgtttggttttcgggcccggtttcccttattaactgggccaattctcttcttctataaattccggcaggagaaactcctgccgtcggttcctcgaaaaaaaaattcatatacatatataaatcatgatttgtgagcctatgaccaaagattatgattgtcgtgctatgtatcatgactaacaatacaaggaataattacgagtttattacgacctttacactggcaaaatgtggacaattaacttatatcttaatacatcatgcgctcaacgagctacctcgagttgtctcattaaacaaatgagtaaaagttcaaactcaactcaactcattaactgccaagtcgagttgagtcgagaagagttttacacaaattaaattggggcaatagcgcttttgaccctgttctagaacctaccaatttgaccatactttttcaactttgctcatttgaccctcgtttttaaaactgaagatcaggtctgacccccttctgttaaatcaacgtaacggtgtgcccttcttattcacacgtttgtgccgcctacctccttgtttggaacaaacaggagaagaccgcgtcgccatcctcttcgaagcaagaaggagcatcgccaccacacatcgtcctccccgtccagatcgaggaacagcgccgccaccgtcgccgtcctcccgtcacgacgcggcgccgccacggatttactccctccgtcgccgccgccgccgctaccgtcttccacgagctggcgtgaccgctccctctctccacgagctgacgccggcacggatccgcttcctccgtgtccctccgccgtcgctgctgccttcctccacgagccggcgcgtccgctcatccgccactgccgcaactcgcccctccatgcgccgccgccgcacaggatatatgagagagagaaacggtagtgaatgggtaggttagatgtggattggtttccttgagggtagtttggtcattacagtatttttttctaaaaaaaatggaaccttaacagtgcggtggaaacagggttagacggggtgttcatttttgaaaagcgggttcaaatagcaaactagaaaaaaaaaagctagtttagtagttagtctttcaaatgaggtcaaataagtaattatcccaattaaattagcttacgagtttcgagatttttgaccaacccctattcacacatatccatccagcatcatagacccggttaagcccctcctatttgggcaggcctacatcccgaaaaggtgctccatggaatgccaaaacgcacccgtcccggttcccattcccattcatagctatctaccacctttttcgatcgttacgcaatgctcgcgcaataacgaaatctaccgcgtgccataccgccacgcaactagctagatgccactcactcgaggttagttaggcatgggcatcacatagcaaactggccatcccatagctttcctagctcccacgagacgaccctgcaccctgcatgcggcagcacggcgcacacgctcctttcttgatcgtgcgcgtggagcccagacgtgaccggccggaacggactccggcttggttcgcccttgcacagcactgcacaagcacaacccggtcgatcaatcgatcgatcagtgagtgccgaatattccgcacctacacgtgttcaccgttatgcgatgcacaagtctagctagtgcacttgaggaataatttggatgcatgtatgctgctgctgcgctttcgaatgtcaggaaaaaaaaacacatgggtgatgatcgagtgaacaatgtgtctcatcaatcagctggccctaaacgaacgaaccatactctgattgcgtagcaagtaccgtgggtgattcgattcgtggatttttcgttcaatacaaagagcgctaactggtaacctggtgcgcttagataggagtaatcagataccactggttatctggtgcttagataccacaggttggtcgacaaatgtccagaccgtgtacacacctgcacgcaccaatgtggcaatgtgcaaaacacccggcctcaacctgtcggcaaatgccctcgatcggcatcaattccctaccaccacgtacacccccgggaaacggagagtgaccgtcgagccgctgggaggaggaaacaacaaccggacgagaagaaagaaccagagctcaagcacccaaacaaacaaaaagttcccggttgaaaataacctgcagtagcttagctactagtagcactgtgagcactagctttgtcctgttccaatccatgtcgtagtaccgctggtgatgctggtaggaccggctagatgcaggccggatgcacctaccttcctccccgtaaacaaacacgtacgacgtgccagcccgggacccgattcgatcgaccggatcaggcaaaaaaaatcataccagcacgaaaagcaagccaaccccgcgaaag

SEQ ID NO: 60213 - DNA, 1929 bp, Oryza sativa
gcaacgcaccggccgcgtgcgcgtcgcgtcggggacgagacgagacgtcatctcgcctcgggtctagctagccggtgcaacggctgtttcgcccgtgtcccctcccgcgcgttggctttcgttcgggccatctgatgatggggatcacgctgtcacgcagcacgcgccgtgcgtggcgcggacgtgccagaaaaatgctctcgcgtgcgtgcatcaacgcgcgtttcgggtggtgtgtgcccgtgtggagtacgtatacaacctttttcctggttcgcgtcagtgcttgggaagagataactgttttgtgttacatcaggtgaattcagggtttttttatggcaggcagcacgttcacgttaatcggggatagactatcacctattggaattgtcatatgcggtgcatcggtgtgaattaatatctcggttcgtaatcgtgattggctggtgcgttcgtgcttactttagagctcgtcgtgccgggacaagatgtttcacttcacggtcttcacgtccgtgggtgatgacgtatagatgaaagcctaagaaatttagccttttattggtcttttgtttaatcaacgaggtagctgtcgagctttaggggtgccacgtgtacgtccaacccagagaaatttagccgtggatgtagagccgctggtgaaatgatcgatgtttactggagttacgactaggtcatttgtttggaaaagtaaccactaaccagtcaaggtcactggccatctggctccacctggacagattggacgcacgcacttgaagttttgaatagttcatgacgtcttttttagtgctttcttctctaaatctaagatgagcataatatatactgtaaaatttggtcaaatcacgtgtaggtgcaccagatgatgtaggagtaattatgtaatgcaccgtgcgtaatcggttacggaactgggtagtaggtttaccgaattgcaccaatccattgttggactagatgatgcaatcgccttgtgagcttatttacgaacaatatgatcttatattttctccgttcaagtatataagggatattggcctaatcccttatctaaatatataagcaattttacaatcccaagacaatgtttatcttctatccatcaatgaactcatgcactagtttaatcctcacttaacaactttggtactactccctccatctacttttgatagttatattttcaaatctgaaaaatttatttttgataggtatatttcaatcaaacaacctatcatcttaatggctttcttggatttaatacgtgactctcaattctttcacataagattggctctatgggcatcgagaaatgtaaatattaataaatcgcttgtttacgaggaatgactagtagcatatttaaatagatgataagtagaattatctatcattggtctgtctgccaagataacatatgactatcaaaagtagatgaagggagtattagtttattttttcaacctttaccttatgtactggtttatttcctcaaccatcatcttttatactatgatttaaccctcttttaacttccttaattattctcaaaatggcataataccatgtatttaaagacagagagtactttgatcgcagatcattcagaaagaaggtctatttttgagatgattcaggcagaaagtttcttttttttgagagagaggaaggcagaaagtttcgactttcgatcatctggtagcaaacccagcaaaacttcagcttacaaggtgagcgtgaacccgacaggtcgtcgacccttcggctggatggagcagcagctaatcgcggttacacctttgggccctttcctcggttgggccactggaaggccgtagtgctgctcattgtagccattgggccagtgtcacatgggcttacaatgaaaagcccatgttctcc

SEQ ID NO: 60214 - DNA, 3855 bp, Oryza sativa
gcgtcggacgtggtgtactacgaggcgttggttgaccccttgattgagacgatgcggttcttcgtcaagggggaggtggtgttcgtgatggcgcacatgagaaggtggaagcgcacggacaagaagttcttcgccaaggcgaggaagctgttcgacgtcgaggtggtacacgaggacccgccgctcgaagggtggcgccatggcccggtggtctacctctttaccgagaagaagcggcgtgacaagaagtgaagaagctcttccaaaaggtaatgactgcctgctcgattgtgttcgtcatgtgttctttctgtttgttgtgaaagatcatactgttagaattcaaacagagaaaaaaaactgagggccaaaacttggttgtgtggttgcatatggatttggatgtgtcaggtgctatcctttgttttatttatggattctagttaattctcatggagtcacaatgaagtttaggatttcactatcttagaataaccaatctaataatagacgatatgattatgaggtggtagtagcagtacaggactttatgattggcaagggactgccgaaatttgtagtttgaacaagacaaagtttttggttctcaagaacacaagtctagcatgtcttcgtactagcacttcaaatggtgatggacggtctctagagaaaagatcaatggcacaattcctctgcatgcaaggaaggaatgacataaaacattatgttacttaacatggaaagttttttgttcttttgtgttacttttatggaattgaagtggaggcccaagaattatgtgttccattgctgctattttccttcaaattgttcatacatttagtagtaagttccttttgttatgggaataaaactgtagaaatccatttacacgaggaactgacctttttcttgttaacatgcaaagctatcaatatattgaaagcgagaaaatcagtacattacaaattaaccccaagagaatgcagatacacaggcttacaccatgacatttagctatgaaacaataattgaatcagggatgttcacagcatttagctagagtcaaatacacgtctgtttgcagttaaacttgagtgcctctcaaaaacagtcagcactgcacaaaggcaaacatgataacacaataggaatacacggcaaacctagtaaccaacctctggcaaccgaacagagggaggggcacaagaatcattggttgcactggacgagctcgtatttccataactgttcggcctttccagctccttcagtgtcccattagatgactgtgaaaatctgcagagagaaattggtggtgcaaagtacattgccactggcatctttggtggaaggtctggtaatggtgcttcaaacttcagtacgcttatgacctggcgaattgaaggccggatattataatctgggtgtgcacaccaaagtccaacaaccatcaaggaaataacttcccgctcttcaaattcaccatcaagccttccatcaattgcattaagtatctcatttcttccataaagatcccaaacccattgaaccaaactgatcctgtcattatcttcctttggcacaacgggcctccttccacaagctatctccagagcaagaatgccaaagctgtagacatcagtctctttgcttgctttcccagtagtgacacactctggagccatgtaacccatggtcccagctatcactgtagtttgtgagcctcggtcatggtctacaagccgtgcgagcccaaagtccccaagcttagcgttgaatccagaatcaagcatcacattgcttggcttgacatcacgatgcacgacacattgttcccactcctcgtggagatacaggagggcggatgcaacacctatggttatcttgaaccgcaatggccatgctaacaggtttccaccatcatagaggtgtttgtccaagctcctgtttggcataaactcgtagactaacaagaactctccatgctcatgacaccagcccacaagttgcacaagattccgatgccttagtctgctgatgatcttgacctcagagatgtactccttcctcccctgtgttgacccttttgcaactcgttttatggcaatttcaatgttttgatccttcaagaaaccctggtatactgcaccgaaacccccttctccaagctttctctctgcagcaaaattatccgtcgccactacgagttcattgtattggaatctccttggccccttgcctttctcaaactcactgtcaatggactcatcacagtctagtttctctttttccttctctcttgaccttgtagtccttctaatccttctaaaacataaaaagaagcaaaccaagccaattgagcagaccacaacactaccgctcgtagacaagcttatgaccaatataccttttgttttctcagtcttcatcaggtgcacatctgtagaatcaaattcccagtaaagaatctggtgcagctctacaaatttacctgtggaagcagagaatccgatggacactttgtcagggagatatttgctgagatcaaccgaataagataggctggagttgccactgaattgtgggttgtcctggtacgacaagaagacactcaagttccttgaatttgcctggtaagttacccaagcattggctatccggccatcgttgatactacttcgccatgtcacgttggctacagatacaattgagtggatgttgatgcctacatggttgccatctggatcccaagtgtttttgtggctgtcaaactcaacagccacaatctggttgagtggatcgctctgatcattactattgctgaagaggccaagataaccatccatggagttattggggaccacagaagggtatgatgagaggaagaaggctaggccctcaccgtacgaactgtcgttcgtgggtgcatatatcttgaacgtgaagcgggttgtgaagctggctaactgaccggtggtgctatcccagagaggcactggatcggtgtagattgctcggcctacgctttgagtgatctttccattcaactcatccttggtgagcttgaccgccttgttgtagaaggcatcctcctggagctgaattgtggctgatccattatgatttgattcagtgaagttcaacttgaaggacagaggattgacatgggcaattttcagggatagggaaaagtagagagccaagaggcaagtatatttggttcttgatcgcatggttggaatcctggaggctggagagagagcaggagggagagatggaaggaaggaaatgaaaagacactacttttgcagacctgataacctgtataaccattaacttggtcaatctccttgattgtctcagcaatacttggtgctattaaagggtagtatcatactgccggcctgtcaataggccctgaaaggacagatgtaagccacaggagaagcagctcaaatttggaacttaactaagctttccaaaaagctagatgaagcttggtttgtatcgtctttgccggccaagattatgaagtcaagtatgtctcgcccataatatgattatggtggttgccggcagaaaaggaggttatctcctctcagcaaatggaacatgtattttctaaggcagaattggactgagttcagacatgcacagaatctgccaaaaggaaagctcttatcgatcttatatgcttaacaaactgggtcatgatgtaatttttgtctttcatgcggcatacaacaatttcatgcagcacaggagagtttattaatacatatagcacaatgatttaccttgtccttagggatcagttcgatgacaacttgacaagcagtaaatatttct

SEQ ID NO: 60215 - DNA, 7426 bp, Oryza sativa
aaaacctgcaaggaatattcgtaaagtacattattgagtggatctgtcatactcaacatgagtttcaagtttgctgccatgaatcgatcgttcatttcgccgtgtcgctggtgtttgtgtcgtccgttggccacgctacagtttccattaacctctgacgcattatctccagattctcattcgaaatcttctcgtacatttttgcatggtcacatttctgcattgatgaagaggtaactaattaaataatttatgcatcaaagatgtctcaaattactctggaatatctcactcttttttattaccttgatccatttgctgtacaagtggagtcgtgtgatcatcactctctctgccaaatcttgcctctcctggtgcatacgaagtcaaattaattagagaatgaaccttggcacaatgctgaacatcatatatatttttcttcattgcttagtaacaagatgcaaaaagatacctttgcgagtgcgatgaggaaatgtttgccctcctttggatcgttaaccacgacgtagctgacaaatcgtaagtgttcgtattttagacgctaaggatgcagattggaactgacaccaacattaacctattctacttagatttcatttcaacatagcacaatatatcaatgtgagattttcttgcaatggggtgacttacttatacagccaagtataagcaggtggattcatttcatacaactggtggagcaccgtgcttgtggccttgtaagtgaagtaattcatgatttcctgcaaaatggagagaacaatcttcagagttccatgcaatctaaacccaattaaccttgcagttagagaaaattaaccattatattgctgtcgtttacagatagcgttccgattatcccctgccggttcaaaaaaaaagaaaatcgaaatcagtagtgtacacgcaccgtgtgcacgtcttcgaacccctcctcgtactgcccggcgaactcgtccacgatgacgaggccgcggcggccgggcctcctccccctccgccgcgccgcccgcgccaccgtgcgccgccgcctcaccccgacgacgacgccgcgggaccacggcaatggcgccgcgcggcacgcggaggaggatgaggacgaggagggaaggcagacgaccgcggcggccatccgcgcgacggcagccatcggcggcgccgcgaaggagagctagagatgtttttttccctcccgacggctcgacgccggctgcgacgatgcgagccgcggcggggttctggataggcagcagcggtggattttttttgctgaggctttggctgattctgtccgcgaaaacagcgcgtttcatgggcttcctgagggcaaacgggagaccccacgttcgcgccgatatttcgtccggcagctcgctgattggtggcggaatggcgacgagagatgattctatttgcctctctgtattttcgcgattcccttgattctttttttttttggcttcagaagtacatttctctttcagccttttccttttttttttgagaatattcacttttagctttttgtgagaatgtaatttgtggaatgcatgactgccaccctaaaatatcttttctgatagtgaacaccaaagtaagggcacttgcgtatgtttatcatagtgaaagaattcaagttctacatttgatattaatgtttataagtacattatttgatattaatgtttataagtacattatttgatattaatgtttataagtacattttactacaagacatcgcaaattcgtgattttagttatgggacaccacatgaaatcacttttggggtaagacactatgtaatcttggttatttgctaacgggcacggctcccatttatttagcgttttagtgttgactatgcaagagctgtccactttttgatgcgctgtgaccaaattgcccctgcccatcctcaaattgactcacctatcggctggcgccgctcttcgtcgtgcagttcatccatctcgcttcaatcctcgagcttcgcctccactcactcctcacctcagacactgtcactccgccgtcaccgcatcctccccaccagcctgctctcctccctcccgacaccataggcgccacccgcacccacgttggtcgaggcgcttccttcccctccaccaccgcaaacctcagtattaggagcaggagaccagcctctaccatggtgttgctcgcacccacatcagtcatggcgcttcctcccctccactaccgccgttgcggcggtagaaccagcatgacgagaagggcctccaccacggcgccacatgcacccacattggtcgcgacacttcctcctcctctactgccacaagacaagcgccgtcgcgagcctagcaggagcccaacccaccgccgtcgcccaagcccccttccgcagaggagttgggctagggtccacctacctcgtggaggtcatgtcggcgtggctcgtcagcttctacctaggagcctagcaagggagctgaggggagccggaccaagccgccacagcggaggtggaggaggcgaggagggagggccagggtggttgctgatggcgagcagaggtggcactgtggctggagtgtgagaaggactgacctagggatatttttgacgtttcatgttgtttatctctcctatttagccggaaattaatattttaatgactatggtgtccataagaaaaaaaaccacattttgagagtgccttcccctaaagatcgacttttgacgtgccctagagttaaaaaccacgaagttacagtgtcctacagcaaaatttgccatgtttatatgagcatctcatttgtactatgttttgaaaaaaatcttgttctaactgagactttagcttagaccctgtcacgtagaatgttttgatactaatttagagtattaaacatagcttacttacaaaactaattgcataaacgagagctaatatgtgagacaaattttttaagcataattaatctataattaaagaatttttacggtagcatcatataggataatcatggattaattaggctcaataaatttgtctcgcgaaatagtccagagttatgaaataggttttatcattagtctatgtttaatacttctaattagtatcaaacatccgatgtgccagggactaaaattttttaaccccatccaaactcccccttaagaagcccaaatccgaacacaacgctttgtagctgactagcttagacctgagggcctgtttgatatagctccaactcctaaatataagtccaggagtttagtctggagtagagttgtggagctgcctaaacccacctccacaactctagtatattttgtgagagagctccacccaactccattcctaattttggtggagctgaaactgtttggctgagctccagcttcagaagggatggagctggagctgaagctgtaccaaacgggcctgactctgagaggaaaggcctgactccacggtccacgcgcaccgcatggcgtacgcgcgaaatggttcacggactcgcggtcatgcacacccgcgaaaacctgcgctaagcaaaagcaccggaaaagcaacggcacgagcccgtgccccgtgaggcaatgaaccaaattggcggccgcgtcaaccacgccaccgggacgcgcgcgacggcaagaaaaagaagtcgcgaagtcgcggattctgcaggcccccacgagaccacggtttcctacggccgatctcgcggggacgcagccggagacgacgcggtcggtcgcgtcgcaccccacgccccggccggttagtggaccgattcccgcaccggcacaccgcgcgcgcaccgcgtcttcttctctatcgcgacaagtctggcttggtcatcgcgtgagtcgatcgcctcgttgctttccgtggccgcgtccgtcgccgcctcgcgcaccagcgaatccggacgtcgaccgctgcctgcggatgttgtggacagctcacagttggtgttcctctgaatgcacaggcgccgtggttcctctcacttggtgtgcaatttaccgtgaaatcccagtgagatataacctacgtcttcgtaacggtctcccgtcttaactccgagtctctgactaaccgtgaacctgatgatgcagttgctagcctcatcgcgtgcgacgaaatatcaaatgatgtcgtccgtgtttagatgacttcttttgtactcctgcactgtctgtcgatgtcatggcagtaggtgcctcctttcaccgactccacctgctccagaacaaagcaggtaccaactgttacaaggaaaaaaaaatctgtattttccaatactgtctatttttattatcttgctttgaatactaaccgggtatttattttggattatagaaaagaagtacacaccattatgcacacacttcaaatattcgtaagccagtagaaaacggaattgtgcaggtggcaagcattctcttttctaaaaaaaaaatcaatatcataaatcacattcatttttctaaaatatttaatttattattaaaattaaatcaagtagataataatacatggtaataattcaatgaataacccatgccaaatagagtcaacaacattgttcacgttttcgacaaaaacaaaatgaaagccaccaaattataaggtttcgacgttgaacacaagcagattctaagtaacttttcaaatgattttcaagaatttaaatttgaaataataaatttgattggaatttatcaaggttcatgaaaaccgtcataagatcgggatccaatgctcaattgaaaatgtgagaccctgccaacaacggctgtgtttagatccaaagtttgaattcaaacttcagtcttttttcatcatatcaacatgtcatacatgtataacttttcagtcgcatcatttttaattttttaaaaaaatttaactttacgctgaactaaagacagccaacgaatcaaagagggttatagccatcccggccgttttcggcccgggtcaaaacgttatgtatgctactcgatttcgtgcccccacacccttgacgagcgagccttgccctcttctcttcccttctctcctaccggcggcaactaccgggaagccgccgccgaccgccggagcggagtcgtcgcggcggcgagggcgaatcggtaacccccccccctccggagttccgggatggggacgccggagttccccaacctgggcaagcactgcagcgtcggcgactgcaaccagatcgacttcctgcccttcacctgcgaccgctgcgaccacgtacgtctttcccgtctcctcccctggccgttttcgtgtctcggtgcctcgttgccgaaatcggatttgctgctgcggtagtttttaaggaaatttgttcttctgtagattgtggaaccaaagaactgattcttcctggaatttttgcttgatatacggtttcttgaagtagatcttggaaagcacctagtttagggaaaatctcgtctgggctttagcctttaggacagtgatccatcacaatcgaggagatggagaagggaaattcatgccaatgcctaggcagcacgaatggagatctttttttgaccgtttggtggatgagagttgatgtgtctatcgttgaccgagaacatgatgaccctttcggtgatgctcttgcagttttgcgcccttttggataattagtttcatctactaattgaatgctatgtagccaatcacataattggtcagaattgttgcttcaataagaatgaaattgatctcagacaaaatctgaaactgggcttaagaatgcaatgggtatggtttcaaatttggaacggggaaaaggaggatttagttgacaaggagtccttcattgttagcttgttgcctatggttgaatgcacataatgataggaaaaaaagaactgaaaaacagtagtggaagtgtggtatttattcacaatgccattcatatctgtattttgtgccagaaacatgccctctagtcattgtactgtttctttgttgccctctagtttctttcgttgacatcacagcatgcagctccactggaatcatgacactctggaattacacaccatataggagtatgcgttattgcagtgttcaagcataactcatcctgagtagcactccaaggtcttgagttcaaatctccataggagcaaatttcagattgggttatttgagggctaagttccctgtttgataggctaagttcctaatttaaaaggctgcatatatccggttggatgtagaggccggataaaaaatacccttctctaaaaaaaaaagcataactcatagacattttgggttcaaaatttttccataatttattatttttgaatcctttccacttcatggcttcccgaatgtaaagtaacattgcatcaacatccaattggcagcactgacatggttatttgatcattgtttaggtcttttgccttcagcaccgaagttatacatcgcatcagtgtccaaatgcaaatcagaaggatgtgactgtcctcatctgcccactctgtgctaaaggagttcgcctgaacccgaacgaagatccaaacatcacctgggacacccatgtcaatagtgactgtgatccatcaaattaccagaaagtaacaaagaaaaagaaatgcccagtgcctgggtgcagagagacactgacattttcaaacacaattagatgcaaagattgcaccaaagaacactgcctgaagcatagatttggacctgatcacaagtgtccagggccaagaaaaccggaatctacattccccttcggaaatatgcttaggagaagtcagaaagcagaatcatgttcaaattcaaacagcagtagcactagttcatcctggtggagctctagtcttcttaccgcagcaacgagtttcaaatcatctgctgaagctgggatgcagaaattgagcacagcaactacccaagccatccagaaggctaaggatgggatctcgacaagcagcagtaacagcggtgatctcgtggagcaatgtgttcagtgcccagcaagattttccaccgtgggggccttaatcgagcattgcgaaaagtcccatcagagcaactcgcaatcaagtcgtagcagagtgacggtcgatgtctgcccgaaatgcagcaaggcatttcgagatccagtgttgcttgtggagcatgttgagagggaccatggaggaacgtcaagagcgtagatctgcttatgtttactgtacctgtgtaacctgtaatttgcttctcattggtcaatggtcatcacactcaataggatttggttggattgtgctctattattacggttgggttcaaaatgtgcccatgaaagaaggtatagtttgttggctgtttcaaggcaagccattgtgaattgaacctcattctagaca

SEQ ID NO: 60216 - DNA, 1196 bp, Oryza sativa
cgggttgtttgtttagaaatccgtggatgtttcgtgtttatggcttctagatggatcctatgtgtatgtaatactgttgtttgctaacaatgagtcaagttgaaaatagcttggtcttggaatatggtttccttgtttgattcatgtgtaggtgacctgatgcctcagaagagtatagtcggtgatggatcgggagtcgacttggagataaggcgacgtccggacgatcggatatcatgcgggatacttaggctaaagatcaatgcacgtggttggtgaatattccatatgacatacgatggagatattgtgtgcgtatgggatgcggaggccattccagggctgtcgaaccgggcggatctataccggtcagaccggcggcacaagcacgatcaaactggcagatcaacctcgattagaccgatctatatcgaaattgagggtaacttttaattccgctaaaaattttggtttttgggtacaccaaccattcaccccctatggttgacttaattctttctacggagttgctagaaatatggcgtcatatgctacagtcgattttttttcagccacttacacagtagttacacctcatttacatcctacttacatatgtaattactatgtaatttttgaatttacatatgtaattttagtacttacacatgtaattttgagacttacattgtaaatacattaaaattagatatgtaatttagggacttacaatgtaaatacatgccgactatttttttttgatgaaaatatagtgccataaatatagctacacccttctttctattcgatcctacagttgtgagggtgacgcgcgccgatactggcggcaagctagcaaatcagaagtccggcgatggcatccaagcgggaaatcaatgtccaaaatccggcaacaaggacaatagaaaggtcttggttagtgtgcttgactaggttgccgttgatttgtgttttgacttttgaaaagactactgttactaggttattccccatagtgtgtgcagtcgcagcgaggaagattggccatttctttgcgtggctcagtcattagttagtggatctcatgaagaaaggggagtgttctgtacagggtgaaattacatcaactactgaaaaaaaaaatacaactgtgtgaatacgcccgccatcttccatctccttgatgtccccaaaca

SEQ ID NO: 60217 - DNA, 1149 bp, Oryza sativa
  unsure (1)..(1149): unsure at all n locations
ccggcaccggaacctggtgcagctcgtcggctggtgccacggccgcggcgacttcctcctcgtctacgagctggtgcccaacggtagcctcgacgcgcacctctacggcggcggcgcgacgctgccgtggccgaccaggtacgagatcgcgctcgggctcggctcggcgctgctctacctgcactccggctacgagaagtgcgtggtgcacagggacatcaagcccagcaacatcatgctcgactccgccttcgccgccaagctcggcgacttcgggctggcgaagctcgtcgaccacggcgacgcctcgcagacgacggcggtcctggcggggacgatggggtacatggacccggagtacgcggcctccggcaaggcgagcaccgcgtccgacgtctacagcttcggcatgnnntgctggagatgtgctgcgggaggaggcccgtgctgctccaagaacaatccatcaggtcccgcctcctcgagtgggtctgggacctccacggccgcggcgccatcctcgaggcggccgacgagcggctgcgcggcggcgagctcgagctcgacgcgaagcaggtggagtgcgtgatggtcgtggggctctggtgcgcgcacccggaccgcggcgtgcggccgtccatcaagcaggcgctcgccgcgctccagttcgaggctccgctgccggctcttcctccgacgatgcccgtgccgacgtactcctccttgccgagccttgcattgtactgcgacgcggcggcagctagctcgtcgtcatccagtgcagggttttcttcttccacgagtggcgagcgttcgtcgacgagctcctctgcagcaaccgccgagtcgtcgtggctacttaagcacaacaacaggggcagtgaaaaaatagtattaggcaacaattgattagatcatatctttagtttgatgccaccttgatgttgcttagctcttcgttgtttatgtgtattgttcttccttgggccgccgtgtcatttgtgatatgtacctcaattcatatctccttttctatatatgcgttttcaactttcctagtatagcctgctatctttgatcttaattgaatgtcacaagccgagtcactgtttcgcgaaacgacatatttgcaaacgaaaggggtgcagg

SEQ ID NO: 60218 - DNA, 1246 bp, Oryza sativa
ataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttgttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagatgaagtcgctccactatgatgacaaagttgcatcgccgtgatgaagtgaacatgagtcggcggcaacagaagcaaactggtagcgaacacgcgcagtagtgaagataaaagcactagtcggcggcggcataaccagtcggcaacggaagacgatgatgtgcattcagtagtggtagctgtataaaccagacgtagaggtgagggcactagtcagcaccagacgaaacgaccggcggtgaagaatataaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcgaccggtcggtgaagacgtagacgcccaacaacggcagcataataagtcagccgtgcaggcggaacaccagtcggcggcggtcgaggcagccggtcggtgaagacgtagacgcccaacaacggcggcataataagtcagccgtgcaggcggaaacaccagtcggcggcggtcgaggcagccggtcggtgaagacgtagacgcccaacaacggcggcataataagtcagccgtgcaggcggaaacaccagtcggcggcggcgaaggcaagccggtcggtgaaga

SEQ ID NO: 60219 - DNA, 1678 bp, Oryza sativa
agaatacaagtatccaaaggctatgactagagattgccaagctggggcccaggcattcaccacattggtctcttactcttagaagccacatcaaccaccttgaaacatactgcagtcatgcgatatggacttattcagtgacaaattgtagagagaagggagttatctggtggaatacagtgcatattctcaaatcccacccacacatccctaggaattctccccgcaaaaaaaaaaaaacatccctagggattcaaccaagtcttatccaacaattcataggagtcatcaagcaatagggccttaaagtatcacaagaagatagttttgcacaagattcttcctcgtacaaacttgtcactgacaaaatataatataaggtgcagattgatggcagaatgaaagacaatgtccattcttgatttttgcatgagcactcacatgactaatcaaaagtcatatccgtcaaatatctaggtagtaagattttgaacaagtcaatttcttatataagcacagagatgccttctctctgccctcaattcaaacttctaagagaaataaaggtggaatactgtacaggaaatattgacaacatatacctgcatgtttgaggaaatattgacaacatattggctaggaggactcttgtctcggtagtggaatcctgtctcacggatagttagaagcttgacaatcaaaacagagtgaagtagttagctgtgtgctatgcaaaatggacattatgtgcatcattataatgtctcaaaaacacattgacttagtccttatcatttaccagttgggaaattatacaaattccaagcaataataatatactagttatacaaaataaacccttttaaggaagcattaatgctttgtttgcatagtaaaggaagcagtgcaagtatattgcaagcagaagaaatttgctagtaggatcaacaatagaacatgcacaagtactcctccagttcttttatataagttgttttagacagtaaacttctctcctgaaccatctacattttgtcctaacttctaacagccaattaatgtggaacctaatacatgcagcacacagaaaaaacatacgagcaatttaggacgatatgctcacatattcatgtttcatgattcatcttcaaaacgtaaagaactatttaattaaataagaaaaaggtagctccctaaaatgccattcacagagggatagcggaagctcaagtaaaagtactgacccaattacaacgaattggacataaaaatacatgtatcctgaccaaaacaattatccaatctaacgacttcattctgtcgtgtgtaacagcctgattattcaaatttcaaagtagcactatcagcgccagaagaatttgcaaggctcaaactgaggtgacaatcaattttggtcgttgtgacagtatttccaaaaaaaaaaaaaatccaaaaccatagttcacctcgtcaaaaatccatttaggagttccagaggtctgaagcagtgttatatatctgaacaacagtccaataatgtcctccatatgttctaccatcaatgatatgaaataggtaaatattacatgcatcataaatcttgagtataaaaaggcccttctggaatgaaactcaccatggcctacatctgtgagccgtataacaacactgaagaacg

SEQ ID NO: 60220 - DNA, 710 bp, Oryza sativa
attcctgcagccctttaggtggcacattagtatttcactacctcctttatcaaataggtgccattttgggatgtatgcagccaaactgtacaaactgagtattaatatgcaaaaggtgcaaacatttgtcatgcaaaaattatattaaacctctcatggaaaataaaactacagtttcactgaaacaaatgaaagagtacacgataaagaaaagtacaagaacacccccattgaaacaatacatggaaacactaaaaggaaaaccaaagatttggttatataatttcttggtttatgttaatcttacatagttacttgctcatttttcagggaagttcaatttataatctttcatagtgcttgctgtttttaacattgtataattgtattccattaaattcctcaggttgggctatgagtttggaagcaggggaaggtgattggagttatgagttttctttcttcagtgttgtcataaagctcactgatgtaggccacggttagttttcgttcaagaaggtccttttttaatattgaatctttacagtgcaagtgatattttccatttactattattgtcgatagagcacatggaggatattgttggactgttgttcagatacataacattacttcagacctctggcactctgaagtggatttttgatgaggtgaatttggtcttggatttgcgtttcatttggaaatag

SEQ ID NO: 60221 - DNA, 1751 bp, Oryza sativa
gttaaacacattgtcgttgtcatctccttgttaagttaccttttgattgatttacccattgccataatccaacagctttgttttgctttcagcttatgatgctcaagttgctggtctttattacggtgttaggccaaatgacactggttttcaggtcagctgtgcagttcacgtgaaataacaattgtttatcttcattgttaatcccgccggggggaggggcttctgttgataatgataagcacattccttttctgattcctgagggagttgaagtgttccatgtgaaaattttatgaaattcctgggggttcaaaaaaggaattttctggttaatgtggaaattgaattgttccactgatactaagctactcctttttgaatacgtgccatttttcgaccaaacgatgtgcatcaaattagtatttactggcttgacgctcaaaaacccaatttagatataattcaatggaattacacttcaataatatctcatgcatgttcaaggaagcaatatgtagggagatagtaatagatgtgcatttttttaactagatgtagttaagtactgagagtggtttgtaaatacttcattactacatgatcttaatttataagatgtacatgatctaatcttttcataagttgctacatctggccccgttcgatctccagttttggagatagatttttatggcacgcaaaacgagaaacctcattagcacatgattaattaagtattaactattataaatctgaaaaaaggatttatttgcttttttaaacaacttctttatagaaaattttttaaaataacataccatttaacaatttgaaaaacgtgctaacagaaaacgagaaagttgaagaatagaacagggccttttatctccatttgttttctttttttcttatttgtggattacaaatggtactatactctctattagattaaatggtcaatattgcataaccctgatttttcatcatgcatgttttgtgatgttgatattattccttctccagaagttagaccccatggcatgttacgtgtcttactaaaatcctcttcttttctaatactccaatatttatgattgccttacagataaccatggttggctacaatgacaaaatgagaactcttttggagactgttattgggaaaattgctgagtttgaagttaaggctgaccgtttttctgtgataaaggtaatggccacactaaagtttacttgtaatttgttgttaccaaatatcttttcaggcctgatatttggctatttggatgagtataaacattcaggaggttccttgttagccacaagttacctctgtttaggaaaaagcggtagtttgcattcatgggtggacaattgggcatgtctgctttagataatggtgtgtattcttattaagattggcgtaaacgtgtaaaatgacatctcttgccttgattggtcaatttgtatgaaaagtacttgcatgatatcagtggtcaatgtacttttctcagggcatatgatgttataatctagtggtcaaagtgggcattgtcttgactccgagaatcacaatttacctttttctttactgaagggagtaagtattgtgtagacaatacttattgttgatcagaaatcaaaatatacatgtacagtctatacattttttcatttccctgatgtctccagtgaactgtttgaatctaacaaagataaaagaaggaggtttttacctatgtgccatt

SEQ ID NO: 60222 - DNA, 2851 bp, Oryza sativa
catttttcctgtccgggcccacatgtcagtgctgccaaacggttaagaccctaacagaatagcgacggaatggtgtggagggcacgataaagttcgtcgatggcatagagggaggctcgaactttttagtggcacagaggcaggggtcatgttttttaatggcacacaggtaaaaacctataaaagaagacatttgcctcactatcttctgaaattgttttccctggaggtaaagtaattcaaaggaatctgagcaaatctgcaaaacatttagtggcatacacatgcaacatttttgtcattactatcttcccatgcaaaaatgggactgaacagctatatacagcaggagagctgtttccaggtgcatatggatatttaagcatctatataattctacctggattaaacatatcatagtttctatatggctatgctatcttggagaggtgaaagagcatactccctctgtttttggagagatcaaggatgaagataaaagactaggatgctcatgttcaatgagggttgggtggggtgggtgggagtaagatgggaagaaatttgaatgagaggtgattgattagacagctagtactctaaaatcccttgtatttgtggacatagggagtatatattatgttctacaatattttgtggtccttcctgatgatgcaatattaagctatatttctatgcattcgacatgaactgagggtgtgaatcttttattgctgtcatcaggaaactataacaaaggagtatgagaatttcaaatttcggcaaccatatcagcaagctttctactattgttcattgatattagaggagcaaacgtgggcatgggatgaagaacttgctgcagtatctcaaattgaagctagcgatctcgagaagtttttgcctcatctgctggggaaaacatttattgagagctactttgctggtttgtttaatactcccttattaaatccatcattcgataatatttttatagcatatttattgtgttggaaatattgctatatttttctataaacttggtcaaacttgttgaggtttgacttaggacaaacccaaagtgacttataatatgaagcggagggagtaactaacatgaatatgtgtcatttcataaaattaccgtgtaatgctgctaatgacttttgtagccacactactctcttctttagagaatgctctgcattgttgatgttattaattcattatgtaattgataatcgatattagggaacatggaaccgggtgcggtaaaaggtgttatgcagcatgttgaagacatcttattcaatgcacctgtcagtctgtgcaaagcattaccctcatcacagcatcttacaaagcgaattgtaaagcttgaaaggggtttgaggtattattatccagcattatgcctaaatcaccaggatgaaaattcttgccttctgcattatattcaggtgtgcctcacttcttgggtgttgtttctgtgcatttacagtttttccttgctcttactctagcttcttttctagcttgaattattatagtttttccctggaaagatacatctaatagacattactatcctgtaacaatgtttccattgcgcagattcatcaggatgatctcaaaaaaaatgttatactccagttgcttgctcttgttgctaagcaaccagcttttcaccaattacgttcagttgagcaacttggctacataacactgcttagacaaaagtacgtacaaccttcacgtaattgataggatgtacagtggtctttttgccttggttggcaagaatggtgttctatatgtagactatgcaattcctgtaaaatcattgacactgatcctgtttacccagaaatgattcaggtgtccgtggtttgcaatttataatccagtcaaccgtgaaggtagatatatttctcaatgcagtttcaaacccgctgaaacaatcattctcctattctaatatattgatttgacaggatccagccaacttggatgctagagttgaagctttccttacgatgtttgaaggaactctataccaaatgcctgatacagaattcaaggttggacagatgatgtcactgactcactgttaatcattggcttctattacagcttgccgtagctaaattgcatggttttgtacttgtaaacatcatgcggactaaacagtggcttctgttatctgcagagtaacgtgaacgctctcattgacatgaagttggagaaatacaagaatataagagaggaatcagctttcttctggggagagatttcggaaggaactctgaaatttgatcgaaaagaagtggaggtatgctcaatatatttacattatccctctgatgtagtatcagttttcaaaacctggagttctgtaactgcaggttgctgcactgagggatcttaagaaagaggagttgatagagttcttcaacaatcatgtcaaagttaatgcaccacaaaagaagatactcagtattcaagtttacggcggtctccattcctcggagtacgaaaagatagtccacgatgagccacgaccaaattcctatcaaataacagatatattcaacttcaggaggtcgagacctttatatggttcatacaagggaggtgttggtcagatgaagctataagtcaacccttttgatattcttgcaaattccaaaagaataatccttttacgtgtaattttgatcattattaaagaaacttttttgtggacagatgttgatacttctgcatttccattccaccattttctatcgccacgacctttcgttctcctttttgctggcaccaagggtgactgacgactggagatcacctt

SEQ ID NO: 60223 - DNA, 2452 bp, Oryza sativa
caaagctgccgaagcaggcgacgcttatattttgcttgaaaactctgcatgtgtgtcacattcctcgctgcgtttcagttttctactcgctgcctcttttgtatgctgcatctgctatggcacacctagctactctctctgtttcataatataagtaattttagcatttttcacatttatatggatgttagtgaatctacgcatataacatccatatgaatgtgaaaaatgttagaatggcttatattatgaaacggagggagtagttttcttcccattccgtaaaaattccgaacgttcgagtagacgtttacttgacttcgaacttcaaacagtaagatgtcccggtacacgccggacttcaaacagaaagatgtcccggtgcacgccgccgtgcacaaatccggcattccggcccagcccatttgcccactcctgacgtgcccaactaccaagtccaccaacccgcgctgcaggtccacccactgctgccgtgccaccctctctcgcgttgtctccggggacaacttgttactcgccgttccaactgccaagccaacttcgcgtcttcgcggacgcagtccactccaactccaacaccacccaccgccagcggcggcgaatccgcggcggccgcaatggcgggttcgaggccagcgcgcgagacgacgaccgacgcccccgccgagccgtcgtccgacggcgcggtcgcggccgcaccctcggcggcggcggcggcggagggcgacgcggagatcaccaggccccgcaacgacaagcgcgggtaccgccgcgtcgtgctccccaacgccctcgagtgcctcctcgtcagcgaccccgacaccgacaaggtctccgtgctttcgctggctccttcgatcggggatgtgccgggggttttggtgcctgcctcctgggtttttggcttgaatgggtgaatcccggctttgtttgtttgcaggcggcggcgtcgatgaatgtctcggtgggctacttctgcgatcccgagaggctccctggccttgcacatttccttggtgagcttcctgttttgacttgttgcgtaaaacctctgagaaattagtaatcgtggatgctatgattttctttttttgttggcttgaacggatgctagtatgatttccgttgtagttagctgcttccgtttaagtggctctcactgtacatgatgttagtaatgataatctcagtgcgttcgggccttgatgcctatgcaattgatctctatcatctccatgcatttccgttgcagtgtcaggcctgctattagcctaccactacaattttgctggctttttacaccaagctgtttgaggttgtggcttggttctgttacaatatgtacatgtccctttttagttgtttaattgttgaattgataatgtaataaagatgaagaaggtcgaaatttaggtatgcatatttttctcacagcccctgtcacatagaaaatatgcaaggaaaatatactttttcatatatttttttggataagtaaaatatgtgcacaaatatatgcaaaacatctgaaaatgaatttccagcatcatgctgagtatctctggatgagaagattaaaacaagtatagcatggccaggaaaatatacagatgattgattcacatgtgcaactcaatgtatcaattcagtatcaatatctcctgataggtgctgtcagaatatccagctaataagcgacaatggcccataccttcaaaggtatatgagctaatcatttacttgattaatctgcaaagatgtcaaagcccacatgtgaaagggcattaagagaaaaatacagttgggccttaaaatggcttacttatctgaaactcacgggttcattgaaggatcagatgtttcagaaattttattcgtgattgaaactattatactaatattgtaatacatatacatgctatattgcctctgtattgaaatggatggcatatattaataggaggttcatttcgacaccagagtgcttcgaacatattatttggatacttaaggtgattgtaaaaatctaaggagacactgttattcaattagaaaattaatttactcactagtcattgtaactatttttccttggacagataaagtaagcacaactttcttgtgtcactgtgtgtcatgctatcgatgtgcttagtgtatgtttaatttgccttgttttgtatgttgctcttttatatattttctagtgtgtacctttaaagagttttaatgcatcaccaggcactgttcaaacctcattgaattgtttttttatcttggttggattgtactatcgcatgtagagagcttcatggcatgtgttttgcagtaattaacatgtatgtgtctctgtattgtttgattcacttatgcttggttcttcttttatagagcatatgcttttctatgctagcgagaaataccctgtgga

SEQ ID NO: 60224 - DNA, 1237 bp, Oryza sativa
tcaataaagaggagttgattgagttcttcaataatcatgtcaaagttaatgcaccacaaaagaaaattcttagcattcaagtttacggcggtctccattcctccgagtacgaaaagatagttcacgatgagccacagccgcactcgtatcaaataaccgatatattcagcttcaggaggtcgagacctttatacggttcattcaagggaggtgttggtcagatgaagctataggtcttttttttttttatgcttgcaatttcgaaagaataatctttacacgtaatttcgatcgttcttattgtgggcatatgttgatacatctatatttccacagttttctttcgatacactagtcaagcctagacctttcaattctcctggcgatcactttgtgggttctaatcacgatcatctatatcattcttaaaggaactttttgtggatatatgttcatacttctctgcttcaactgttcttatattttttgggcccttgtacaatgaccttttcattttccttttgctggcaccaagggtgactaacagtctaacacacacgggagatcaccttgtggattcatcacgagggttcaaatcctacgatttgaagaccttcaactgggctgctgaatcaggcgaggttaagctgcatgcgtttgatgggcttcatgaacgggttcacttttggttttcggctcatatctcgaacagtttttgtttcggctcttttgaacagaaaagattttatactgcttaaagatgtccaattcagagaaaaaaaattcaaaattccttacctaggcacaacgacgcaattatgagggagctcattgtgtggggctgcaggcctcccaaaagaaggtatgctataccaaaaacgagaaaaactctatccctttccttttgatatccccatctgccacaccgcacacaccacacaggagggtgtggggccattaaaaaggagatcctatcaatatcaactagtaattgttccgatataggataataagctcatgagcttggtcgtactttgccctaaacgaaaaagacttccatatccaaatttagctcaaacgtagctgccttccttttgggcatgaagcaattaatgtcaaaccaaaatacgtaagtattagctcatgaaaaaggaggtgatccagctgcaacttccagtacgactatgagcctgtttggggagcttaaaattataagcagctggttcatagccagctt

SEQ ID NO: 60225 - DNA, 846 bp, Oryza sativa
cacctgcaagcaccgcagcggccggcctacctcgcgttgcgttttctctccgttcttcagacgccaccaatgtcgaattgaaagaccaggtgagtacttggtgccgctcctcggaccacccgctcgccgccgagaatccgatggccacctgcgcggggagcaagctcttgaggtcaaccgtgctgttgagctcgtacctcttgccgccatcttggggggccatctgcagcatgacggccagcatccttgtgctgttgttgtagctcaccgacgcaaccatcggctcggtgacgttggagaggctgcggtcagacagcaacttcaccgcggtcgagttgatggagttgacgtcgatgccgatgtggtcgctgctctggtcccactcattttggaacgtgtcgaactccaccgcgacgatcggggcggcggcggacggattcatgccagtgctgttggtgaagacgccgagcaatccaccgccgtcgagtggagacatctttgacggatagggtgacaggaagaaggcaagcccgtcgctgggtgcgtacttggccttgtctgactagttaaacttgatgacgaacgagaagcgcgtcgtaaaactcgtcacctcgccggtggcctcgtcccagagcggcaccggatggccgtaggaccctcggcccaccgtgtcgtatatgccttcacgtttcgggtcagcgttctgcgtgagctcgatgagaccattgagactcgcggatccatctattgcgatgtcggaacgattgaaagtggtgggcttggagaaatcgtagctgaaagagagtgatctggagaagcaaggtagcttgacggggctgcaggaat

SEQ ID NO: 60226 - DNA, 2236 bp, Oryza sativa
tacacatggtattaatgaacagttaagcactgcgtaggttctatgcattactatgggaaaaatgtactcttgcatgtgtgccaaatttggttgtttgtcacgttgcattccagcgatttgatgaatggctttcttcaagttcatatcattcgtatcagttgcttatggctaactataagccgtaacagcttatcaatgttaaaaataatataagtaaaacttttatataggtgtccttagcattttaaaagttgaagctgataaattttagcgttggcttataagccataggaaagaggtcctcagccacttttcaggttttcaagggaatagaagaatttaatcgtgtaccatattctatattttcacataggctgtgtttagattcaaagtttggatccaaacttcagtcattttccatcacatgaacctgtcatacacatacaacttttcagtcacatcatctccaatttcaaccaaaatttaaactttgcgctgaactaaacacaaccatactgtccagtgactatccttttgattccaacgttctagacacgccactggaaattcggagaaaactgacaaatcgtttactcgacttgactcgaacttcgaacagaaagatgtccccggtgcacgcacgctgacctggcggcattccggcccagcccatctccccccccacccctcacgtgcctaaccaccagtccactgtccaccacccgcgccgcagatccaccgcccccacctctctcgcggtctcgccgtgccaaagccaaagccaaacccaacccaaccgcaaccgcccggaggcctcgcggactcagccagtccacgccatcggcggcgagtcagcggcggcggacgcgatggattcgaggccccccgagaccgacgcccccgccgaggcggtcccaccggcggcggcggcggcggcggcggcggcgggcgatgtggagatcaccaggccacgcaacgacaagcgcgggtaccgccgcgtcgtgctccccaacgacctcgagtgcctcctcgtcagcgaccccgacaccgacaaggttcttcccgcttcgctcgccccgcgctctacctcgatcgggatggggaagggggtttggttatctcctggggggttttggcttggcttgaatcccgcgactacttgttttgcttgcaggcggcggcgtcgatgaacgtctcggtgggctacttctgcgatcccgaggggctcgaggggctcgcgcacttccttggtgagtttttcctgcttcgagctgttgcataagacctgagaatatggtagtcgtggctgctgtggtaatcactacacatgatgttagtgatgataattcaatgctaggcttgcttaccgtaccactacatttggcttgttacataagattgttttaggttgtcaggttgtggactgacacagtcataacaagcatgtttgctttaagttgttgaattgatcatgaacatgaagaatcgagatttggtgtgcatattttttatcacaggcataccatatgaaaatgtgcaagaaaaaaatactttaggtctagagacagcagcttgctacttttgcgattttgggatcacatccatcaaaacatctggaagacatttccagcttcttgccagtatctctggatgagaaattaaaacaagtatagcatggccatgaaaatgcatggatgattgactctcaccatagcaaaaaaatattggacctgttgagcgaactgcccaagctagttcactagtccagtggtacacggttcaacaaactgttctgtgtagtttatctactggtacaaacacaagttatgagatggcaggatagcaacaagaggtggtgttcagttcagagaccaaggttggactccctgccctcgagctattatcacaaatatttagaataaatgaagttggtggaggccttgatgagaacttgggccttccttctggacccatttcaacagtgcagcccaaactcagctggttcaaccagtcctggtttgacatcggttcactactttaccgtgaaacctgatggttgaaatggtttaaagtggtctgaaatgcatgaatggtcctagcgcataactgacccgagcttagaaactggttctgtttttcctctttcccggttaagctgctgatccggttcggttttttcaactatgattctcgcatgtaaaaaaatgtacaaattcaacactactccctccgttcc

SEQ ID NO: 60227 - DNA, 1289 bp, Oryza sativa
tctggtgtgccactgttatccaattagaaaattaatttccttaatacttaatagtcattgtatttacctttggttggacaagtaaagtaagtgcaagtgcacaactttcttatgtgtcattctgtttctgagcctagtctatgtttaatttgaacagttacatattggcttgttttgcatattgcattttagtatagtttgtaggatgtacctttaaaagagtattagcacattaatagccatagttttaacctcattgcgttgttttcttttatcttggttggatttaactatcacatgtgaaaagtttcatggcatgtattgtaatataagcgtgtagctctgtattgtttgattcccttatgcctgtttcttcttttgtagagcatatgcttttctatgctagtgagaaatatcctatagaagacagttactccaagtatattacagaggtatgtattttaccaggccatttttttacttgtcatgttcatctgaaaacgatgttttgtaagtgatcttagtttggtctatagttcgactgaacacaaattgaatccaatttttaatggaatgcttgagagcaactggaaggtccatgactgttgggtctgtggcagctgaaagttaatgtagtgtaatctctcattctatgtataaatattctcaatcacttgggaaagattagagacttgtagcacattatggaggtacttggctgctttctgtatgcttaacagataccacttgtttaattttacatttatagtactttaaaagtagagtgccattagagtatatctatatttgtacgattaatttagtttatgtttgataatggataacttcctttttcccctagtgccagttggtcacactacaatatagttcttgtagggtatgttactattggaatttttaagcagggattgggccctttaaaccattaacagctctagttggaaaagccacctgcctggcctttcacatagttgatggaggcatagttgtttcatataatcgtacaaaaatatcatgatctataagtatttcctctactatgaatcatcaattgtgtaatatgggaattttctttatagcatggtggttcaaccaatgccttcacaacttgtgaacatacaaacttcttttttgatgtgaaccatgattgcctcaatgatgctttggacaggtacctcctgttgctttcttttcttttacctttattcttattttgcagaatatgattcattttgcttatcatctcttgttttaggtttgcacaattc

SEQ ID NO: 60228 - DNA, 993 bp, Oryza sativa
gacgacattctaatttacagcaggacatgggccgaacaccttcagcacatccggacagtgctcaccgtcgtctgcgccacaaccttgtcctcaagtgctcgaagtgccacttcggtgaacaccagatcagctacttgggtcacgtcgtctctaccgacggagtggccatggatgcgcagaaggtttgcgcggtggccgactggccgcatccgcgttcgcgccgtacgcgggtttctcggcctcgtcgggtactaccgcaagttcatccgtaactacggcacgatcgcggctcttctgacggccctcctcaagcgcgacgcattccagtggacgccggatgcagcccgcgccttcaccgagctcaagcaggccctatcgacgcgcccgtactgcaactgccggacttcgccctgtcgttcgtcatcaaatgcgacgcgtcggggtccggcatcggcgccgttctgcaccagggggcgggtccgctcgctttcttcagccgggcactcgcgccacgccacgccggactcgccgcctacgagcgggaactgatcggcctcgtccaagcgatccgccattggtgcgcgtacctgtgggggagggcgttcctcgtccgcaccgaccactacagcttgaaatttctcctggatcagcgcctctcgacaattccacaacatcgatgggtaagcaagttgattggctttgatttcactgtggaatatcgcccagggcgcacgaacgttgtggccgacgccctgtcgcgtcgcatagaagacgccgaactcgccgccctggcgctctccggcccaacattctcgacattcgacgaccttcggaatgaggtggctaccgacggcgacctcatcaagatcaccgctgacatcaccagcggcaagctgagcgcgccttgggcactccgcgatggcctcatcctccgggatgaccgtgtctacatctcggcatcttccccgacaccgccggcattgctcgctcatg

SEQ ID NO: 60229 - DNA, 1997 bp, Oryza sativa
  unsure (1)..(1997): unsure at all n locations
gctcccttcctctgttcttcccacttgccgtcacgggcagggtaaagtggttgccgaagcctcgccctccagtgacccattcatatccaatccgttcccttgccggtgctcgtaacaacttggtatcagagaccatggcaccagatcaatcctcctcctccacgcagccatcaccagatcaatcctcctccacgcagccatccactgatgccgacgcactggcaaagcttcaggaatccatggcgacggtgttgagcggcatttcgcttttggcctccaaaagtgacctcgccgatctcagtcgttctgtcgctgtcgcgacctcccgcatcaccgccttggagtagtcctcctccacttcctctggtccacgtctgaccggcggtggcctccttaaatcaccaccaccaccacccccccaccaccttccccaccccccccaccaccacctccgccnccacatgctaaacacngcgcacannacgacgccaactccagcaacgcaantccatcgttttacaagctcgaatttccaaagttcgatggctctgacgatcatctcaattggcttaatcactgtgaacagttctttcatgcacagcgttcgccggatggggatcgcgtttggttggccacatccatctcactggtgccgctcaggagtggtatttccactacgagcaacacaaagggccgcctgattgggacacgttcaaggagctatgctacacccaatatggtccaccaatccgcaacaacccgctgggtgaactcaagcgcctctcacagtcgaccacggtggccacctaccagcagcgcttcctcgccttgtccagccgtgtgacggatctcctcaccgaacggcagcaagtccaactgttcacggcgggcctccgtgatgacatctgcatcgacgtggagctccatcagcctgaagatcttcgggaagccatggggttggcacgtgcatatgaacacaaagccaacttcagcccatcgcgcactatcagcaagcagttcgcgcgcacggctgcgtcatctccggccgctagcgcctccccggctccgacggcagtgccgccgtgcccgatgtgaactctcgccagtttcgtcatctgacaccggcggaactcgcagagcaccgcaaacaagggctctgttacaactgtgacaagaaatttgtccgcggccaccggtgcgcacggctctcctacatcgagtacgacgacacggcggatgatcccgatgacgactcggccgacaaagatgaggacaccgagccacacatatcgctgaacgcgatctcgggtgttgatggcgccaacacaatgcgcttggcaacctacctcgcggatgaagaggtggtggccctcgtcgactccggctccacccacaacttcatccacgctgaccttgcgttccacctcggcattccgctgtcgccggtccgcgatggtgtccgtgtggtggtggcaaacggagatcgcctcaccagccccggcattgcgcatggcctgcacctgcgtgttgccgacgaggtattcgacgtcgactgctacgcgctccaccttggatgcgtcgacatcatcctgggcacacagtggctacgcactctcagaccgatactgtgggacttcgtcaacatgcggatggcaatttgtcgcggctgccgggaggtcacgctatacggcgtcctcgacgaacgccccgcgtccacatgcgctgcgatccacactgacgatctccttccgtccctattggcggaattcgacgacctcttcgcgcttccaaccggtttgccgccggcccggaccgtcgaccaccgcattcacctcaagactggtgtgtcccctgtcgcggttcggccgtaccgctatccccagctacagaaggacgagctggagaagcaatgtgctgagatgctggcccagggcatcatccgtcccagcacatccccgttctcgtcgcagtcctactcgtccgcaagcacgacggtt

SEQ ID NO: 60230 - DNA, 2129 bp, Oryza sativa
ttgagctcagccttccaccccagagcgacggccagtcggaggcggccaaccgcgtcatcggcatgtatctacggtgcttgaccggtgatcgtccccggcattggctacgttggctgccctgggcggaatattcttcaacatacatccagagttccctgcattcgacgctgttccaggttgtctatggcaggccgcctctagcgctgcgggaatataatcgaggcttggcacgcgtccgcatagtcgaccaagccctcatcgagcgtgatgaatttttgggggaaatcagggagcgtctactccaagcacaagactactccaagctgtactacgacgacaagcatcgggacctcgcgttccaggttggcgactgggcgtgcgtgcgccttcttcaccgtcaggctgcgtccctgcccgggttccgtcgtggcaagctggcgccaaaatattacgggccgtactaggtcagcgaccgcataggtgatgtggcttatcgtctcaagctaccggccggcgcacggatccacgacgtcttccacattggcctgctcaaggaattcaaggctacaccgccggaccaaccgcctgctctgcctgcattgtccaatggcggtgttttgccaatgctggcgaaagctgttcgtgctcatttggcacgcggtgtgcgtcaggttctcatccagtgggaaggcaagccggctgcagacgcgacatgggaagacgaggcagaattcaggcacatgtatcctgcgttctagcttgaggacgagctgtttgcgaaggaggggagagatgtcatggtcggcatcacgtatgagcgcagacgtcgcgcggcgaagaaggacgagcagcgtgtcggatgagaaacagtaccgcgcgaattgctagcgattggtttcagtttgttttgctattttgttatccctttgttttagcaagattagttcaatgtaaggctatttagagccacgaatttatggttaatctaagcaagattcaatctacacttctcatcccattttctctgctcccttcctctgttcttcccactcgccgtcacgggcagggtaaagaggctgccgaagcctcgccctccagtgacccattcatatccaatccgttcccttgccagtgctcgtaacatttcatgtttgtgttcttggcagttcatgactttcaccaatttaattcatatatagtaccagttggttatttaacttgctttcgttgtattacgcaaccttttttcaactggtgaataagaccgcgaatcatagtaaagtgtttagcaagctagttagcgtgtggattggatgtgtcatgcgtgcatctaaatttacttaacacgagcgtgagattgaaaatcatgcaaataaaaccatttgcaattgcacatctacatctcggttgaaactcaaataatagatcggagggatcaattaaataaatagccaggaagagtatgccatagattctgaagtacaacttgcagtattattgcgcagaatctcaactagaatttgttactgcgcatgcagtacaaatttggtgttagattaatgggttaggcccaattaaatcttaataaattccaatggcccacatttaatgcaataggtaataataccaccttgaaaatctgaagtagtagagaggctacgttgaccggttgagatggagctagtagagagtctctgttcaccagttgagatggtgggcggacagccacacgcatgcgcgcgcgctcagagccggctaggcctaggtaggctgcttctctctctcataaattttgcaatggaggagaattgaatccaaggcaattgatacgatatcaatatgggcgcgattactcctgtaactcgtaaattctgcaacggatgagaattgagtccatcgcaattgatactatttcaatcaattgatacgatttcaatacatgtgtgattactcctataactcgtaaattttgcaatggactctcgtaaattttgcaacggacgagaattgaatccagcgcaattgatcgatttcaatacgggtgtgattactcctgtaactcgtaaattttgcaatggacgagaattgaatccagcaccattgatatgatttcaatacgggcgtgatta

SEQ ID NO: 60231 - DNA, 1523 bp, Oryza sativa
ccgcctcatggcttgtggagcttgaatccaaatacacgaggaacgtagcgctgcgagggtttctgaggcttgaggtgctcgtacgtcatcagaaacaggtgcgggaatgttgtcccaaagtatgcgccgtcgatgtctgaacatggtcaagaaaacagcagaatataacaacaaaatggcagttctatgtaactatgatatcaatgtaacacagatgagagtgtgtggacttcatctaataagcgataatatatattggcactgagaacactaagaaagcaaaagaccatgcgttaaagattactgaattgtttatgtccttagtattgatattagtcgtcctaacaactgtatatgtctgcctgttaaaacttgtcaaagcatttgccaaccactcctatcagcgaattagggcaaaactattagaatatagtaatgctggaaatccaaaggaattctattttcttccagagaaaaacaaaaaaggaacgctcatatagacagtatgataagagagtggttaggatactgccttggtacttggaccgtggatagtagatgtcttcacacttggggcagtatatcttcacagtactagatcggtgtatatctgattgtccaactggtaaacagggttgaccacagcaataaactcgtgggcatcttccaaaatcatagtttttgtacttctccagctgtgacaaaaaatattaacaactgtcaatttatcataaatcggaagtacaacaatataaataccaaagaaaggtaccattgcagccaatcctttactggtcaaaatgtatcgtgcatgaatcagcccatataacatctctgcagctgactccactagctcgttttgttcttcggtgaacatgtcacctacatattgacacaatcaagaaacattagcaaaaagaatgagaacagtagaaaagagaacatggattaaagggagctactgcattatgatgccataaagaaggctgtgttacattactgatgggttatggcatttaaaatagcagacaaaacaacacacatatcctctccatgcttgctaattactaccacaccatttactgccacagaaacctaaagcaatctattagcaacatcactcttaataacattagggcacctaaacaggtgaccaagaacaaaacaaaatcacaaggtttaataatagtgagaattaattttccatgtaatagaacagaaagtttctaagcatgtactatgggtactatcaaggagcaaacgacaagtaacgcatgatggtgcagccatatgcagagttgcaaaagagacggtcatccagaatacaaaagcacaataactaacagtaaaagaaaaggccttttgacctgcactggttatttgttcataatcatagaagttgataacagagatcaattcgaggagaaaaaaaggaacatctatgttttgtgttctttctaggagaggtaccttaaattagtcatggtactccacaatatctaatatctagcttaagagttgaa

SEQ ID NO: 60232 - DNA, 1438 bp, Oryza sativa
tatttgttctgtttgctaatacaggtacccggtgcaatcaggggacaccatttggatggcaccgtttgtgcctcaatggttagtatctgtcaacatagtgtttatcattcatggaattggcttttgtaggcagctcatcaccgttgccttgctgttccaggtacgctgcccttggaaaaaccaagacgaggtacttgctgtataaagatgtcaatagggatccactgatatgaggaatgcaacatttcctgaccgatggtaatagatcaaattggagagctattacgctggtcttgaagagtccctgtggaagatgatctcagaaaaaaataaatcttctttctcgctgatgaacccttcaaaatgatgaatcgacgcaagaatctcagatctgtacatggaatggtcaagctacccacttgttcttattggtcaatatgaattcagaaaaaaagttgctgtactattttctggacagaactgggctatgctgtgactcttcggaaatctgtattggctaaccccttgaaatgtcgaaataatgcgtcgctgtaatgaaaccaggtacctgattccaagattagtgcctttttttttccttttaattgcagagcatcaaatatgtggcgacatgtcgaacatcaatgtttgggtatctgaagatgccttttaaaaatggaaatgaactgctttaacaatatttgcaagaagaaacatgattactctttggctttatgaactccaaacttatgagctatgattggtttatgcctttatgttaagcttgatctccgaactatgaaagggcattattcgtgctgtcaagggaaaaaactaagaaggaaatgcaagttgttgaagaataattacattatgcttacttttactctcttgaaatgccgtgccaatctttgccaaaaggagatgatagaaaacataatattcttaatcataaggggatatacatgcatgatgtgttgataagtgtgtccctgccacatactccctccatccaacaaatccaacctaataagaatgagacataaataatttagtacaacgaatatgaatctgaacatgagtatataggttccagattctccctactaggttatgttccatatttgcctggttggatttttttttttaagggagagagttctccactccattaaaaaaatcaacttaagacggggtgaaatataacctagtacagtgaatctgaataagtcctaggttatattttatccttgcctagattggatttttttgaatggagagagtggtacaggagaggcaactatatttttttattttgtaaactttttaaataatactcctccgtctcaaaataagtgcactcctctagttcaattttaaagagtaaattacacaagcggtccttaaacttataacgaagtttcacttaggtccataa

SEQ ID NO: 60233 - DNA, 1114 bp, Oryza sativa
ggcagctgctcaagttcaacaagctcacctcctctttcgcggagctcattgtcgggccctgccgccccgctaccgccatcgagcttgcgcccgccctgctcacgctgagctcaccgacgcctcccctgcacgcacggcgcgttcggcgacccctccccccggggcgcggctggcgacacttccccttgcgcgcgcctcgaccgcttccgcatgaatgacgcgccgccgcccaacgaagtgcgccgccccccctcttcgcccccctccagtgcggcttgcaaggccgcgccacccccgctcatcaccatcgttctcgtcttgggcagcggcggaagaggaagtagagggagaaatcatatgtcgccgttggcggcggccgcctctccctctcctcccccctgggcctccgtctgcggctcctctccttctgccagccggcgcccgagcacgcgcgccgctcctctcctcaccggccaccacccgcgcacgcgtgctgcttctctcctcccgccggccggtgcccaagaacgcacgctgaccgtcgccggaaacctcgtccaccacgcaaggtgaggaaggagagaaaagatggggagaaaaaaggggaaaagaaatttagccatatcatcgtccgcgtggcatgccacataggtaagaccacggttaaaccaggctttggactgggatgatacattaaaccaagtttaggtatctcaatgcgtattttgcaagttcgtggatctaagtgaaacttcgttacaagtttaagaaccgctagtgtaatttacttaattttaaacataattatgaaaaagtatattcggatcatcatgtcatattcatcggaatgacaagaaaataccatcacgttggttaccaagggtgtgataaggatttaatcacgtagcatggctaaaggtttatttttgcaaacatttaataatgttaaaaggcacatttgatgggtagtagtgtttaaactttaggtggattcacttgcagaagtacgaaaaaggaaacatgatctacttcctccgttttttaatagataacgccgttaattttttctcacatgtttgaccattcgtcttattcaaaaaatttagggctgcag

SEQ ID NO: 60234 - DNA, 7380 bp, Oryza sativa
cctgcagcccgtctgtgcactgtgcatgaagagtacaaagatagagatgtgctataatttgaaggcttgtacaattggcttatacttgaggcatcaaattttatttgaaagaaaaatatttcgatcaagcaatagcataagtgggaaacaagattagaaagttaccttttgaaggcgtagaacaacaaatgggacaaatgtcaatgagaaatacagagggaatgttttcttgaacgttgatgaagagacactgacattatgagccaagcacgatgctctgtcaggatgtatcacagaacatggaataatgggtggactttttgttaaatttatcaaatttgaattcttcttgttagctaaataggctgagagaccaatgagatccacatgaccacctctgcagcaatctcttacagccttgtaaacaggttccgcaactggtccagtcttttggatgaagtcttggtacgatttaggtaagctttcaggcctcataacgaaagaatacataacctggaaggatatttcatatgattatatagatcttatctccataacaggataataatcccaaagcaaatcggtcaacttcatcttgttacctgggcagacgcaagtgaaaaaagtaatgcatctccatgcctccaatggcttccccaaaagtgaaatctgttcttagactttgcagaattatatgcacactgtaaaaaccaagcatcaatacatgaggaaaagggccatacatgcatcttcaccatataaaatgcaacagtttagcagttggtgacctgggcaagccttgccagaagatatagagaaagggtgcgcctcctacttgaatcatctagcgctactatcgccaagcctgccaccgaacctgctaatattctgctccatcacgccttcagttgagtccatgaacattattcgaggtaatcttataataaaaaattaacatgctttggacctatctactttttagggaccatctcagattcaagaactggttagaggtacacatgcgttgcagatgtgttgtagtgaatcagacaagataaatagacacaaaacagcataagcatagagttacttacgcattaaatggtgtttcctttttccgaaatctccgaaggaaacatcgaagtgcatgatatgatccagtgaatcctccaaaaagtaatcctacccggcaagcttcctccctcactattagatctttctccgaaaccagttgctgcaaattagaaaagaaagttatatcaatgacatcttatttgaactttgtagtatactagtagtagaacagtaaatatttgtcagaaagggaagtttgggaactggaccaattattttattttttaaccttttcttagtaatattttaaaaataaaccatccagtattttgttttaaatgaacctttcggccatgtcacggctgatggcaaggcaaaacagtgaaaacacatgctacaccatatgctattatctcggtgtggcagaggttatttttcaaacattattaacaaaaggttcaaaactttttttaagaaaaaaaaatcatactggatagcctcacaacagggatcgaaccatttaatgcatagcaagaaacatccctccaacaggttatttgatgtgcttcaaacactaccagctggtcctacacaagtactactagtaccagctcattaccagttcaccactaactattcaagtaaatgaacatagagcaatagatgtaacatcacaatcaagaccagcataatatgtgaccctgtcctttgctaacacatttgcacgccctaatgtgcgtgtgtccaagctccaacagttaagcaccaaaacccccaattccactccaattagccaaccgaaacaagatgaagtaaattcgcacagccgaatcccagttcccggccaaattctccgaataattccgtccaaactaaactaatctaatatggggcgcagttgagcactaaccgaaagaaatttgcaaattcaggtaggaggagaggagcaaggaggaccttgaggtcgaggagggaggagtaggatctgcggcgggcgagcttgaaggcgcggaggaggatgccgatgccgacccggacgccgtaggagagcaggaagctctggcacaggttccccgccgcgtgcgccgcgcacgactccccctcgtgcccgcaaccccacccaccaccaccaccaccgccgccctcctcatctccatccacccccttcccgtccccatccccatcccctcctcccccgtgctggtggcggtggagctcctggatggcctcccgcagccgctcctccgcctcccgcagcctccgcgccgccgcctccgacgccggcgcggcctgctgcggggtcggcgggtgaacggcgtcagggggaggagggggagagcgcgggccgagggtgggctcggcgccggcggagaggtcgaacgacggcgtcgagaggaacggcatggccggcgccgcggcggggtgggccccgcctgggattcctccgcttcggtggctcgcgtcgtcgtcgtgcttcctcccgccgctgctggctcgtgtcgcgacttcccgcggggttggattattaagcgatgataataataagattggaggtggttacgggtgggcactggggcgggtgacgcgtcgtgcgtgcgacggacggctttgcacctgcacatttgcacggaacggaatgtactactaggcgcctactactagtgcaagagatgggatcatgggaaaggtatggataacctcggcctatttacatcccacccaagattttacaccctagtcacatcgaatgtttaacacttgcataaaatattaaatttatgctaaaaataactaattacacagattgcgactattttgtaagacggatcttttaattctaattgcgccatgatttgacaatgtggtgctacaataaacatgtgctaataacggattaattaggtttaataaattcgtctcgtagtttactgacggatactgtaactagtttttttattagtacccgaacaccccataaaacacatcctatataatacttgatgtgatatgtcaaaactttaccccctaaatctaaacacccccttataggaaccctcttctttcttctaaccatactactccctcaggtttcatcatttttaacgttttattacataataccttctttcttctaatcacggttctacacgtcattttttgtctagacttggctcagcatgatctaattacttgaactagacgatttgaccctatagacaaaaaaaatggtctagggcacagtttaggccctaaacgggacgaaaacctgcggtctcacatctagacgcggtctagacagtctagaccatggtctaggcgaacactgatttattttgacaagtttgcaactcgattcaatggttagtttaagaaatatcgagtttttatagaagcgttgtcaagttgtttttgtcggactgtcataccaataattgtacttcaatcagactagctctaagtcccatacaggtccggtcagactgtcaaaagtgtgttccattggctttcaaggctgggatgtgttttgatctattaaagttcaatttttttactttccctgacgtaattcaccccctttggtaagtttggttacttgtgttcaatcttacagtaatttagatttggggataattagacttgacgaactacttggtaaagtagttaaaatttaaaaatacttcaaacacatcatcaagttgttatgcgttcttttctacaactccaaactacaatttaggcgttttccgttagcatgcttcccgaactgctaaatggtgtgttttgcgcaaaaaaaaattctatatggaagattctgaaaaggtcaaataaatctatttttcaactttataataattaatactcgattaatcatacgctagtgagtcacctcgttttgtgtgtcgctaatatgctactccaatatgaatactacggttcatacagaacccttgccttttctttagcttagatttctatacgcatttaaaagaaagcaatggtggtgcccaccaactctattatattttctttaccaactacctttgtgtacttcaatattacaaaagtctttcacatattgttaatatctttttttcatctctatttaagtttcatgcaaagacatatacaaggatgaaattgtttcaaaagccatacaattaattgttccaaacaatgttagcacatgtataatacatttttgtccactgcaaaacacagttgttttgctagtttaacaaaattttactctatctatattttaccggttttcaaatgatcttacggaaatcaacaaaatcattcaggagtgattttcgatcgggtttcgttaatcccgcgttcctagcttcctactctagcctctagaaaagagcataatactctcttcattcaagtttgatggtcatattctggcttcgcaccaagaccaaacacgcttataatattcctactaatctagtactctaggccaacacacctgtggcaacgctttggcaccaacacaaccaaattgttgttgccacatccttgatcgtatgcttcttacccatagcgcttgtgatcacacgcgaaatttaactgttttactatgccttgcagctatttttgcctactaaagatgaaaattagtaattagccattgcccatgcaacctaaaccaaaacaaaattgaaagagcagatcaaatagccctatttaaatagcacttggttgaagaaaggacttaagttttcaattcttttcctccctacctggctgcctctaccaccgaacaacgaaagtaacagatgatctactctgtaaattatcacggtgagcagacaggagcgatggtaaagaagagtttgtcgtggatgcgttgctgcacatggtggattagaaaatgagtgatagaagacttatcggtatgatctatagtcaattgcaaatatgattactttctcgtgcatacatatgcaacgggcttttacgaagtactccctccgtcccataaaaaacttaatcatgtgtttaaatttgaatatatattatgtccagatttaaatctaggatttggtttagtactcatgaaacgtccacgtggtggttaattaatttcgtgtgcgaactaaaacgactaatccgacaagactcaacgggctatcaaatgaaaatccagattcttttatacaagtgtgaatgatcaatcgtgaatggagagaacagaggtggtgggggagccgggcaggtgggcaatggcatccgagtcaccaagtggggcccacctaccaaccaccgtccacgagtgtgccgccgccgccgcctcacatccactccactctctctctctcctctcccccgcaaatcccccccaaaaaaaaaaaaaacccgccaccgcgagcacgccgcgcgcctgcttcctccacctgcgccgggcgagaagatgatgctcccccggctcctcctcctcgtcgttgcctccgcgctgccgctcgcttccgtcgctgcgggcgccgtcggcgtcggcgaggggttctgctcggcggagccgtcggcggcgtcgggcggctgctccggcgtgcggccgccgctctactggaaggccaccaacccgactctggcgcccgcgcacctccagggtgagtgagcgtgaggcggagcgatacgtcgcgagttggatggaatcttaaagattattgcataaataggtgctctggattgcgtcactgcagtgtttttttagaactgcaatatcgtgatattggttctggatttggagttactgttgtggagtatggatgttgatgctggttgagacgctcgggatagtgtttagttcgttcagtttcacgatgataccatactctctagaaggaatttctctgtgaatggtgtggcttgctgtcgagaattaggctgtgaactaggtaggtagtagtaggtagtcatgtgggactgaaatagaatggcatatgatatgcacgctcgtcagttactccttttcgtcgaattggattggccgagaagattatcttgtattcccttgctaagcacactttaaagataatttatgttttatgcttctgttttacttattacacggtgaatgaggatatcttctgagctattttatcgtttactcatgtaggctatctgtgtttcagaagaggatgcgttccttttcctgttcctgctaattttgttacttttctgtatctccagatttacctggcttcacacgtagtgtttacaaaagggatcatgctttgattacaccagagagccatgtattcagccctttgcctgactggtattggccaccttctgttgtactttctctttgctttccacaactatgtaatatcatttatttactctttttttttcaggatcaacacattaggagcatatttaattagtccagctatcggggcacatttcacaatgtacctggcaaaaatgcatggtatgcaatttctcccacctacaaagcataggtagaaatgtaaatgatagcagaatattcaacaagttctctttgaggtccgagtttggtttctattctaggaattcagaatattttgtttgccacagaaccattggattagcaagaacatttttttttgtgtgtgtggattcatttcggccattgggccaagaatgcctagctcccaattaaaagcttgtattcttattattgtacatcggtacatgttgtgttcaatcttatcaaactaatctgttgacaagatagagagttcttattttatatgttttatttgcagatggatcaaaatcagccctaccaccaaaaggtgttgaaaggttcagtgcttctcacttagttagaatagcaaccattcacacttgtaatcatcactgtttcaaagaacagaatgattgggtcactcctagtcctagccaataaatgttgactgtgatgcacatccaattaagtagctcatttgtcagcatcctatacttgactcgacttggtttttcaccatccagttaatgggtttccactggtccatggtaaacaattttcaggcttatctttgtactccaaggaagcattctattgtctgaggagagtgggaatacccatactctgctggtaagattcgatcaaacttagtatctgctattttgtgaatatctagttattttttcactatactctatgttcgtcgtattatgtaagtgttaatccactttaaacatttctaattccatgacataacttgatgggatcatacgacatagttttcaaagtttagaggcagcctaagccaactgcggtatgacaatatttttgggctgcag

SEQ ID NO: 60235 - DNA, 1679 bp, Oryza sativa
gcataacatgtttgaacataatgcaaattaaacttatggatgatcagttgttaaatttgtagggtgatgttattaaaattttgtcaaaagacaataatataaatattatacatgataaaagggtactaaatatgggatactgatgtttgtaaattcaacagaatttccattgtttgtcataactgaatgaatggaactcccacttgtttcttgcatactcctgcagtaaatggcttaattcttttcatgatcctgatacttgattgttttaacttgatcatcttttaccagctttagagaagtaaaggttgcctagcattaatatggtttactgattgtgtaattgctgagtgcaggtggactcttatgcctatcttcctgcaaacatgaaacactctgtgatctcagatgaagtaactacccttgtaatctttgagaggaggtacaatggttaaatggcacactttcatgtaaattttgtttgttttttaccactattttttttagggaatgcgcataatccatgcgcatcatttgttttaagaatttttaccactattattgacctagctgactagctgagtgatcttattgaatagctgaagttcttcccattttggtaggcttttagtcgctaagactggattaacttttgcaatataaatggattggcttaaggccaattaagtggttgatgaacagtatttttcctttgtcttctttttgttgtgaatatgatctgcacatctcagacaattattgttttccgtcaatgatttagttttctcagtttacatttctcattatttaatgaatatatttgtttaggtacacaaccattgagggttaccatcctgatctcattgttggatcaactgataagcaaccccttcttgaaaccccaggagaggtacattctggacctgtgtggtggataccgattatttgcaatctctaggcatctagataaattggtttgcctgccatttgagtggtacgcctttaatttatactatgcattttcaagagggttggaataaactggtttcagttttcaatttatatcatttggccttgtgttgccaatattgtagagtttttgctgtgacattcatatagataattgctgttttttcccctgctacagacaatattgtagtactgttttttgctgatatatattctgcaagcacttacatgaaattcttgcctcttttttccaataggtatttgagttgaggaagctgctacccacttctctgccttatgactttaatatccatgtaagtctgattaatttgggtttattgtttaacttggtgtgtataacatcattccactgaatgtgagtgcccataaatttcggcaaaccaagcattagattcaagctatttgttctcctagttattcattgaaataagtgtaataagctattgtgttgtataagaactcaaactctgaaacactggcaacctgagcttgcaaaagtcattacttatcagagtctttaaacttattcgtaggttatttctagactacaaggagctaaactttttctgatatccttatttctcacttgcagataatggattttcagcctggggaatatcttaatgtgaaggtttgtgaatattttaatatttcttaggagatttcagacctaatgtgctagtaccatg

SEQ ID NO: 60236 - DNA, 2421 bp, Oryza sativa
  unsure (1)..(2421): unsure at all n locations
ggttactaagtagagagaaatttatatggctacccttatgatagtaacatttatgagggtaattatagacaatatgaccttgggcccttatatgggccactaaatgggcctcatagggccattcggcctgcttggttattgaggctacagcttcgggggcgaaagggctcggccctgtggtgaaggcctcaggcttcgcctagcgcttcaccctgaagtccttgtctttgcgatcctcggatctctaccgcatgtggtacgccttggtggttgtggatggcgtttcggtgacatggtcgaaggtcctcatggcatgcctgcaacaagcccttcacgggtaaggatgagtagtgagcttcggtcgagaccgtgtaaagccccgggtatggcatgaggcgccccctttcggccaatattcccgtcgaaacctatctacttttgagaaaaaaaaagtcataagtgaaaaaatctatttccttttgtcgacgtttgatgtcgcgattccggtatttgcatagtatggggatcgttggtactaggatatacacgagactggggtaaaagagatggagacagcgatttttatacaggttcgggcccctgcattgtcaggtaataaccctatatcctgttggtcgaagccggttgttgctcttattcatcataatcacaccagtacaatatttggggtaacctatctaactgttgtcgacatggcggtctgaaggtctgactcgtagtcgacaacagggtagctttcctcctcgagtccgcatccggcgagatcagagacaacgctatatctctcctgacggtatccgtaggcaccgtaggggactagctatgcctatctctgaagtcgatatctggcgtcttgtcttggcgtatgttggcttgtatgttgtggcttctgttgttccgtgtcccctctcctcctagggagccttatatttatacccataggtgtccccttgtccaagtagaactagggaaaccaatatagatacaatccgagtagtccttgtcgtttccatgtagaactctattcatccttccttatgcagaactcttcctatatccgaaagttgtttccgtataagatatggtatgtggtgagtcctgccgagatttagtcaactactattaggtatgtggtatccatacccctgacccctttccatttatgggttctttggtggtccatttttgccttggaagctaccggttcgcattcgcccttttactgtgtcatttgcctttttattgtgcggcccacgggctatcttcgcgcagatagccgttggttcaagggatgcatgccacacatcgcacatccatcggtttggcactcaacggtcgcgagggcggaggagtataaatccaacctccccctttcccccggaggcttacctcagttttttaccgcagcacttttctcctcaattcctgcttcttgcgctcacgcgttccaggaagacagctattcacccagttcccctttcacctttgtagcttcgccacttctcaagccgaaatggctcctaggaagactgcttcggccgcgacaaccgggcccgatctcggagcgatgccggatgacttgtccagcttcttgggcaagttgtttgtcaaggagggtgatctgggcgaacttgtcgcctctggggcagtcgtcgaagggcaagctttccttagcgcgagaaaaatataattatgaatagtgtacattgttattagaagatggttgttcactaaaatgctactgagacaattttcactngtgcggcgtgatcgnacagntaagcaccgttgttatgagaagacagttccactaaaatgagacgtggcatttttcactgtgctcgcgatcgacagtttagcaccgtcacgtacccctatttgaggggtggctcggctctttctcctccatatagctaattcagccttagacacatggtctgaccgcagtgtattgtcctgtctgaccggccacacaatggcggtcagactggcctttgcggtaaatgtcctcccaacggtgacacaccttctcagacaaacagagatggcttgttttccttcaactatctgccatgcatgtatgtctctaggatcatagaaatcaaaaggatgctcaccggagaggaaggaatcggccacggcggcatttagccggagttggagaagacgaaggcaatctccatctccggtggacgaatattgggaaatcttgaggtattttggagaggacctcgaggggaagctggtggcgcgacgactcatcttggcgtggtccagatccacggcgctcggtgcatgcactggagctcccgtgggcatggcggcgttcccgtcgttgcagtggatgaaatgaggtggtgtcaaaagggaacttgttcggcatgaagggtagaatatgga

SEQ ID NO: 60237 - DNA, 1032 bp, Oryza sativa
  unsure (1)..(1032): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctgtgcttttggagtggctgaaggacgtgacggtggacgtgcaacaaggcgaccgtgctatcagggtgcctcttgtatcgcatctggcgcagcaaagggaccatcagacggggagcacgcctcttcacctggctgcatcgctggaagggtggccatacgtgggcattctttctaaatggttcccagatgtttggccgcggccgaaatcagcagtcgcgctgctgctagaagccaacacatgtgcagcgtatcaaccggacgctgaaggattataccccatacatgtggctgccttggctgacagcctcgacgtagtcaggaccatgctgcagaaatgcccggactgcgccactttgcgagatgccaaagggaggacgttcctccattccgcggttgaggcggagggatacagagtagttaaatatgtctgccgccgaatgccaaaagaattttcgtccgttctgaacatgcaggataacaatggggacaccgccctacaccgagctgtccatctagggaatctgccggtttttaactgcctaactcggaatccgcatgtacatctgaacataccgaacaagtatgagttgacgcctcttgatctttcatggattacagtcccttcatcgttttattatgattcggtaagttactagtgctattgttcttatttcaagaggcagttccctccacccaaactttataagttatccctcc

SEQ ID NO: 60238 - DNA, 5792 bp, Oryza sativa
tataattacactatatttgtactataattacatatgtaacttgcatgtaactcacgtgtaattatagtataagtaagatataagttcaagctagatcataaaaatatagtagcccaatggggcagtcacgccttcatcccatgaggtcaaagatcgacccctaaatatggttttgtttttcttcctaaaagcacatatcttgatgcgtattaaactgttatagcatgaatctaggacacattcaacggtttagaaagtgaaagatttagccataaaaaatctgtcaacaaatatttagcaattccatttaatttagtatatagagattacaaatacggtttaaacttttggaaaaaccaaaaggtgaaatagattttagacttttgaatggagggagtaatatttttatacaagatcattgcttaaatgatactagtatattaactgttcattctcgcagaatccaaggggtctcatacaattatcattgcaatttgtgggagctccatgcggtgcaagtcgaccggacctcttatcccaaaaacacatcccaaagatagacaacggcaaggtctcggcgcatctaacaaatgcatcgcaaatgctgggcattgtgtccgtacttgtcgcgaccgtgacattcgcgtcagcattcacgttgcccggaggttaccaaaccgggtcggataacgcggcaggcacaccactgcttgctgggagctatgcctttgacgccttcattttatctgacacgctggcattcatttgctcgtgtatggcgaccttcagcctgatcttcgctggggtccctgcaatggacatctctatacgctgcaggtacttcgaaatttctgccctcttgctgcggagttcgggaagaagctttgtggtcgccttcgcgttggggctatacctggtgctggctccagttgctcacacgatcgcgactgcgggctgtgtgattatctttgtgtcttcgctctacgggaattcggaagcctggcagatccttcgtgtcgcaaacatggcccgtgctagattgggaactcgaatgcatgtagcatggactttaggactcacgttctataacgtctttgttaatttgtttttgaacttctggtccttcattataatctttggcctcccagcagtaattcggaaggttcatgcaagggagtagttttcgctacctttccatttccttcgttagcattcggttaaaactaaatctccatgtgatcaattagcaagggacgcatgggctatatacatgtatgtaatcatcccatgtacaagattcatgccccttcatgggctatatatatgtatgtaatcatcccacactactgaaaaaattatctttgttggttcactcaaaaatcacattagtcctggtttgagtaaaaaccaggattaaaaatatctttagtcccggtttgaaaacacacaggtattttttgatcattactccaggttagtaacaccaaccggaactaaatattacttttactcctagttcaaaaacatatcagagccctgttatttttagtcccggttggtgtccatctttagtcccgattgtttataccaaccgggtctaaagttaaaaaaagttgcgaaaatccttgcaccgagccacgcgcgctgcctcgtccttatcccctcctcttctcctcctcccctctcattttctcgatctcctccacctcctccccctccccctctcctcccccttcccctctcctcccctctcccctccctcctctgacaatgacaacggcgacagcgggtggcggcccggcggcgcacgatgcggtaggcgggcggcagaggtcgggtcgccaaagcggcagcagcacacggccgacggcctaccctccgccagatccggtgggaggggaggccgggtggcggcggacgggcgaaggcggcctggcggagacggccgggcggcggaggccgagaggcggcacacggccggacggcgtgttttgtgaaaattttatttttggaatgatttgtaatttttgttgtagattattttagattttgggatgattttgtgaatgactcgtggatgtggatgattttgtggatgggctaagaactgtggatgatttgttgtgcatgatttggtgatgatttgtgtggtttggggatgatttgtggggatgagggtgacaataaatgcaagaagcaaaaaaaaataaaggaaagaaaaaagcctaaccaaccggactaaaatgggactaaaaatccattgagtatctttagtcccggattggtcgtcccggtttacaacctgggactaaaaggggttataaaccgagactaaagagcccttccccagtaatgccatgtacaagtgaaaagtaaatacaagaatcattcatctctagagttctttacttctaacatgttatcacgcacgttagttgttccacttaacgatagaaggccaagaatacgttcttcgtcaacaggagattggtcgatttcttccaaggtaagaacatgaatcaatttcattcttctacctttgccatcggcatcgagtggctcttccccaaaacctttcgcaagatgccgcaatggtgttgccatgccatggtcactgctaaaaaaaatactcattggtgctggctccaaaggtcttataggtgccagatttggaaccggcacctataccaccgttgccgccaccttcaccaccacacgcgtgcgacgtgaagtaggcgggtgccaggggaggaggggccaccgccgccggcacgcggaggagaaggggggaggaggggtggcggatggagaggacggtggagaggaggagaccagtgtgagagagatggagaggaggcagtctcgaaaatataaggacggagaggaaggatgatggcctattttttttaataggtgccggtacctatagttatattataggtgttggtttttttaaaagtccaacacctgtagtattggtacctgtttttctctaaaattgatacctgtaatgtaagtgtaggtgtcgattcttctaaaaaaccgacacatgtagtattggtaccagttttttccctaaaactgacacctatgtgtttaaaggtgccggttctatatttttttcattgtggcagaggtgagaaaaggggtataggtatcggttttaaataaactggtacctatgggccagtcgtagtagtgggtctttggtccgatattgcacggagaaatttggtgccgcccatgcttgcatcttcgttggcaaccccgacggcaccggccttgctagctccggcagcatcggcgccaccaccacagccgacccattttgactggccacggcaaaggcgctggccatccactcaaatgatggcatcaccttacagggggaggatttttttttgaacttttttatttttaaattataaaaacagaccattctaaaacttattacagaatctaaacctttggccatatcaactagtctggcgtggcaaaacaatactgacaccccacacatagcgagcataataattttgtcctactacactagcgagaatagtgtgaccaaataacgttgccacgccagccagaccgacgtgaccaaataacgctgccatactagccagaccaatgtgatagtattattttaccacgccaatctaactggtgtagccaaaaggttcatatcttgaaaataagttttgaaagagtttgttttaaaattaaaaatttaaaaagttcaaaaaataaaataaaaatttgagggagagaacggccgcctgccgaaccccactccattctctccaccgcgtggtgccggaccagacccccctcccccgggtgtgattggtcggtgaccagccgcgcggggctgcacccgcacggtcagttttgcccgccttagtccattagtataactactgctgctacaaatactacaactactactaatactaccacattaccactaccagtaatagtagtaatagtagttctattaatactagtactactactataattatatatatatatatatatatatatatatatatatatatatatatatatatgcgcgcgcgcaaagtttatatactacgtattaaaaaatttaaaatactaaaaaatatatcatgtatacaaactttgtatatacatatacaaactttatacacacgcatataaagtttgtatatgagcatataaagtttatatacatgtatgtatataaagtttgtatccacacgtataaaaaaccaaaaaaccaaaaaaaaagaaaaagaaaaccagagaaaactattttttttaaaaagaaaaccaaccaaaaaaacccacccacgtgggcttcccacgcgcgagcgactgccccccctctccgcgtgccacgcgtccatccacgcagggggaggggcgcgcgccgcgtgccacgcgtctatccacgcaggggaagggcgcgcggatatccactttttagcggatctgcccccaaaccacgacatatgtcctacttccctgcccacttctacatggatgtgcagccactgggggatggggatgaaagcgatggagtatgtgtagctgtggctgatggcagaatcgcggtatccctcctacgtcgtggccccgggccaatgctcctccctcctcgcgcaatgtgtccacgccccgcccgtctcttgacaaagtgaaaaggtggactctgaagaaaatggcagaacagtttcagagcttcaagggagatctgtaccagaaatatatcctgaaggggcagacaccgaacttcgacacattcccaaagctaagggatcactgggacgagttcgttgcatataagacaggtgaacaagggcaggcgatgatggaaagaaacaaagaaaatgctaccaagaagaagtaccatcaccacttggggtcaggcggctatagcgtcacgatgccgaagtgggaggagatagaggctagcttgcttgagaggggtatcgaaccggccaccgctaattggccggaatgatcgaagttctggtactatgctcacggtggaacgctcaacccagctgatggctccctgatcttcggcgatcagatacgcgaggctgcgcgttgactaacagacgtagtggaagcctcttctcagggcacgttccgaccggacagagagaaggacgagctgttactcgccctgcagactccagagcatccaggacgaacacgagggaaaggagtgattccttggaagattgggttcaaggaggacatccacacgtataggagttggatgaggagcaagagagataccgaggcgaagattgcagattttgagttcagggtatcgagctacgagctcagcatgcaagaggaggtggcaaggaaggttgatgaatgtcacgcccagaaattcccgaatagaattccaagcagaatgtgcattaaaatccccgtccaggaccggccggggtacacaaacgacaatgttgacattcagatccacgtcttacaaatatcataaaagtcttacataaatgcagcggaaagaaagaaagacaacaggagctaagccttgactagaactgcagcgggaacaccactccacaggcatcctcgacggcacgggcaaagcctattcctcggagaaaccttcatctgacacatactcgtactctggggttgggaaaagtagagcaagactgagtactacccactgtactcagcaagtcataccggaatagaggcatgatgcagggaatcatcaaagaagagctaaagtggatcatttgcataaagcgagcatt

SEQ ID NO: 60239 - DNA, 6196 bp, Oryza sativa
tatcccacgttgcaacaggcccacccatccacctaagctatccaaattctaaagattacactagggtgatactaatcacggtgaatctggttgaccgcccataaccgcgggcacggctattcgaatagttttactctgatcagaggtgtacaactgtacccacaagacacagccccacaacacgtttccatgcgccgacatgccaccacgacatatcggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgttgactagaggagagctacactacaagcccagccgttgcccacgctggcttgtggtaagtacgataagttcttccagggcatcccgcgaacaggtccttaattgccatgggtgcgaccagcaaaaccatgcacccacaacccaccatgtgatttattttaattaaccaacaccaaagcggtgtcactaatccaacaaaaccattagaaccaacagtctaaacattaataggattttccccattgtgcactagttgaactaagcatggctaagcaatccctggtccaatctctagtcatgttataaccccaagctgacaaagggacaaggtacaacaataacatggctaagacaataggtaaacatcccatagtaacattataaaacaatgcaatatttgaaaggaaacaatagagcatttgcaatataggatcaacatgttcaagtgacaagcatgacttgccttgctctgctgctggaggaacctcggcgactatttcgaagtacaccggagcgtcggaggaaccggaatctagcgacatacaaggcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaataaatcccagggctgacatcagcacggagggggcgcggcgccggcaagcgggccccaccggtcagcggctcagggggagcggttcaccgtggactgggaccacgcgggtggtccaccgccggtccacgggaccgacggcccagatcgccctcgggccgatcggacgggcggcgatagaggcggccgccgggcttggctcggcatcaaagccgaccggccggccatggctagcggcgacggcgcgcgcgcgaacgcgttgccggcgacggcaaccggcggcagaggcgacggcgcaaaagcgacgcgaaagcggcggcagcggacggcggcaacgaccaaaggcgacggcgagcgcgggcggcggcgacgcacggggaatcggggaagtaaaggaaaggggagggagttcctcaccgaaggggacggcggcgaccggcgacgaggagcgacggagggaagtcgacacgcggccgacggcgaccgggacgacctaaagaacgaaaagaaagagattagagaggaagagaggggccataggaggcgggaatactggccgaaggcggcggacatggcaacccttaccgtcgcacgacgggaacggctctccggcgacggacctcgacgaaggaggggtggacggggtggatcttggccacgcgaacccgacggcggcgacggcgcggtgcggcggcgagcctagcggcggctagcggcggccggagtagcggaaacggcggcggcgggtggttgcacggcgcgggagcgatggggagcacgagggagttcggcgagaaagggaaaaagcgagagggagcgacggggaagcttaaataggggaggggagggccggacgtggccgggagaggcgggatttcgccggccaacgtggggaagtgggggaggagagagatgcgggattcgaaaatcgaatcccggccatctcgggcgcgggcgcgggcgggagagagaggggagtgggcgcgggggacgcggcgcacgcgcgggcgtggtcgacgtggcccggaggaggcggaggcgtggcggcggttgcgggcgcggcggttgcgggcgcggcgccggctggaggagggagacgggcccgacaggtgggccccacctgtcggcgaccccgagagaggagggaggcgggacggcctggatgggcctcggcctgcggccggcccaacagggaggagggggaggaaaggagagaatgggccagcggcccattcgaaaaaaaaggaggaaaaagggaggaaaaagagaaagaaaaaggaaaaaggattttccctggaattaaaatattgcttgctcaattttaattggttaaaattatttctagagctctgaaaattccactaaaaatcctgttagtgaatttcgacatgtagaactcaagcaaaattctacatgccaaatccgattattatttgcattactttcttagggttttctcttgatttgcacctgcattttcttggggggtcgtttataaattaaatttttggcttgggaggaaaacttcggggtgtgacaatgaacgcatggccgcacatcggtccaatgatccccagccgaccattcctcctgcaatggtgagcccatcaggaaatcgtagcagctgcgcctcaacggggcaagtaggatcacagagcatggacgccatgcaaacccaggacgaaaccacctgccccgttgatgacatcactcagcggacaccatgtgagctgcatatccccttcaagaacttatcaataaaggtaaactcgtagtttatagattttagatttggccattccgctagttgctgcttatatatgttgattactaataaataacctctcaccacatgaaggtggcgtcgggcatggccatctcaacggacccttcaggtacttaccactacaggccgattccagcaggatactccaaggtcgaagttgagttggtcgaaggcgcgtacgaggacctcgagctggattaccctggaggagacggtgagacgcatctacaagacacaagccacgccattattctatggcgcaagcggtacatcatcctccctgggcgacaagcggcgtctcgtgcactatctcctccggctccgccatctcctcctcaggctcctacaccgtctcctcctcatgctccagcaccgtctccacctcaggctcctgcaccgactcctcctcaggctcctgcaccgactcctccgcaagctcctcttccggcaccttctaagtcaagggccccccaagctccaccacctgcccccacaagggcaacgaagaaggcgaaaattgacgccgccaagaacaaggacccagggtacgattgcacgcaagaggagcttgacgcttacgtggcatcagaagtcaggagacaattcaagcctcgaagtccagaaaagaagattcctatagacccgagtgtcaagaacttcttcaggggtatgtctacacctgccaaggaggccataaagctattggactatgagcgaacactcaagaaagcatcttctggaaagtccaaaccagtccctcagcttggagagcaaccaaactaggagatcgagccgttggtgaccggtgaagattttggaatacaagactttattaatgacaccgggctaactacggatcaattgctaggagacgcaccaatcgaaaaggcggaagtgaaatacatgtacgaactcggtaaaccgcttgtcaagcctgagctgttgcagtccctacccacacaaatgtacaagttccatcagctgtatatggagatgagcgccaccggtagagagatgatcggagcgaggatcagggacacggacttcttgcaaggagatgacattctctggatcaatttcaagggaatctacgaactataccagctggacgccctcgacgtctctattatgagttgctggattttgtaagtatattgttcggttagacttcttactacatctcctttaattaattaggtccttctatataagtagactatatataatatatactcccttttatcgttgtagaatggagattcaaagggcccgatggcgggggttttcgatactggattcattgacccccggaaagtaaacgtcgcaatgctcgaccaatatccgcaagccacagaggacaatctcgtccatctcctgaaggcgcagcattacaagacgttcatactgttgccgtacaacacagagttagtttaattttactgtcttcctataccaaatttcattcccgtacgaacatgctaagtgtttcatatgtaatgcatcccacgcacattgcagattccactgggtgcttttactcttcgacttggaggcctgcaccgtcaacgtatatgactcaatggataaaaaagagtctacgtttgataaggttttcgaacttatagacaggtactgtcataagttcctatgttaattaagaatcttgttatagttaattgctactacgaatcatagctttaaactccatatagggcttggtatcggttccgtcatttggtccgcggcaaatggagagaaagacttaggcggaagttcaaatttcctgtgattacacatgctctacatttatatttctccgattcaaatacatacaagtgtatattaattagatctctcgtcatttatttatagtgcgtaaagcaaaagcagggaactaacttgtgcggctactacgtgtgcgagtattgccactgccttgcagaccaaatcatcaccacaagagagctcgatgtacgtacaaataaattcaaaatttcattacgtatcgatttgttgtttaattactaatcaatttcatacattcatatagtttattcgcatgagggataacctgatcacacacaaggaatttatcgcggtggttcaagaacaacttatgggattcatcaacgaacaaatccttgatcccaagggtgaattctactacgacggaaacacaattcataggtccttagcttctgagatagcgactactactacgtcgaaatcgtagctagctaggacatataatgaattataattaatacatgactatgtttctatatgcatgtgtacacattttctataatgtaaatatatattttagtcatatatatatatatatgcatttgcataacatatatatgtataaatacatatatattatgcatgtacatatgtattgaaacatatataaatataatataatatatatatacatatatatgtattgaaacatatatatatatatgtatggtttatatatatatatataaaccatgcagcaacagggccatgcaaacaaaaaaaagttagctcgatctaacaccaaccggtactaaagatggctcagtcgggcactggatgatcgccggacactggtcgattacgacatccaggagtccacgctccacctcgccgtccgcctccgcggcggcagccgcggccactatccctgcctcgctcccggcctcctcgccctcgcgcgcaagtacatcgagatgaagatgatctgccgcaagtatgcacacgcttccgatccgatcgatccaaaactcaagtggggttaattttgggagtacccctggttaatttgaacatgcatctatctagttcgctccgttcaaacaagacgcagtagctttgtgttgcaaattaagtaaactttgtctttgcatgattgcatcaacggtatgaaatgcgaaaggaaggaatctcaattggtgtgcatctcagctttctgatgattttgattcacagccgccttgtttgcatagttaattagtttcttgattagttgggtggattcttgatgggcataaatgatgaattaattagacgtgtacagttacattattattgagctagaagcctataacccttttgcggcaaatgtattatctgtctgtccttttaatcaacttgtttaactgtttgcctctatgagttttgaaagttttgtcatttgctagccatttacttaagcttgctttactgcttaacttagcaaatcagtcataatggactaaaataattaggcacaaaggggtgca

SEQ ID NO: 60240 - DNA, 1039 bp, Oryza sativa
aggcatcaatacttgcactttgacattatgttgtgtttttcacagttttgaacagtctgtatatagtaagtgtacacttggattcactaggtagatgatagtggatttaaggtgacaaacatgaattccttcattctttgatctgatgtattttacaacattcctgttttctttttcagctaaggcgtaagaaaaagttaaaggactactgaaccatgggaatggaaaagcgaacgaaacgatgatatatatacagctgctgtcagttgaatacttgaatgggatgtctttaagtcttaacatgatagaactaccgctgcggttagttgaatgagatgtcttagcatgatggaactgctgttattagtatcatactggagtttaacttcagccctagctagtttaacatttcctgctgggttatgaaccttgattacccgtttccatatgctaatggtggtttaattttgaagcatggcagttacatgctccagaaaccccggctgaaagttgctgaactttttttttatcacactatggatattactgcatcgtgatggttcggatagaaatgctagttgcagatgaacattgcaaatattaatcttctggatgcaatgttccctagctgtctactgtgtatcgactagaagtgatttttgagaagataccgagaggtgcgtaaaatttgatatattttggtaccactaatagaaggtatcaaatctacgctaaattaaaaaaattaatatctttttatgtgaatgaattttagtatattttatatttcgtcgtaggttgtttatgagtaattcaggacgaaggaagtaggtaagtgtgtatttagttcgcgaaaagaaaattgttgggtgtcacatcggacgtttgaccggatgtcggaaggggttttcggacatgaacgaaaaaactaatttcataactcgcctggaaattaccgtgagatgaatttattaagcctaattaatccatccttagcagatgtgggttaccgtagcacttatggctaatcatggactaa

SEQ ID NO: 60241 - DNA, 2573 bp, Oryza sativa
atttccaaattgtatttctatatggactctatactctacttctaatattccttatttttaattccgaatttctattatttcctaattgtatttctatatggattctatactctacttcttatattccttattttaattccgaatttcagttatttcctaattgtatttctatatggactctaatctcctcttctaatattccttatttttaatttcgaatttcaactatttctaaattgtatttctatatggactctagtctcctcttctaatattccttatttttaattctaaatttctattatttcctaattgtatttctatatgaactctatactctacttctaatattccttatttttatactctacttctaatattccttatttttaattctgaatttcagttattttctaattgtatttctatatggactctagtctcctcttctaatattccttattttttaattccgaatttcaactatttctaaattgtatttctatatggactctagtctcctcttttaatattccttattttttaattccgaatttagctatttctaaattgtatttctatatggactctgtttttctttttctccgactaatgtgagaatttctaggctatgagagcgaacgtggaggctcctttttctattcctttaataatataatagattatatctcatagcatcacaattcgactaaaatcaacacttacagtttgaaagttgctaataaaaatataaataattcaaatctctgttgattattggattatcaaagctattactggatatttggattattatgcaagttcatctacaccatttggtctattaactctgttgattatcactaatcttattacttttcacacttatctctgtttatactgtactacatgatattgtcatggttgcattgtgcttatcatttcactagtttttagcacaagtagtaaatgtaagcatgtctatgcataattctgaaacttcatctgctaatagctctagccatgaattgtcttcacaaatctcaaacatgtaaaatagcaaaagtgagggaacattttgagcaaaagcttatcatgatagatggtcttcaaaaagcacagtgtaaatattgtggattaatgttatcatcaactagaaaatcaggaaccagccatctcataaaccatattttgtgaatcttgtccactagttgattgtgaagttagaaataggtagcaacagttaggaaacaacccgtggaaaatttcatgtttgatcctaaaaaaaactgaagagctgatgataaaatatttcatccatgctaagataccattccagaaaattgaggatccctaatggtgtagttcatctcatattcaacttctgtatttttctgataatctcgaattgatcttttccaatctgcagaagtttactgttccacaaaaatacttcatgaatttttatgtggtcggagtgttggcgggaacaattttgcttctggcaatatggttctttgcatatatgaaattaacactcatactaccagacctggcaatgatttacgagatagtcattcagatccaacataaagctctagttattaatatatgacactttggaccaacatacgcctaagtttccttttactaatgacatatattacagatgggaatgattaatatttgcaaatcatggtataatcttgctggatttatcattacaattaaagcatcatattaaattatttacttggtactagttcctatccacccctttacaacagagagacatattgctaaattatccacttttcagatgcaaatctacacagcagaaaaagaaaatgacaaagatagaccctctcgaatgctactagctaatctgcatgacaaaaaaaaaaaagacagattgtcctccaaccatccaggagtacaatgggggcaaattttttgcatggttgactaccactgaagttcatgccactaacagcataatcaagaactgacaactaagactgttctctccttcataatctggaacgtgacctcctgcatgagctgccaatttaagttccttagccacaaccatataagttttctttttttttgtcctactttctccataaagctacaactttttttttctcgcgagggaagttagcaaaggtagaagggattgcaggacaaacaatcagcatggaactgaattaatcaaaaagaagtgaaagaaaaggtcaaaacctcagcgctgtcgatggcgaggtcgatgcgcaggtggtcgtcgagggtggagagcgggatgccaagcgactgtgcctgcccgatccctcttcttgacgaggcctaaaacgaccttcctctcggctgcctcctcgcagaccggggagtgagtccggcgatggtggcggcgaacggcggtgacggcgctcggcggtggcggtgaacggtgctcatcggtggtggcgctcggcggtgacagcgctctgcgccgcgcgtggcggcacgcagtgcacaggtgcactggctaacccatgggctgagttcatggattggcctcacaggccatcccg

SEQ ID NO: 60242 - DNA, 1742 bp, Oryza sativa
ctctgtcgtctcaaaggtgttgaatagtatttttttcctcgatgttacagttggttttctttgttgtttcacaagttggtttggtgtacatctcatgtaaactatatctatggatcgatagtacaagtatccaatctaagttggtactaaattttgctgaccaaatctttctagaaatctaagttggcaagtacagtgataatgtggttgaagtatacagaaaaaatcaagcaataatagacacagatatcggaaattttaaccagcatccaggcaatcaatcccaaaaaatgaaccagatttgagatgtctagggtttgagggagagagtctagggtttgggttaccttgcaccagatcttctatgcggcgccgccgtgcgcctccgtggctgtggggagccgctcccactgccaagtgccgccgtgagccctcagccgtccaaacctccagccggcgccgcccaaacctccgcctggcgccctagtcgcgagagaggaggcagccggcaccactgccaccgccgctgcctcagtcatccctccttctgtctttgcaccctcgcgtagaggcgatgcgcgaccgcgactcgggactcgggggatgcgcgactcggcccagtacgggtgtaatttcatcagaaaataatgaacagctgtgggctctaatttaatacaccggaaatttcatatgtttacaatacaattacacatggcacagttatctctactacgtggtgatggtgaagccaaggtagacatgcgacgtacatcgacacgttgagagcgacgaactcctcttccgaaaaaaaagcgcacacgattcctccgcaacaaaaaaaaacggcgccaccccaatccgtcacccgccgccaccgactccccctcctccctcatagagccttcccctatacccgcgcccccctcgaccgccgccccctgccgtcgtctcatcctgcctgctccatacatcgccgacgctccgcaccaccgcagccccaatccgcgccgctgatggctccaggtcatcctcgtcgtcgcgcagatgtcgacatacgacatcggctaaagaggatggagtacccccccctcctttctcctagcccagccgtagcctagtaacccagtcgcgcgtgcgatcgatcatcagcaggagccagaggcgcgtcgctttgtctgtcgtccacaccatgactcgcgagacccaagatcgagccgtgtcggttcgtcgccgaatcgccaatgccctaatccgcgaccgcgaaagccgagagtgcgccatgccgcagttgccacctctaggctctagcgccagtgcgcctaatcagctgattgccatcgccgacccgcctaaggaggcggcatggctgcttgcctgcctggtggctggtggcccatggtgggtgcggtggtgcctggctgcctgccgcccgcctgattttgattcctgtgatcgactgatcgtcatcgcctctcctctcaggcgctcctgaactgaaggtatgtcgcagaactagaagtcaaccaatactggtggagaaaccatctttggtcggtcagccaaattccacaatagtcccggttctaataaaaaccgggactaaaaagcatctttagtcccggtttaaaagttgaggggtactttttgatctttagtcccggttggtgttagatcatttttaatcccggttcaataagtcatggggttcaagacagaccccaattatttttactcccggttgg

SEQ ID NO: 60243 - DNA, 1239 bp, Oryza sativa
gttcatccgttggttccccaaggatctgtcaattaacattatatggcacaggccacgagaatcaacatgacaaacatcgttgctgttacaaaatatatgcaatacacatgtctttttttctttgtcgggatataaaatacacatatgtaatatgttgcttggcgcttgcattatagcatctactacggcaccttaatttactcaaagaagaaccatgtacgactgctacttgcagcctagcctagcccgaaagcattcgagattgataaatcgccagctcatggcaagctgtgctatcatgtaaatcatttatgttcttgagatgttttgctacttccaccatggatggtctcttcgtcacctcggacgtcagacaccgtgaaaccaggctcttaacctcctcaagatgacggcatctaaggatggcttccttgagctgttgcccaggtttctcaggctcggaattcacatcatgtggcggtccaatgtcccagagctgctcaaacacggtatccgcctcttgcagtgacaccttcttccatgtgaagagcgttaggagaacaagaccgaaacagtatacgtcatgctccttcccatgactggttacaagcgaatcctccatgaagaatcctgtgtgctgtgccttgtcaatgtcagggagccctgatgttccatagcctgcaatctttactgggtaattgcggctaatcactttgagtaccgaaagatcatccagcaatatattgacagtgctgacattgccatgcacaatgccaagtgagtgcaagtgagcaggccctctgcagcgccaaccgcaatcttcaggcgcaggccacaaatgaagggagataccttccttgcatcatgaaaaagaacatcatacaagctcatcgcaccatactcgtatacaagcactagaccttcccaaagatctaagcagtaaccgagaagcttggcgtcattccagtgcttaattctagattggacattcaattcgttccagactatgtttttccattgatctaaaactgaaatcgacatctttattaccagcagttgtgcgttgcaaaatctccctatgtaagccttgcctgatgcacattccttgagaacagttttgaagtagtatgtcatatcgtccattctctctttcgagatcataaacctaccaaagccacatcttctacaaagtacttcaatctcgctccgtaccataacctgcatctcacggattctcct

SEQ ID NO: 60244 - DNA, 759 bp, Oryza sativa
ttatccgacattgttccttgaaatagataactcattattggttaatgaatatgtgattctttcatgagactctttatgttgtttgttactatttctaaaggatccctgatcaaatatcatatgtggaacaaatatgtttatatgatcagcacatgtattaattaatgatcatgtctcatggatcatggtatagagataccaaattaataatgtggacacatgttggtgaacatgttgttggatagacccaacatgagacattgtaagagccatatgtgttgtgtcatcagtgatctcatttagtattggtgttgaatccttagacctgatattatcatggttcccaacatgtgtagtagcttacttagggactgctaaacgctactccgtaattgggtagttataaaagtagttttcgggtatgctatgaaacatgtagtgggattgcatacatattggatttagccgatggcaacaaaggttttactgtttaatctaatcttgtggattttatgacatcggacctccagccgatgtatgctttaaccttcggattagtatttcttttattatattatattgctagccaattggtttatactggattatattattgttatattgattatcatcagccgatcgcctttatatcattatctgtattggacatatagctgactgatcaaaaccctatcgacatcggctggtatcgacatcggctaaaattactccatcagcttgtcagccgatgggctgcag

SEQ ID NO: 60245 - DNA, 1048 bp, Oryza sativa
catcctccaaactgtcacccttcaattattatcgttgattcagttttctggcagattcaagttccactagccccattcctgtgatgattgatcagattttgcacctccctctgcgtataattggttatttccttcatcttaatggccaatgtagttggtgttagggatcgttcttacacctttttccaaaagcaagaaaatttggttttaaaaaaacatggaaaatatttgccatgcacatacatataacatagggagaagaataaaaggggtaaaatcctaaaacataggccaactgggtgagcaatgtttatgcatataaagccttcattctttcatataaaatatttttctagatctgtactgctataaataatatttatcatatatatttatgtgacaactgctaaaattagctctgtcttgccacatttgtttcttcaaattaaaattgtctcatcttctattcgcaataaaactaaccagaaattttacacatgacttcctcagaaatcagaaaagtattccatgttttctttttttttggctttgcacattataaactacagaaaaaagatatatagtgatttcagtaatgcaccatcttcatgaatttgcaggcacaatataactatatcttctgttcactcttatgggagattggtatgaacaattttcacaatcttttaaggatgctgctaaggaaatgttggcaaaaacagatattgatccaaacgttaagtgcttcacaagaaagcagatgaagcgcatttcaaacaactacagaactatccttgggaaagggggcttttctgtggtgtacaagggtaggctcaatgatggccgtgcagtggcagtcaaaaaatataattggaaaacacagaaaaaggagttcacaaaagaggtaatcatacagtctcagtttagccataagaacattgttaggctattggggtgttgtgttgaggcagatgctccaatgttggtcactgagtttgtccccaatggtaacctttccaaccttctgcacagcaacagtagccagttt

SEQ ID NO: 60246 - DNA, 1489 bp, Oryza sativa
aggggcggtggtgaccaccagcgcctcgtcgtgccgtcctccgcgtcgtccatgcccaagggacggtgctccgaaggtgacgtcacgcgcgacgcgacgcgaccgactcgccttccccctcctcttttttttttattggccgtctcgcgtggcgcgtcgtgcctgagattgagaaatccgtcgtttgcgtggtgcgctgatgcggttgcggccatgggaggggatagattgcgctgcggcagcagggaactggttctggattggtattccgttgtgtttgatatgattagtgattgcatatattcgtctttatggggattcaggcggctgcggtagaaatttattgtttgattttaaacgttaggattaggatgtctgcggagctttcctaagagggaaccattcgtcacatgtggtgtttgatcgatggcatgagcttatgaacctgtttggaactatagaacttaacagggaataactaatttgacgtaggaatgtaattgattgttgattgtggattttcattagcggcgaagttgttggagcgttggaggtattgtgactggtttgcaatgatctgtttaatgtatcctaaatgtgttgaagactatgaaagttgatttatttgttctatatgtgtgtagagatgtcagtttaagtttttttggaggtgtttcagggttgtgttaattgggctgttgttttgatgatgtttgaagatgctgatgtaggatcttattgaggaagtgtttgcttgttgtatccgatttaccatctgctttttcaggcatagacgcatagttaatgttgtgtaaaagcacacaaatgccttaaatggccttacctcccattgggctttccatatgtgcaccgcaaaaaagattaacggcattgtctaacatcacttatcttcatgattttatatgcaaatacaacgcgtggcttaattacgtacaagaataacaaaaacaactccaaggacaacaaaaataaaaacaatcctgaaattttttgcatgtgttgttgatttaaaggttaattgaaattacattcctggagtggtctccgttaccaaaaccaaaaatcaagtggcccatacgatcagtaatatcttatttttatgcttcattgattgcttaaatttggttccattgcccagttctttgcatgaatgttgccagtcgggttgaggagtccattagtttaattcatctatgctattgcgggtctaactggagtataacttttaagttttttgaggtgttgattaagcatgctatgttttatttcagatttgatactgtgtttacaggtatgctgcatttgcatcattgtttgtaaaagcctttgcattgacaagtccatgcttgacattgcaggggagtctgaatctgatagtgaagcatcagatgttagtggttctgacggagaggatcactcatggatttcatggtactgcagtctaagagggaatgaattcttctgtgag

SEQ ID NO: 60247 - DNA, 1120 bp, Oryza sativa
atgggcgatcgatcgccccgagcgatcacccccctcctccacgtggttttccttttttggcaccgcattactttcctattttagtaaatttatgcacctaaagtttgtacacctcaaatttacacatctaaagtttatacacctaaagtttagagacccaaagtttatatatccgattcaaatttgaatttgaattcaaatattttttatatatagtattttatatacatctaaagtttatagacccaaagtttattattcaaaagtttatatacccaattcaaatttgaatttgaattcaaatattttttataatagaaaaaatgcccatgcgttgcaacgggtgaaggttattttaactttattattgttatacgatttagttaaggtgaaattcattgtgagaattcgcttggatatatatattttcccacgaaattatgagctataattaggagtccgatcatcttgtcgacggtgagtaaccgtagaccggatatagagggtattggggtacgctggtacgaggatctacgtagtacgacatcaaggaaacaagagagaaagattataatggtttaggccccttagtaggtaatagccctaatctagttgatatgggattatatggaaataaccacagattacaaagggaatagtagaactcggtggtaccgacgagattgtagtcgagttaattagactagaccacccggcgacttggctcctatagtcttcggcttcgtaggctgtggtcgtcgtgtagcctatgagattcgatcccttaggtccccgcggggggtcccttttatatcgcaggtcaggcggtctccaagtaggactcggaggcatcggaccctgcacaatatagtaacgacccagtcctatacgggtaggaacctttccattgacagactttgtgatggacttccttagcgtattcagaggacgtccgtatatgcaccgacataccgtattgccgtatagcatacgtccaagggtagagggtataccttatccgtaaccctgacaatagcccccgacttctacttaaatgaactcatgtaaccaatcgcgacttctgatgtcggaattgttgtcgttctcaactggtcgatct

SEQ ID NO: 60248 - DNA, 4550 bp, Oryza sativa
gacgcaacggacccagaaatttccggtggccatctctctcctttccttggaattcgcaccgtcggtagtgcgcctatttaagggagttttgggaatccattttggagtccggctgttgcgagaaactttcaagccttcggagctcttcgtcttctccgcttctgcacaaaccctagcttgttcctctcagccccttctccggtgatcttcgacggggatggagctcgacaagtccacttctaccagcgcgtcgctgaagaagttgcaggaggaaggcgctctccccggtcgcaggaccatggagagggaaccaggaggtattgaacctaaacctgtcctgggccgcatggttgcagttgaggactatattctctgtggtttccttcctcctccctctgagtttcttcttttggtcttgaatttctacggtctttctctgctccatttgaaccccagctctatcgccttcctcagtatcttttctcatctttgtgaggcctatattggggttgacggagctcgtggctcctcaccgggagaccgcgcaggcccccctttgccagttcggccgggggcttagggtgaaatctcaagctctcgctctctctgtatgtggaaatatcgtatgcccgccagaaaacacgagacaccgacatctatacaggttcgggccgctgagaagcgtaataccctactcctgtgttttggtggatctgcgtatgaatgagctacaagtgtgagctgacttctcccccgttctaagctcatcatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtcagtgtcagaccggtcacaaatcggtcattcttgtccaccgcgtgtaaacttggcaacgtgcatgtttgcccttcttcacacaacatcttgcctgtaatggttaagatgaagcctggcatatatcgaccgggtctaacgtgtcatctctaagggataacacgcttaacgccggcttgagacgagtgactagaggctttcgtcttgacgggatggggcatggcgtgcgtcagaccgccagtcgccacctaacccgtgatctgaccggtctgtgactggtcacagaccggataaagggacgcgccgtgctgcactgcatgcagcgtgacacgcttgaccagactgcaataaatgctgttaggtgagcacagctgtgctcacttatcccatatacgtggcgcagacttcctaaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaggggtagagccgtttcttgacctctttcgcttctactatgagttgcgttggatggaatccaacagggtgtcaggatgcgttggttttcgacttagggatggcctgaagtcgcgctatatccccttccagtgcccctcttctcgtagtaaatggcgggtgaggtggttagaaaattcggatccggtcttggttgttcccgaggagcaaccgaacaatatttcgtcttggactgccaagcccgccttgaccccctcccttcagtctttcatcgatgtcatcgatgacctccgagtgcgagggttgtcggggtatgaagtcgctgctgacttcatcggtagacggatccagccgctctaggctcgagcccatctagcctttgactactcagggccggaggatgcgacccgggtttctcctcagggtatttttctcgtattctgggttccattccttaagtatatgttccccctgacttatcaattttggttctcgatctataggtttgaacagcgaaactgtagagcgccgcgttggtcaagtgatgatcagcggccctacaacggcgagcaacgtccctgttgctctttgcgagaagggggcagccgaacgcgaagccaccatcaatgtaagtgtactcagcggcccttttgcatttttctttcgggatcgcattgtgacttcatgaagcgtatgctctccctctgactgatattatcgggccactcgtggaccatcaggcggcggcgtggctgaaggagaacgtcgccaaggaggtgtctgatgttgctgctgctgctgccacaacgagtggcggcaacatcccgagaagggggaggaaattctcctccgtgatcggaaatcgtcggaaaacgcccaccccctcgataagctctcctggtcgttcatcgcgtagtcggaaagcttccacctcacatcatgcccgttatactccaggcctcggatgcgtctccccgcctccgcgacggcagcggcttgtgacgcttggcgagaagtaagtggatgaacttgaggttttgtcgcttcgttgagctcttgcagcctgtctcaattgcagcctttcacagggcggcgcgggcgaaggcggcataagacggatctggagggacttccagcgcgtctcctgccgtgtcctcgactgatgtcgtggtcgtgcccaggagccgcgaggcgacgcccagcggcccagtcagcgatctcgcggctggtcggggtccgccggctgtcgtcctcacctaggaggagctccaggtcaagatggggcgcctcctcgaggctggtgctcgcggcattagccacgagatcgtagaggcgagggcggcggcggcgtcgtcggcgaacgagcgcgccgaccggctgacgcatgatttggcggaggtttgcaaggacctccagaagatgagggaattgtggccggcaacgagcgacaacggcaggggctcgagcaccgtatgtcggagctcgagaacaacttgttggaaatctgtggctcgctgcgggtcacctacactggtctgcaccagctcgccggggagtgcggtgtcaagaccaccatccctgcgaatcccaatgaattctcgctgatgacttcgcttgcggaactggcgacggcgatggaggcgatcccctccaagcacgcggccaggatcgaagaggagatgtctaacgggatttataccggggcgtgccatgtccttgcgtgtgtgaggctggcgcatcctgaactcgatcttcggaagatcctggatcagggggtggctagcgacgcgcgcaaggatgtgatggaggaagtcagagacctgggggagtctgtcctccccctttttgaagagtaggaccgccgcttgtttgtaccccttaaccaatcgtgctttgtaaaacttttcgttggttccaactgcttttgtgtgtgcaattgttgccttagttttctttggcattttgattccaggtactttgtctgttgtttgtagagatgtcggtgtcgagaatgtccagcagcgcgggcagcctgaattgcttgaggttgcttcgacacttgagctcgagccgtacatgccgcgggatggcatagaccaggatctgcccaaggagacggacgtggtgtcgacttctttaggttggctcttgtcggttccctttcctttacctcgtctgtcttgattgggttgacttagatgtttgcatgttgagcagacctcgagagtgtgcttgctgatcacgaccgtcgcatccagtattggaggacgaagtttgaggtcgccgaacttgagaggactatattggaggtgaagagggatcgggctgtggaggcgctccgaggtcgcgaggtatggttcaactcgtacctcaggagttgttgcataaccatggccgttgtctgcagagagctccgagtacctcgcggggatcccgaggagtcagcggctggctacatctcgtggctgaacggggcttgcgctcagcttgaaggcatcggcgggtgtatcgacgaggccctaaaacaggaatgtcgtccatcgagtcgatacgccggagggcacatactggcgtgtatacgagatcatcgtccgcagttgcacctcgagttccttcacgaagggttttcccgttctcggaggaaccctacggagatagacaacctagcgaagttgatggctccgctagctgagaaaatcttccattcaatggattggcattggccttcttggtagtgcctatatatctgtgacaaacatcttaagaaaaaagtaatgtattctggaattctttgcgatctgtaagaaatgcttgtgaaatagaaaggaaatctatctaactagctttcttatgctggtacggtgtgcacgagtgtcttctcacttcacgacttcgatcagtcacttgagttatacactctccctagcccccagccttgtcgtccgaga

SEQ ID NO: 60249 - DNA, 2161 bp, Oryza sativa
acttgtgtgatcgtgtacggtccttcccatttgggtgagagtttgtttcgccctgcctggctttgaactcgtcggaggacgtaatcgccgatcgaaagtatgcgtgctcggatgcgcttctcgtgacatcggcgtagggcctgttggtagctagctgctctgacggcgacccgttcttgatgttcttcgagtaggttcatgtcgtcgtttcgctgttcctcctgatcctcgtcggagtacttctgtagtcgtgtactctgatgacataacttggtagggagcatggccttcgagccgtacacgaggaagaagggtttctctttgttggacgttgtcggtgtggtgcgcacgacccatagtaccgaggggagctcttcgacccacttcttgtcatgtgacatgagcctatcgtagacacgggtcttgatcccttgtagtactataccgttagccctctctagccctctcgacctgtccgttactctgagggtgagaaaccgaagcgaagcatatcttgactcctagtccgatgcagttgtcttggaaatcagcgctgatgaattgggagccgttatccgttatgatgcggtgaggcaatccatatcggcaaaatatccccttaatgaacttgatggcgttgtcggccttgatttcccccgtgggtgttgcctcgatccatttagtgaatttgtcgatcggcacggacaggaatgtgttgcttcgatccatttggtgaatttgtcgatcgccacgaacaggaatttgtagccgccctgtcctcatgggaatggaccgagtatgtcgagcccccagcacgagaacggccaagtgagagggatggtttgtagtgcttgcgttggtagctttgtgtgtttgctatgaaattgacaagcttcacactgttgtaccatatcgcaagcgtctttgagggcggttggctagaaaaatccttgtcgaaaggcttttccgaccaatgtacgaccggcggcatgtgacctgcagaccccttcgtggatgtcgacgaggaagtgtttgccgtcgtcagacgaaacatattttagaagtactccgtttggcgccttcttgtatagatcgttcccgatcatacagtagatttttgcttgacgggttattttctcgacttctgcgtcgtcctcgggcaactcattgctgcttatgaatttaatgagtggggtccaccagtcatccctggtctcgatgtcggcaacggcacaatctgcctctgtagcccccgagccgatgtcgggggtgactgggctatcttcgtcatttgcctctttcactgatggttttgtcaggatatctagaaaggtgccgggttcgagtagctctcgtctggacgcacgccgtgctagatttgatgggacctcgatcccatcaaatcttttttccagcttcttgacttctgcaagatatttggaagctcagggctagagcatttgtaatctttgtgcacctggtttgcgactagttcggagtcccctttcacgatcaatcgcttgactccaagtgcagctgcagctctcatcccagcgagtagtccttcgtactcggctgtgttgttggtcgccctgaagttgaggtgaattgcatgcttgaactgatctcccgaaggtgatgtcaagatgaaccccgcacctgctccttggctgttgagcgcgccatcgaatgccattgtccatgtttcgttgtcggtctggctatctaacctgttttcaggcatagttcaatcggctacgaaatcggcaagaacctgggacttgatggctgttcgtgtataaagtggatgtcaaactggcttagctcgactacccatttcgtaatgcggccgacaacgtctttgtttctcacgacctcgccaagagggaaggcggagacaaatgtgactctgtgggcttggaagtagtggcgtagctttcttgacgtcatgattactgcggagagcagtttttggatctgtgggtaccttgtctttgcgtcgtgtagagcttcgttgacgtaatagattggtctctgcaccttttctctttcgacaacaatgacagtactcacagagtagggcgtagtggcaatatagaggaacaattcttcattaggttggggagcaacaagtacaaggggatttgacaagtagcgcttg

SEQ ID NO: 60250 - DNA, 2774 bp, Oryza sativa
aagcgaatacgtccacattgtcgcggaggaaggtgatgagcgcgagttcctatttctcgttcagtgatgccccgatcttgaccgtcttgtcggggttgacactggagagtgggacgattttgattgcgccgtctggtttcggcgtcttagtcgttttgatcactttcttgggtggctcggctgtggcgggtgggctgggagtgtactcgaccatgtcgaggcttcgcttgtcgcattggaccgccagcttcgcattcccttggatagtgattgttccctttggccagggcatcttgagtacctgatacgcgtagtgagatgcggccatgaacttcgtgagtgccgttctttcgatgacggcgttgtatgctgtgtcgaactcagtaacatcatatgttatctgctccgttcggaagttgctcgcttggccgaaagtcaccggaagcatgatcttgcccaatggcttggacgaagattgaggggtgattccatggaagggttgatcggtaggtgtcaactcgcctcatggaaatcccattgcgtccaaagtgttggcgaagaagattgatggagctgccgccatcgacgaggactcgcgctaccttgatattccgaatagtgggtttgaccacgatcggatatcgtcatggtataacagcagccttggggtggtcttcatctgagaactcgatcttctgttcagaccacttcatcttgggtgcagccccctgccatgtcgaacaaacctcacgctctacttttttgtattctcgctttgaagagtatgttgtggaacctccgaagatgtgtgagacatgaagatcagaatctgggtacgcggagtccgagtcctgagtggttgcctcagttgccttctcgactacacgtactcgcttacccttctctaaagccagcttcctttccgatgattttttgaagatgaggcattcctccagagaatgtctgtccgacttgtgtatggggcaccatattctctttgtatcactgccctgtgggtctgggtgtttgggcgggcgttcgtattcagatgcaaggacttctgtttaagctttcctcttcccattcttgccgcttttcttcttgcttgattcgggcgcgtccttggctagcttcttctctcctcccgcctttggtttgtcgtttttgcgtctcaatgcgtcgtctgcatgggcacatcgatcgacaacctcgaataaccttcgagtagtagtgattcaccttgttgccaactcctgggtagtatagcgatctctgacaccggttttgaaagcgcggatcacagaagcatcggtgatatcggggatcgtatttctccactcattaaagtgccgaacatagtccctcaaagattcaccctgattctgtgttaacacgtgtaaatcgtcttcgatcgcgtgacgcttgtaagttccctggaagttcgcgacgaattgttgccataaatctgcccatgaagagatcgagtaaggtgggaggtgcatcagccacgaatgcgcagaacctttcaacgccgtcggcagataatttactaacgcgttgtcgtctgtcccaacggcgtatagtaccgtggagtagacctggaggaattcttcagggtcagaacttccatcgtacttctctattgctccgggtcggaatctctcgggccatcggacatcacgtagagaacggttgaaagccctacacccagcgctgggggcagtgggttgtcggcgatcgtgtgtcctccgtggacgtctatcggatgatgaagacggagatgatgatgacgatgacgacgatggctcactaggctccggtgtgcgattccaagggcgacgttcaggttctcgagagttctgtcgtcgtccaccattgttgtcctgcgccgatctccattatcatcaccgtcatgctgatgccctcgaccaacatcgtctggtgtccgatgttcgtgatcgtcgcggtcgcggcggttgtgacgattacggtggtgttggtctccgttcgagcgtcctcctcgatcttcgccctcgcgacgtcgtgaagaaacacgatgtcgggaacgattctcgttgtcttgcgcgcgtcgtgcttctcggcggccatttagatggtcgtggagatcgccggtgccgcgaggtggaggagtagctcgtctcggcgacgtccgctgctccggtggttcgccgtcggtaccgtcagccatgggtcgttcaggttgtgctctggtagcagcttcctcgaacgcgttactgagattggccaccgattcccgtagtcgttttgtccaacgtgcgagatcatcgttaagcacaggttgtaaggagcttctctcagtattgcgttgacggtgccgagatgctgggccggcgtacccgtctggttctccgcctctgcgttagcctgtgcggatgtgctagtcccaccgatggcaaacacgtcgcgtggtgtactggaagatgacgagccacaatcttcgagtaagtgaaggaccgatggctcgtggggattgatgtcgattactccaacgaatcaatccgaggtcaacgtcactccttgttccttgcctgtatcctcgagagaggttcctgactgccggaccttaggaggcgtcgtcttcatggcgcggagaaagaccttgcagcttgagaagtcatgattcttcgtcttgtgaataggacaatagacatcatgagttggggaagtacgctggattccacgctctttgcaagcacggatttcagtttgtacgttgagaaaaacccagcaag

SEQ ID NO: 60251 - DNA, 3080 bp, Oryza sativa
  unsure (1)..(3080): unsure at all n locations
ttatatccccgcggggggtcccttttatatcgcaggtcacgcagtctccaagtaggactcggaggcatcagaccctgcacgatatagtaacgacccaatctatacgggtaggaacctttccattggcagacttcgtgatggacttccttacgtattcagaggacgtccgtatatgcaccgatataccgtattgccgtatagcatacgtccaagggtagagggtatatcttatccgtaaccttgacacatctgaagttagcatgtaattttttttaaagaaattccttatacgactggtaatgtatttaaaaaacgaacgaacttaattcaaaattataatatgttgtacgtactgcaagtactaaatttgtaatcaaaattatttgtctttgttaggttgcataattttttttcatatatttactttgttatgattttatagttatttagttatttttaattttggatccatcctaacaatatggaatatccatataattttagctttggcctgtttcaattttgaacgttgttttaaccttttgagtaggtgcaaagccgcatgcatgcaaagtcagcccaacgtgtgaacatgcaaagtcagttgaacgtgtgagtggcttgaactgacatgcagtcgaaggcttgcatgtgcatgcatgccgcgtccctagaggacccggtcacacaccgacacacgaacgagtgaacgacgccgaaaattcgaacgggactcccatgcaggcgacgatgaacacgcacatgacattgaaacaaacaacgagacgggtaggaatcgaaaacggtaacttaccaaaaattttagcaaaagcatcttcaatttttataatagtatttttatacgcataaagtttagagaaacagagtttataagtcaaaagtttatatatccgattcaaatttaaatttgaatttaaatattttttatatatagtattttctatacatctaaattctatagacccaaagtttataagtcaaaagtttatatacccaattcaaatttgaatttaaatttaaatattttttatatagtatttctacacataattttttctaactttgtttttttattttttaaaaaattatggtgtagtaggaagaggagaaggggaggaggaagggggagaggagcgtgttatgggggatagcgatcacccgcccattagcgacacccggagtagagggcgagaaaagaggagtttgaagccgttgacacgttgtggccacgcgttgagcgcgtccgagagcggtcggcgccggttttctttttctctctcgcgttaagcggtgaggaatgaagatggacagggactgggctagctggggaggctgccaagtgggtccaaaccgtggtaacctaggctagagagaaagggaagggtagaaacatgggtagactagattttggatgattttccaggtttatttctcttcccatctttgttaattcatatattaatttgtggtgcagataaattcatgtagattttactggagttaggtgattatacctagatttcatttttttttgcacttaaaaattatgtgcagtttgctctcagaaaaatggagaagatgggctcagcagaattttgtttgaattgttagaaggtctaaacagaagaaataaattctggaaaattatagttactcttgataattaacctagtatttgaataaattatttcccttatacacttcccacttccatgcagtttaatgcatattttggtgagttaagattttagccaattaaggtttataattagtctattattagactcgtttgactgatttatttgaggtattagcttaagtgataaattctgaccaaaatttcagtgtgttgtacacattggatagtattcatgtgaatttttccaagatttaattatgtataaatatttttttagtaattgatctagtctatcctttatatgtattttcatctcgaaatgcatttgagcatttatagattttatatttgaacacttctttacctaaggtgatattattaaacttagtttcatacccaacatgcacacaaggactcaaacctaaccatgatctatatgcatatgcatgcttacactttgttactcaaattccattttggtttggaaaggaaaagttttaactagccccaaaattccctatatgcaaaagttgggttgacctacntaggtttaaaatgaaaattttaagctcgcaaaaataaaaaatttatcttccaacaattttgacaaggaattttaaaccctagaatttaggtatgttacagtcctgcaacgggcctactattcgatctgttcacctcgaaggcagatgattattatcagtggtgtatttatgagtattattactcgtaacaaaactaaaaggatactccctccatcccaaaatttgtatgacagtgacgttttttcatataacgtttgaccattcatcatattaaaaaattgatataaatatcatttattttattgtggtttgttttattatcaaagaaattataatcttaatttacacttttgcatatttatactaaactttaaataaaacgaatgggcaaacgttatgcgaaaagtcaacggtgtcatttttttgttgggaaggagggagtatatagtattagtggtaggatctctttgatctaaaaaaaaaatagtgtatgaactcgcccagttggagtacagcccactgcccacaagttcatttcatgaaagttataaaagtcaaccaaattcagcagtgtttaatctttcggtttagtcatttatatcaaggtggccgaaataccaaaatttctaaaatttcggtccaaaattatatgaatttttaaataaaatttgattaaatttgaaaaaaatattacctaattcatgaaaaaaatttaaaaatttcggccgaaataatatcatatcgaaattttgaaccctgaaatgcaggccttctggaggggtagatagttgacctttatgccgacgactctgcaagctgcaacgaccgcttctacctgcaatatgattgatgctatatagtttcttccccggctg

SEQ ID NO: 60252 - DNA, 1326 bp, Oryza sativa
tccctgggacctaaccaacctcatggatgcacatgcatggcttcacatcgaatggaatgagttgacgtcgtctcgccgaagctcggagccgccactgagacgttttcttgatcgctgccatcaaccaagccccatggcctttgctcggcctcgccctgtccaacaccgtcgtcgccaacttgttccaccgcatccccgacaggtcgacgcccttgtcagcaacgacgatgaccacctcgctgcgctcgaccatctccaccggcggcacaaaacgaagaaggagagaaagaaagagaagagatggaccttccattggccccaagggcatttatgtctaatcaccataaagaagaggcaaaatgattttggaattaagagaaaatgagaaaatggcaatccggcgagttgtgtggccttgatattggcattttatcggatcacgttttaaagatggcattctagcgaaaccgtgttttgaagatggctaaatgtccattttctcgatgagggatccctcgcccacttcggtaatgatgggcaacagaccgcctgatccgatccccggccggccgccggcggctgcttcagagagatcccccgaggcatgcgcgtgctggcaggatcacagccgcaactggcgctcgcccgcgccgcagccacaatcacccgacgaccgccattgctgcctttgaggtaaaggcaaaaccttgtttaccctcgccgctctcctctcccaatttcggtttttgcgcagatgaaagctttatgcacagtatagtgtcaaacttaaaattttgactaaacgacttatcatactctttttatattagaagaagacaaggatggtagcagtgaatctgtcaccactcaccaagtatagttgttttttttatttaccacctactttatcatattttctaccaactatccatgtactttaatgttataaaataattcctctaaatatatgattctatcatatttcacctgtacaatatagcacacatgggtacaaaattatcccaaaaatatcactattaatttgttttaatctattgcaaagcaggagtatttggctagtaatatgaaatagagggagtaacttactccgttgcattgtaggttctttttatcatcacttcatttagttcgactccgttgttgtatgttttttatgaacggcgtatatgtcatgctcacctagttaaatgtcatggagtgcttgctacatgtaactcaacatgcctgtaattttatatggcagcacaaagcaaataagattgagagagtgcattttagttagtcttaggaatataatggttaagg

SEQ ID NO: 60253 - DNA, 1248 bp, Oryza sativa
ctggttttgagcatgctctgcatataaaactaagagtgcctttagatggactaaattcctttttattttatacctttgagaaatttttcacttcatgaatatttcatgttgtatcattacggtatcaggccaacaatgaaacattaatgctgtatgattgatctctttagccatgttggtcacttggcacttggcagaggccgagggaacgatgcaattgatgcttgtacagcattatttgaatgttgcatttttacatgtactgttttgatgaaactgaacgtgaattgattattttgaaaatttgacagtatttattattgattaaatgattctgaactttgtcatacattatttttttcagtccatacagtaaacttgaatctgcattttggattgtgaattactgtattgttatggaaaacaatggattatagttcatataatgtattaattataatcctaattctgaacatttaccagattaatatgggctacgttggacttgtatctttgttctgttatggaaaacaatggattatagttcatatcccgcctctaaatttataatcctaattctgaacatttaccaaattaatatgggctacgttgtaatctttcataaccttggacagccatgttttgctctggagtttatcgttatctcctgagttcattgtctaacacatcttgcaatgttttccatcagtatattaatagtctgcaatgtcatttattcattctgaacctcacgctacaaaagctaccttcaccgtcagtttgtcaccaccacctctgtgtcaattccggaaagacttgtagaagctgacctgaactgtaattgtgtgaaggtctcgatagtcctgtaccatggatgaggaggatgtagactgccattggtgcggtgaaggggctcgccttccttcactacgccgacacaccggtcatctagcgtcttcaaggcatccaacatcctccttgactcggtgagcagcaggccgttcttgatttcactgtgttcttttcgccatcatttcactcaaaagtgcagtagaaatttttcagtcgttcaacaaaagaaactctcattgattcacaatcaagtgtatgtattacttacgtccatgatcatcccttcctagaaacaatcaagttatattgaatgggttgttagtaccatcaagatctagagatcgattgaaacaattgagaactggaatcgctaaaatcaatgagagttcttatgat

SEQ ID NO: 60254 - DNA, 2917 bp, Oryza sativa
agggcgagccatgtctgtcaacaaaattatattgcaaatttattaggattttaaataggtcaagatcaagtactaactatactttatcaaggtaccatgctcatgaggaaaaaaaatgcacaagcagcacaaacaacaaaaaaaacatagcgaaatgacacagtatcacacgtcagcacatcagaaaaaaaatacggaaggaaaagaaaagttgtttctaagtacagtacctcctccacatgattatcttcaacatcctgtccaaatattggagtagcacttacaccttattcaagatgcttaatataaatttccattgacttgcctttctttgcaaaattcaacattttacgaactgaatgatcatcatgaagtttgtcgattccattttcaagactataaccagggatagcatagaatagttcatctccacccttgaaacctacatctttagccatgtctactagacaaaagtatgacatcctttcgctgtcacaattgcgaaaaatagagacttggcctccaacatagcaaagttgaccctcctttgaaaaagatcccccatgatgaattttgatactgatcatatccccctccattctgtatgtatcacgtatgaaattgacgaatacactatgtgtcattctatagcagattaaatgcctactaccattaatactaaaatatgaaatcgaattgatctatattggaaaatctataaaggcaatcgactgatgaaaaaaaaattaagaacaggtctactctatacactgggaaaatgcctactaccattaatactaaaataccaaatctgattgatctgtcttggaaaatcaaacaaggcaatcgactgatgaaaaaaaaatagagaacagaataacatcagtacctacagcttttggtgtgataaactgcagagcaaaactacaaaaaaatcagccttgagcaacaacagacgtagaagtacgaacagcagatcagaaccaccttttccccccccccccccaccttttccccttacaaagctgcttccatcgatctgtacaggagaaagacacaaatttctcagtcatgtactgcagaaagatggggaaagagagaatccagacctcatgaggctgtggtctcgatctgtacaggagagagggagaaagagggagagttttcaagaacacaacaaacttgcgtcagaacctaaccttggctgtggtttcgcgtgtgaatggggagaatcgctggtgatatttcacaggatttattgcttctcgtggtggccaacggagtgggcgaggaaagtggcgctgagatggggatttttcgcgcgttttactcctcctcgcggcagtgaacaggatttttcgcgcgtttttattccttttcgcggcaatggacggcggagtgtgcgggagaggggtatttcggacttctgctgtttaattcccaccaagtctcgtgaattaacaggtccccagggatgggatcggtgggagttggatagattaattctctatgccagtccctctaaaattcccaagtcctctaatcaaactagagattaaaaagctcaatctcctaaactcccatttccttattcaaaactccctccaaccaaacaagccgttagaggacttttaagatacattctacttgaagtatatactaccaatatatttgatctaacggtgtaaattcatctgatctttctcccaattattctgcagtataaattgaatggggcatatttgtcttttttatctatttgcgtgggggtaattttgtaaattcgtgtttctcacttagtcagatctggcctttaggtgcacaggcaaagcgaatttttctcgaagccgcgcgtgggcgaccactgtcgctgactgcctctgcgagcacgccgcgccgcaccgccgtcgacaaccacaaccggcgtcgctgccatcgggaatcgattcaatttccctccccctttcctcacccaaaacctagttcttccgaaaatccccaattcgtcaggtttgcgggaggcggcgccggcgggctgcgaaaggcggtggccacgagcagttcgtcttcaacgggttcactggcgcgaatctcagctttgatggcatggcgacgttaacgcgaccaaccacctcttcgtcgttgagttcgacaccatcctcaactcggagttcaatgacatacgccctgtctgcgggaggcggcgggcaggcggagctacagaagggcgccgggaagaaggcgtgcagctgcggcagctcgcagcggcaagggcagcccggcggcggcaggtggcagcggcagggcggcataattagcataactaatgtataattagcatggttatatgccaatataactaatgtatgaacagttctgtgactactatccattcaactcccacgttccagtcttccagagaaggccgtgaaagaagaatgttcagactccaaaaccattaacatcgtttcgaactttatacgatataaaccatgtttagactccaaaaccatcaaccctcgccgccgtggtttggggaagacagaagctgtgggaggtcggataagggggagaacaggctagggctagagacaaggcaccggggatgcggaacggcggaagacgccgggcgcatggaagatcggcttctcccggcgccggaggtaatatcgggatggaggcgctgggccggggcgggagcgaggtgcgccgggagcttccgtcgccggggacgccggatgaaatgaaaagaagcgctacacgcggatgacgatatccacaacagaaaaaaaaccacgggaaagtttatcactattcatgattaaaaaaaccaaaataatctctattttaaatgactaaacaacccttttcagatttttaacaaataccgaacctaccctattatatagggctgcag

SEQ ID NO: 60255 - DNA, 752 bp, Oryza sativa
tacatttaggtcacattaattgggaacttgtattaacttcctatatcacaattgtggagctatcagctactggcagacttggcactggtaatttgctcggactgcatcgcagacttattatacattgacttgcagttgcagggatcatgaagattttgcaggtttgtcaagacagctcgaaggcatcgtactaccttgtccattgctggcctctccgtcaccttggatgcaagacaccaagaagcaagtttcttaatttccttaagatgatggcatctagcaggaatgccatcaagttctttgagcaccatgtttacgtcatgcatttgcaccatgttctgtgcgaagagctccacaagaaccacgccaaaaccatatacatcatattccttagccatgagcccagtcttgaggaagtgtggatccttgtaatggatgttctctgttagaaatatttcatgcttggccttatccaaggaaaggagcctttgtgttccataacctgcaatctttgccataaatgcagttatcccaggcatttcgagcttagatttagaataaacatccagtacacattggcagttctgacatcgccgtgaaccacattaagtgagtgcaggtgagcaaggccttctgcagcaccaactgcaatctctagacgtatttcgcaagagaaaggacaatcaaactgctgccacgcgttaccgaaaagagcatcatgcaagcctatgtcaccatacttagggctgcag

SEQ ID NO: 60256 - DNA, 1473 bp, Oryza sativa
  unsure (1)..(1473): unsure at all n locations
agaagatgtggttatatttgtgcctgaaaattcgtgaagatggtgcattattcaaagcactgtatttattattagtctgtactttataatgtgcaaagccaataaaatgcatggaatacttttctgaggaagtcatgtgtacaatctacagcttatcttaatttacctgaanattaagataacaacaacaattcaatgttaatttgaagaaacaaatgtcgcaagatagctaatcttagcatgttgtcacaaaaatatatacgttagaaattatttatggcagtacacatctaaaaaattccttatatatgaaagaatgatggctttatatgcataaacattcctctcacagttggcctctgttttaggattgtagtaccctttttcattattctcccaataattatacgtatgcacatggcaaatatttttcatgttcttgtaaaccaaattttcttgctttagaaaacatgcgagaacggtcccgaaacagcactggacatcaagatgaaggaaaatacgcaaagggaggtgcaaaatctgattgatcatcacagaaacagagcagtggaacctgaatctgctggactcctgaatcaaaagataatacttggagggtaacggtttggaggatggaacccccaaattgattatagttactcacaagcgtactagtgctctatactgctgaactgaaaggaactaggactccctccgtccctaaatatttaacgccgttgacttttttaaatatgtttgaccgttcgtcttattcaaaaaattttataaaatatataaaactatatgtatacataaaagtatattttacaatgaatcaaataataggaaaagaattaaaaaatacttaaattttttgaataagacgaacggtcaaacatgattaaaaaagtcaatggcgtcaaaacattttgggacagagggagtatttgataacaagttctttttggtggagtgttcggcatgctaatgggacagtgcatagttgttttcatccattcgcattgttatgctagaaaggtttctgatgtaaagagagggatttcagatttttcttttccttcaattttgatgtgctggagtagttcttagaaaaaaaaagagatttggggcacggatttcagatttagaacaattttatgatccttgaggaggtatcatgaggtaccaaaaatttagtataaaatttggtacctaggtactatgagataccaaatttacagtagaaaaagtggtacctcctcaaagaccgtaaaaatgctctcagatttatcttttccttccttgaattttgatgtgctagctctgaaaaaagggaattgggtagaccccgggagtctcctcaatgtgctagttctgaataatgaattaagatgctatctgttagtagtaacaactaacaagtttggagaagattgtcgttgtgctatgaataataatacattaatactccac

SEQ ID NO: 60257 - DNA, 5532 bp, Oryza sativa
ctttcaaatttcaacaatcagttaacctcaagactgagcgtttcctaaagctccagacgcatccacattggacattgtactctatcgtgttttcgcaaaaccaaatggtggggaaattgaactgaaatcgaaccctggcgacctgcagtgattgtgcgaatttccatgcgcctgtggtacatcttatcttaatcattgtaatgcgccattccatcatgtaaaaaatagcatgatctagttctctaaagaaattaacatgatctcgctcttccgtcatcatgtaaaactgctaatacatcaaaaatcaagctgcaacaacaaggtagtagaagagagtagtgcagatgggagaaagagtagggggacaaagaagtagggcgtacgcggtggttgggagacgccggggggttcgtggccagtcaactcaaagcatctctcttttttttaaaaaaatactgcagcttccttaggccaattacatacttattctatatatatatatatatttgatctagaattagataagataagattgtggaagaactcagggaccttgacccattaccattcctatagatgctactccctccgtttacttttgatatgcatatttctaaattaaaaaaattatttttgataggcatatttgaatccaaccacatatactcttaaggactttctcggatttaatgcgtgactctccattcttccatgcaagattggctacatgggcatcgtgtaaatattaatgaatcgtttgtttacgagaaataactagtactccctccgtctacttttgatagacatattttatcttggcacaatgaacaagggtaagtaattctacttatcatccatttaaacatgtcattagttattcctcgtaaaaaaaacaattcattaatatttatatttctcgatgcccatgtagccaatcttgtgtggaagaatggagattcacgcattaaatccgagaaagtcattaagatgataagtggttcaattgaaatatgtctatcaaaaatattttttttagatttagaaatatgtctatcaaaagtagacggagagagtagcatgtttaaatggatgataagtagaattacttattcttggtcattgtgctaagatgaaatatgcctattaaaagtagacggagggagtagtagagatagagatagagatagaaatagagatattagttattactacttaaaaaatttataatggtattggtgacactaacgtgatagacacgcgtgatattaatgatacgatcgcgacatccagtgctccacatcgatcccttcacgcccctcatggcctcgctcctccgcccaccgccccacgcccttcgctcagatctcaaccccaccaccccgccctgcgtctcctccacctccacgccaccctaatcctctctccctctcgtcgtttcacacgttgccgacgatctcccccgccagaacgtcatcgtgcccgcactcccgctcctcgtccatcacgtgttcgccccaatcgtcgtgcccgacctcgccctcccacgccacctcaccctcgccgccgatccaccgcctcacctcccgtctccatccaccccctaaatcccgtcctcccaccactcccatcccagggcggcctcccatcttcggttccccttctctgtgaccgtgtccagccacattcgttgacagccacggagggatggagctccggcgatggcggacatcaggaaaaacgtggcgacggactgcttagggaggcagccgagccgacggtggagaggaccggtttcggtgcacagctgcagtcgcagccacccccacgttgcgcgtcgcatcaggaggaggaaccagggccacccctcggcacctcaagcaccgccattgagctcgactcccacggtgcgcgccgctgcatcgggtgtaggaggtgctggtgattcgcgtgaacgcaagggcagcagtggcggtgcgctgcttggacgcccccatggccccgcccgctctcctcgtggtgacagtgccgaccgatagaagatccagggctttgacttcatctacacaatggatgaccttgccgtctccagggagaaatggacatttggccactttcaaaaagcgatttcgccggaatgctattccgaaaacatgtttcgctaaaatgccaatatgaagcgcgtgatcacagtcactttaccattttctccatttttgtcattttcaaatccattttcactggaattcggcttgatgagactaaattgcccctccttgtcggttgaaaggggatcgagatcgagcatggcgaggtggtcaccgttgctgacgagggcgtcgacggtggtgtgagatggggcaagaccgagcttgccggccgagcaacgcgagcgcccccatggccgtcttcatgggcgctgggacaccgccgcgccgtgtggagcaccgcctccttgcgcgccgcctctgcctccgtgaccacccagcacctccacctctgcctcctctaaccggtgccgccccggcacctcctcgccgcaccggccttctctccccatccacccgacgccgcctggccgcccttaggccgccgccgcgctgggccaaccgccatcgccttggtcgggtcgtcggccgtgccgccgcacccagcctcgccactgcaccagctgcgcctcctcgctagctaagaaggaagagagaaaaggggaacaggaagagaaaccgaggggaagaggagaagaaaagagaagcgcccccgtggcgaccgcagtgtgggtgtcgagccagcgtaggacgagacacaactggtcgtccgggaggttgctgatgcggtcctcgccgccgctgccgcaggtcccggcgcgaccgacgacgatgacagttggtggcagttgtcggcggggtggctgttcagttggcggcgagcacaggtggtggcggcgtggggtgtggcggggagcggcgaggttgaggaatggggagaggtggcgcaccggccggtagagtagttgtgggcagcaacggcgtcgccgccccttctctctgtctccttgcctattctgtctcatctttcaccgtgttctctgagttgataaggggcaattttgtctcatcacctagtagaggagagaaaatcttttcgaaaatgaataaaatggcaaaaatggcaaagtggcggtagacgcacgctctatattggcattttatcgaatcatgtttttgagatggcattctagcgaaaccgcgttttgaacatggcgaaatgtccattttctcgtctctaggagtccaggtgtggtggttcccctcctgtttcctcctcttctctaaccaaattttacctgctgttggtggtgtatggcgtttgattaggggggatgagtggttgatcttgattaaggggaccataatattttcctgttgttctcaacgtttgatttattcacatcaaaggagcaaccaagacatgattgtgtggcatttctgaatctgatactactgtgctacttttacttttagttaatctggcttgttctccagcatgttgtcaattataaggttttaattggctaataagaaaaaattgccaaccccatctatttcagtttattcttttttgtcatagctaaagtttgaattttaaagcaatctttttttccctaatagctaaagtttgaacgttcaagcgatccaatcaaacattcacatctggaaattattttggtgctacaggtttgctgagaacaatttagcaaatcacatcaatgtacagtcatgggtgtattttctaatcaacttactatgttaggtgtacaatggtaaagtggtctgtggagaggaggaatcataccatgggagttcaagaggatacacataagtaacatttttattgataaatgtatttcgatatctccaaagaatctgaaagtagttctttacaacatgtgaaatgaaaccatataagctgaaagttatagaaacctgtgcacgttggtcgcatctaaccaattaactactagactactagaggcatcgtgcggtacccataaatcttttcaatcaacttgtcctaggattgtttgattttctaatgaaagatccagtggaaaagaaccgctatacctgtgacacggcaatattaggagttttttttttttttgacaaataagaggacccagttacctgttactgctagcagaccagccctgctgtatttttttctccactaacaattttgatgtaatgtacatttgataacttgatatactatattcatataatgttcaaaggggatttgacagatttaataacttgctacctaccttgacgataaaacagagcagtgagcacacttctctgcatcatattccaggcaccagaatttggcacctgtcaaacgagtgaaatcggtgaatagatgatttatgcagcttacatcgaatcagtttgggtctatgccaaatggatgagatgtagtatgtagttttttttatattgatattaatctctattctctactacttaaaaaataagagttgcttctgtcgtctgtcgaaaaaaaccgggcgaaaaaaaatctgtccgatccaaaacaaaacgggaaaaaaaccgaacgaaaataaccgggcataaaaagaaaagaacgtccgatcaaaaaagggggaaaaaaaagaaaagaacgtccgatcaaaaaaggggcaaaaaaaaagggaaaaaaaaaaggaatccgattccacggtaaaaaaaaggcgaaagaaataaaaaaggaatctgtccgattcctaaaaaacgggcgaaaaaaaaacaggtgacaaaaaagatcggcgagaaaaaaacgaatccgcgtggacgtggtaaaaaaagagcaaaaaaaattaaaaaaacaaatctgtcggaataaaaaaaaattatatgtgacgcggtaaaaaaaaatcgaatcatattatatttgacacggtactatatatctctatcttctctatctctactacttatatatatatataaattaaaaaataagaggtgcttccatcgtccgtcaataaaaccaggcgaaaaaaatctgtcagatccaaaacaaaacgggaaaaaaaccgaatgaaaaaaaaccgggcgaaaaaaagaaaagaatgtccgatcaaaaaacgggcgaaaaaagggaaaagaaaaacgaatcccattccacggtaaaaaaaaggcgaaagaaataaaaaaggaatatgtccgattcctaaaaaaagggtgaaaaaaaccaggtgaaaaaaaagatcggccagagaaaaacgaatccgcgtggacgtggtaaaaaaagagcaaaaaaaaaattaaaaaaacaaatctgtcggattcaaaaaaagaagaattatatgtgacgcggaaaaaaaaaaatcgaatcctattatatttgacacggtactatatatctctatcttctctatctctactacttaaaaaaaattaaaaatgtttccgttgtccgtaataacgaaaaaatagcgaaaaaaacattaaaacaaaaaaaaagatcgat

SEQ ID NO: 60258 - DNA, 1406 bp, Oryza sativa
atcggacttgaagcccctgagctcaccggagctttccgggaagcggcaccgccgcaccttcacctcctcgcagtcgtgtccctgcgcacgcactgtcctggtgcacccctccaccgtcctttgctgaagacgggaagcggcttggcgtcacccctaccgccgacgaggtccaggccgctcggcgctcgtccccagagagaaatggaatcaggagagagggatttggggacgattggagccgtccattagattggacggctcagatttgcctagcgttgggccgacgctgctattgattacgctgcgcccaatgggccgcggaagtgcatcggaccgtccccgcatatgtgggccgtgctcagccgatcagcttaagggccgtcgaattgactcaactcgccgatgatgggccagcccaagtttgggcctgcttgggaagacctgggccaaaagtaaatttgatcaaacaatatggctcacatttttcaaattaaagtccgtcggataaactcttaagtaggctcgaaaaataaatctaaaactaaatcctaaatcctatgctaattgatcaaattagactcggttctacctatttgttaatatatatcaaattagacttgatttttacaaatttgaggttttcaaggtgtcacacaaaaagtacgacttcatcaacacctatatatatttttttatccttagatatattcatccaacggcttatacgaagtgttggatcctcccagcaccaccccgctgcctctccctcgccgcctcgcgccgttgccggatccccgctgtcagggcgccgtcgatatatcgtcatctagtctccgtcgagccgcttcgcccttgtgtctgcatcgcacctcgccgtcgatcccacgcagtccggccatcgtcgatccccgcattagcctcgcgccggcaccggatctcctgctgtccggtcgccgtcgatccctcgatgtccggtgtccactgcgccgccaccgcgattcctcgctgccccccctacgcaaactcatccggatcacgtctccctcgctgctcctgtctaagacaaaggtgaatttatgttgagttccagccggacaattgtttggcctgcagtatgaagcttgtggagcagtaaatctgccagcgggtaggtaggagcagggtctcattgagttgctcccggccaggactgcgaagctgttgattcattgtcgtgtcatgctgagataaaggctttatctaattttggtacattctcacatattattataccatggaatcaaaatataccaaggtaagagttttcagccttgaaaattcacatgtgcattgtttcaggttcatatatctgacccaattagtgcccttgccaaattcagttccagaacaacatgcaagtcccaata

SEQ ID NO: 60259 - DNA, 8203 bp, Oryza sativa
  unsure (1)..(8203): unsure at all n locations
tagtactctaaaaagttgggcaggatggtttggtcaaaattattatcacttatggaatggaatgtgaatgttagcctcaggatgactgatgacaaggattttagcaaaattattctcaaatgtagactactggtaaaatacatttttagttcatattttgcatttcccatgcataatactcagcaaatatataactgtcaaattatagctgcatgttatagaaaattatgcctcacgaatttcttgtgtcttatatgcaaaaaaggaaaatgaaccccccatggcttgtaagttttaacatctagaatgcagtaattacaacattttgaggaatcatgcacttggagtagcaatctgaaaaaacaaattcttccattaaatttgtttaaatgttatttatacttctacaattcttccagtatgaccatcaattcaaaaagttgatttattcctcaattacatcactttcagggtcataagcagtggctggctgaagttcagttccttgctgttgtggatcacccaaatcttgtcaaactcattggctactgcgggactgacgacggcgaacaaggtcctcagagacttcttgtgtatgagtttatgcctaacaagaccctagaatatcacttgttcaataaagcatacccaacacttccatggaaaacaaggcttagcatagccttgggcgttgctaaggggctgcagtacttgcatgaagggttggaaattcaggtattggtctaacaacttcgataatcgatatattgagtattgtcagttacaagttcagagaacaatgtaaatagcagtgctctttttttcctcctcttttcttctgctttttctgctgttttctttaatccttactattagttgttattagaagcttagggctctagagctatgttacattagtaaacaaataatacagctgtttcccattaatgctatctcaaaacccaagtgctcagagttaagtgacaactcccagttgttccagttttgcaatgatagtctcatagggatatgtatcaggagctatgattcagaaggctttctgatctataattctatacttgttagcgcaaattaacagagttttccagtgtttatattctgaactattgatgcttgtgttcacatgttgtagagttgtagacttgtagttatgacactctttatgttacaggtcatatatcgcgacttaaaatcatcaaacgtgctgttagatgaggaattcagaccaaaactttcagattttggattagcaagggagggcccagtggatggacaaactcacgtgtccacagcggtaagtcatttgtcatcagtactagcaagatggttaccatttaccttaagaactacttgcattcaatctgcacaaaaaaaaaagtagaattacagtattttcttgaataatttcatggttggttcgaatcgggcatcaaaacggtctagaaagtttggtaggcggccaaaccatcgtttcaggcatttgtcctgacatataatctgttttcacctggagagatgtgttttcacaaaaagattcatgcagttcaacgaatgcgaaacttccaccctttcaacaaaaataagctaaccaatgcaacccctagaaatttaagatctgagagttggcggtccaatttagttcaaagttcaaactaatggctaaacttttgcaaaaaaaataaaataaaattcgatcggagactaatggctactccctccgtttcataatgtaagtcattctagcatttctcatattcatagtgatgttaatgaatctagacatatacatctatctagattcatcaacatcaatataaatgtgggaaatgctagaatgacttacattgtgaaacggaggaagtacaattttaacattgggtgttatggttatcaaaagattggtacattagaaatcaattttagtgcgaagtaggacaggaataataggattattatgtattaatctgagcaatgcaagcatgaacaatcaacaacaacgtgtgatgtgtatgaaacgggcataaaatcaaacaggtgatgggcacgtacgggtacgcggcgccggactacgtggagacgggccgcctcacggcgaggagcgacgtctggagcttcggcgtcgtgctgctcgagctcctcaccggccaccgcgccttcgaccggagccggccacgccccgaccagaagctcgtcgactgggcgcgccgccaccccgcgggcacccggtggttctcgaggctccccgacccgcgactcgcggggaggtactcgcaccgcgccgcgcaggacgtcgcggcgctcgcgtggaggtgcctcgccgaccgcgccggggagcgcccgtccatggcggaggcggcgcgggccctggagcgcgcggcgcggcacggcgagctggatggtccccccgagccgccggaggagggatcgcccccgcctcctcgctgccacgccggctccggttcctcctccccggaggcgaagaaggcagcgacggcgaagcggcggcgaatggcgcacctggccaagctggcggctggcgcgagcgcggcgccggcggcgcggaggctggtgcacatgaagatgacgaaggcagcagctacatgcaacgcaggcacgcagcatggtgagacttgagacctccctgtgttcaaagttcaaacgcactactattctatcatgtaatctactcctcctattctatattacttcctccgtttcacaatgtaaatcattctaacatttttcacattcatattgatgtgctagaatttctcacgttcatattgatgtgaaacggagggaggataagttatttgattttcttttgttaaatttctttaaatttgatcaatttataaaaaaaatatagtagtatttacaaaacaaacatattatcaaaatatattcaatattagatttaatgaaactaatttgatatattagataaaaaaatatttttataacttggtcaaactaaataaagtttaactagaaaaaaaatcaaacaatttataatacgaaatgaaatggaaagagtactaatttttgggataattacgacctgattttgtttcgatgacttgctctcgcctgttctactaccattgcaagcctgtgctgtgcatatcatttttttttcaaaaaataagtgttttggtttctcttaagtacggcattgggatattcttcatttgaaaaacagcagcaatttctgatttcttaacatcaccacatagtttgaacacaggatgtgtaccgtaccaaaagtggattttaatcttgacgactacactctccacataagagaattcatcagaagctagaaacagaacggcttttgtgttttgtcatttgatccaagcgtaaactcaggatggaaaactggaaccagaaaacttcgactttgtaggctcggagaaaaatattcactattacaaaaatccatgcaggagtcaagttaaaagaagaaacagggttctgtctttgagatggagtataatttatttaagatcattccctccatcccatcatccatgagtttgcaaacttcagctcacattctaaaaatgaagatgcaaaagagagagagggacagcaacttaaaaacgtattgatcaaccagccaaagcggcattgagcgcactgtgaacatccactccaatctgagcttcggccttctccagttcagttgaggccgatccaagcttggcgttgaattccgcgagaccctgctggaccgcggctgggtcgatctggtccagggggacagcctcaacagccacgatatcagcgatggagtttgcatggacaaatgcaaagccactgctcacaaagtacttggtgatatcgtttccctcgtgtaccgagagaacaccaggcttgagctctgcgattgtggaaacgtggcctggcaaaacacccatctgaccagttgttgctggtacaattaccatgtcaacctgagtatagacaagcaaagacataagcaagggaaagaagcaacagaagacaatattgatgatgggggaagaattaattggtacattaacagtagtattgttgaatcaagcattgacatacaaaatctatgtgaatcaactgatagataatttgcctatcatctgttgaaatgcaacaacacaaacatagacaaccttcgaacaccatcaaccaattatatttcatacacaatagcaacaaaagaacatgacgctcagcaacatacttaaggaaaaattgatgatctgaaacttcttaatagtgccattaaccattaagtaaacagtaccaaaccatcaaggccaacaagcaagctaaaggaaacaacatgaaacaaagaaaatcaccacaaaactaaacaagtagtattagacttggttatcacagggcaaataacatatatcaaggacaaaagctataattggcgcacagtcaaaaaagaagctgcctatgcagcatagtaaaatataagtgaatagtaggctatattaatatgcagttttatttatagaacttcagaaggaaagattttctcaaccaaagaaatttacatcaggaacattgacagtgaatgttcagacacaaactctagttaatgtaaacaagagaaactgcaactataccgataaatccagacaatgcataaagccgcatagcactacaaacactagagataaacaggtctgaatacactgttgtagtcagaattaaaacttggcctggcacacagcaatcctagcaagagaaacttgaaatctataaataagaaacacccaaggagcgacctggaatcctcaatctgattaacaaaatgtaacggggtttccaaaagatacttcactagactactactacctctgtccccaaggagcggaccgtgtttattgaagattttgtttggttggttgtatgaatcacgaatttagccaggttcatagctaactaaaaacacagtcttttaaggcgaggaaatatcaatttatgaattctctatgctccttgcaattaaggcacacaagcaccccaaacaagaaaaaagaaatgcaatttgctaccaacactcaacagcaatcaaatgttgagcagaaattctatagtcatatgacatctagccacctggagaatcacgctacgttatgtttgtcccatgaaagaacatctccaactcatagcaacaaaacaaggaaatacctggtatgattcaacagccatgtacaaccgtaaaccgccacacattcgtgttaataggattgcaaatacgcacgcccaacaaatggccacatcacaaacattctgggcaaacgataaacggaggatagaagcattgaccatgatatattcctacggatgaagagtctggatgcgagacctctaccacaccagctcgacgaatcggatcgcgctgccttgacccacccaacccctatccctaatcgcacgacgcaaaccccagatcgcgcacatacccgaaaccctagcgacgccacacgcacagatctggggaccgaggaggacagaggagagggggaggggggggggggcaaacacggtccgcgcgtacctccttgttggcgatctcggacttgtaggggaggacgaagttgacggtgagcttgggaggggatggccgccggcgtgggggggcggggctgcatgagcgacatgggcgtggcgggggcctcgatgttgggggccaccttcttccacgcctccgcgaaggcggagtcggtggccgcctcggccggcacctccgccgtcgagagcgccctgctgctgcggccggcggcggcggcggcgcgggtggtggccaggcggcgggcggcgtggcgcagcatttttctctttcttctttttctctctctcgtttctcctctcgtcgctgcggctgcgcgtgggtgggtggaatggggttccaggggtgtgggcgatttggagggcgaggtgaggtgaggagtgtgggtcagtgggagtggaggcgagtttgggctgggccgtttctatatttaggctaggtcgcctgccttcttttcatatcatttaggaataagttcacttgaggtcccttaactgatcaacgaatccgattttggtccttcaaccaaaaaaatagatataacggatcccacaactgtcaaaaccggcgcaatataggtcccatggcggtttggacggtggttttcgctgccatgtcgcttacatggctagtttgactcggtctttattctacgtggcattgccatgacaatttgatctgggaaataataaaaaccgtggacccatatgtcagctataataaaaataataattaaaaatggtgaggcccacgtgtcattctcactccctcctcttctctctcccggtcgttcttcttcctcctctgtcatctcttcatcatgtggaaagagagagagaaaggagcgaatgagaacacatttccatatcaaattgccactttaaacgtcacgtggatgctatatgggataaagatcaagtcaaactagccatgccagctaaaaccaccgttcaaaccattatgggacctatgttgcaccgggtatatggtttccggttgaaaggtgaaaatcagattcgttaacaagttaagggtctcaagtgaacttattcatattgtttattggattttttaaaatggattatttactccgcgtttctaagaatatgctttctaaaaaaagaatttttattggattgcttagaacaccttgttaaagttatttattaaaatgtttaatttatccatataatcaagtagataatccacagcacacatagttcttatatgttaaatggctactttttttcatgcttaatggacgaagcgttttgacaattattagaggatacaaacaaatgaattatctattatcaactcgaaaaatggatttaaaatggtattctaggaagttcatatataaaaatattttacaaaaattacatcggaaaacatgccaccgttccattcttctcctcttctaaattaaaaaaaaaaactcatttcttccttaaacattttctcattttttccggtaaagaaatatatttttttaatttatttatgggttataatacaaagcagaggtttgcaatgaggatgatcgcattctttctgaaccagactacacaaatagccacgttttggatgggaacaatcacaagttcatggcaaaatgatagtgcacccagaaagcatagacacatcataattgattatatttagcataagagcaaccaagctaggtatttcggaaagacacgatctacagaatgcacctgcttacatcaacctggtactagataaatactgtgacatagccatagtcctgcatttaactaaaattacaaagaaccaactgatcaatccaactatcctttgggttttataaacacagcacctgcagaaatccccaacaatgatgtcagccctaaagttaagaaagaagccaaaccaattacccgtgcttccaaagaggcaccgaatcaaataatgaacacaccaacagtaaagaaattgatatgtggaaacttagcatcagtttttaacgtgcaaagtcaaatgcaatatatgcttaaagcctaaaaactattagaagtaaaatatttcttgtaattgagcagctgatggacagctatgctcaactaaaaggaaaaacttcctaaaattagtattcatagcaatatggcatccttcaacatgtgagcgtttttaggtaaaagttggaatcattaagcacgaacatcaactgtgttattgaaacatttttcctgtttttgctctattatctgcacatatttaggaaatagagagtttccaggacttatgtcatatgactatattaaaaagaatatcacaattagaatatctgcctcaacttcataactgtgtcctctagaaccacagcaactagttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60260 - DNA, 703 bp, Oryza sativa
actaggctaggctgcaagaactagcagtcgtacatgggttttttttttagtaaaggtgccgtatacgttgtagatgctatatgtaattcaagcaacatgtgtattttatatcctgacaaaaaaaaacaatgactcttgcttcttctcaggtttggtggctctttcttgtttctaattcttattcagtgcatttgtctttttttttaagataatggagtataattcagtgcatttgtctacatctggccctttggcctttctttcttgtggccgattttgctcggtcaaatttttgtgtaacagaagaaattaagccgcatcagtttactttggatgttgcttggattggtactgtttcttgttttcatgtttttttgtgaaactttatgtaggatcgaacataaataatcaagcctacgagggggggtgaatggtaaggaaaaccaaaaacccaaaaacttttagcggaaataaaagttaccctcaaatcgatggaaatctcgacgtagtcctgtcgccgccggtcggactgctcgtacgccgccggtctaaccgccgctttgtagccggttgaaccgtcggtatgtcaccggttagaccaccgaacccgataaaacacaaatcgaagaactcttaaaataaatgacaactttattgcttctctctgtgtttacaaagtgcaacaacatcactccttacaaaa

SEQ ID NO: 60261 - DNA, 3721 bp, Oryza sativa
gcggcgcggtgggggctagggttcgggaggggactaggggctagggttcagagataggggaatggggaatggggaatgcgtgcgcagccgcggtgaggggaggagggggcgcgtgttttgtagccagcgagcgcggcttcggttactggtgctgacgccagtggcgctgtcgctgccccccacacagctgtcgtcgcgctccggggcagcgcgcgctggcggcgagcgcgggcgcgcgtggagcgcgaggaggggggagcaagcggcgcgcgggcaccgcgttgcgccgcgccgcgctggtgtggacgcgcgctacggcgcggcgcggcgcgcgtgacggctggaggagagagaagttgtgcagtgtgggctgccttcgacaagcgtgtcgggcctgcatgggccgtgatgatgggctgggtagtttttgcgtggggaaaagtatacctgaggtccctcctatggcggcattgactccggttttggccgacgtggtagctgacttaacgtgggacctacatgtcaatgacataaactcttctcattctccccgttctcacatcaggccggtgcagagcgacagatgccggcgtgacgaggcagccggtcgtagcaacggggagcggcggagaggcggcatgggaaagggtcgtcgaggtagataccggcacgggtagtcagccggtcgcggaggtggcgggggagaggcggcacaggaagagatcaccggggctggtcgctaggcaaagcagctcgggaggaggcggtggccacgcaacgaccagccaaccacactgatgtcgccgccaaactactcctccctcttgctcgtcgccgcccgatatccaacaccttaggccactcctcctcctccttgccgctacgagtagtgaccgatggagaggagctacacattggcggcggcagcgggcctctctacttcccctcctagatcttcgccccctcttctccggctccatcaagctctcgctgacggcacccctgcccagacatccttcgtgagcccaccgtcgttggggggatgggctcccgctttcctcgccattaccggtcaagcttagtgacgctgctgactcctagctcctctccaccggccaccgttcttctccttgctcgtcgtcaccaacaagcgtcgtcgctgtcagcgagggccaccgtcgggcaccgcgcgcctccagttctccccgcccgtcgccggtcgcgctcgccgcgctggcccttctcctcgtcgaccgttgcacacctcagatggagaggactggagaagagatgaagagaggtggagagagagaggaagggaagtagtcactaacatgtatggctcatatggggtccaatactgactcagctatcacgtcggtaaaaaccaaagacaaaatcacctaaagacctagagagcctagttttctaagttgagagatgctatatatctcgttttttggttcagggatgattttgtaattcagcgacaagacgagggaagtcaggtataacttttttccttttgcatgggattcgctgggtattgggccgggcctttctttggaacatggtggaggcctgcgcctatagggctgggccttgccttcagccacagttggttttgggccgggcctttctttggaacatggtggaggccagcgtctatagggctgggccttgccttcagccacagttgtcatcggagcgttggatgttgagccggccaagcaaaagcctgaaaaactaatggcaaattttgccacatgacatcgtgactttgtggttttagctgtaggacatcgcgcgaagtaattttttggggaaaacactctcaaaatgtggttatttgatggtggacaccgcacccattaaattaatgatttcggtgctgagtagacgagatggctccacttttttacatgacttaccaaattgccccttattcctctttctcttcctatcttcttcctctctctccctcgatggcgcggctcgcgatgaccgtgcggcgcaacgcggcacgcgatgcaggcgactggcgacgcgacagagggcggtgggtgatgcgatggcacactcgtctaggagcagcggccagcgcgaaggtggagcagcggctggcgcggcttgcggcgaccgtgcggcgtgatgcaggcggccggcgcgcgacgcagggacgcactcgtgcaggagcggcggtcggcgcgatggcggagcaacgaccggcgtggctgctcggcatagggcagcgggcgatgcgagcggccggtgaagggcattgggcgatacgagcagcccgcggcacagggcattaggcgcacttgtgcaggagcggcggctagcgcgaaggtggagtagtggacggcgcggctcgcggcaactgtgcggcgcgatgcgggcggccggcgatgcatcgcagggcagcgcgcgacgcggtggcgcactcgtgcaggagcggcggctggcgcgatggcggagcaacggctggcgtggctatgcggcaccaggtacagcagaagaaggccgccgccgccgccgtacacgactgccgccgccgccgtacacgactgccaccgccccgcccccacgcccagctcttctctgctccgctccctgaccccacggcgtcacccagcgcgtggcgctccctccctcgccggcgtacgactccaatcagctggcctccctcttcggattcctgcttgtgggttagcccagcacgagccatctccttcgcgttgacatagaggacggagaagcgctagccattgcagtgtggaaggaggggatagagagaagaaagacctgacatgtgggccaaaggacattttagaaatttcacacaatttatctctcctattcaaccggaaattactaatttaatgggtgcggtgtccaccagcaaataaccacattttgagagtgtattcctccaaaagtcacttcgcgcggtgtcctacggctaaaactgcaaagtcacaatatcctgtggcaaaatttgccaaaactaatctacacagctataacagcaggtacaatagcaagctataagccagctataaacatattttaaagagataaaggaagagagagaagggcagcgggctacagaactgtagccagctgcagtacgaactccaagatgtaatatgtgtatgataggtgagaccagatataaatagtatagtaagcaactattgtatgaattggctattacattagctaagatgatttagagctagtagtgggctgcactattgaccttgctctaattgttggtggtggtgatgacaaaatgttggtagtcggtgatagtaaatctgccacaacaactgcctatcactgatatatttaaccctctatcattgacatatggcgtcggtgtaattttgtgctccctaattcaaacactcccgatccctaatatgtccgttgattccgtagatcagtaacctgttaatatatgttctttaaaaaggaccttggctatttgctgcggcattcattcacactaaaatactaacaaggccatgaaagatacatatggtaagaagtacaatggtgcctcgagcaaatctactagtaagaagtaaaatggtgcctcgtttacggtattccaaaacttgagcatatgagccaaattcaaatttgcttacaagtttaagcatatgcataagatgattaacgaagcaggtccgagttgaaacgaattcgacag

SEQ ID NO: 60262 - DNA, 1043 bp, Oryza sativa
cctgcacccccaaggcagcaaacaggctagaaccatgcaaatgcaaattaagacaagattgtaaccatcaagacatagtaaatatatctgatgtcaaaataataacacaaacaacataatgctatcgagtctgagcacacagatgtatattgtcaggagcttcaggtgtgtggtgtgtctgtgttttccttaatatgaagactagtatatttaaatatttcaactgcttagacagtgagataataagggtgacaaggggaaatgcttctcacttctgtatgctcaattatgctacctttctcatcccgtaacctagcatatccaggaagattgcatcatcagtatatacaacaattattatatttgaagcattggatgaacaaaaaaacagtacttaggggttaggatgtttcaaatagattgcttgaattatgtgaaactaaactgtatgctattgaaataaagtcattcccaacagtggtagtagattacatattgtccatatttgacagcaaatatggtataagatagaaagatgaactggcaattgtgatgtgatgtctaccaagtaccaacttggatccttcccaaaagaaaagtgatgaagattgaaatcctaaaatgaattacctttcacaagatttgacaacgttcgcaccagcttcaggctcacatttacgtgtcttcacaaatttttcttcaggtttgtaagcaacatcctgaagatacacaaaaaacatgttacagaccacaaaggataacatctgtccagtttggtaatagagtgatttgacaaacagaaaaaaggagaactttctaacagtcaacatgccgaaaagagatacagagagtgcacaaaagaattttctttagaagagtcagataagaagtataagattactaacgaccaattgaacacttcaatgttttgtacttcctccgtttcacaatgtaagtcattctagcctttcccaaattcatattgatgttaatgaatctagacagattcattaacatcaatatgaatttgggagggctgcagg

SEQ ID NO: 60263 - DNA, 2703 bp, Oryza sativa
atattataagtcgtctgacttttttcttagtcaagctttgttaagtttgatcaaatttatagaaaaatttagcaacatctaaaatgtcaaattagttccattaaatctaacattgaatatattttgataatatttttttttgttgaaaatactactatattttttttataaacttggtcgaagtttgactaggaaaagttcaaaccacttataatatgaaaaggatggagtacataagagtatacaacacaatagtttgttcactgctccttaaaaataacatcacaattactgtccagcgtccacatctcactccaacaaacgtcaataggcagaaatcaagagggccacacgaagtgacggatgatacacagaaaaaaacgcgcataaaactggtgttcagtatcgcttagttagaaaccagaatccaacaggttaggaagcagagggtttaccctgaggtaagtgagatcgtagagcgcatacacctcggatttgttgatggtgatgatgaggggatcccggatgggcatctcccccgcctccgtgccgttctcctccacctccgccacccgcgccaccagcgacgcctccccgccgctttgatcccccacaccgcaaacgttagcgaaacgaacagtggcgtggagagaaatttggggggaaatgagagagagagagagagagagagagagagagagagagagaggcggagagtcgagcgcgattaccgagccactgggcacggccaggtcgacgacgatcttgctgtcgcaggtgaggcggtcgcggccgtcgtccgagccgccgcgggcgcagctctccaggcgggacttggcgaggacttccactccgccggcgggcgcgaagttgttgacggccgcggcgaggagagcgaggaggaggggacgggatgagcgagcggcacggcggcggcggcgaggcgccattggtggttgcccgcggcggagcgagagcgaaggggagcggggcgaaactgacagagaggaggggcaatggaagaagattaaccgttttgagttcaaaatactactccctcgtcttaaaataagttttcttttatcatttattctaaaataaatttatttgttagtaattattatatcgaagtttataaaaacatgtaatgaatacattaaaagtagataaaatgatgaataattaatttaagattttaaaaagtaaataatattttagttacttttcaatttcttttgaaggaccaatacctataggtgcattgattcataaaatagagtaggaaaaaattacaatactaacactgtagttaggaaagaaaaaaactatcaccgcacactatgttatttttagttttgcgttgatatatacgatatgagtaaaaagataaaacttatttttgaatggaagtaaaacacgtcttgcatcttgtgtggctgttgagtggtttgatggctttgcaacttcacattaaccgcaccatttggaagtgaggatgtattgatcaaaatcctaataattttctgtgtgtgtgtgtgttttttcaaattttgtgttttacaaattatctgatttttcatgttttttttcataatatataccattattcaattaaaccattttactttcacgtgaaacaatatccatcaaacgagctctacgtctgcatgtctgcatttgtacttctcttattaatacaactatcatggtggattgcacatttgcataactagacttagttttaagattcacgatttgtcgtgtaatgtacaaacaccatgctattcatgatccacccagcgagagtctcgccgaaactcacatccatacatagagctcctagacatgtatgtatgtactgtctactttttgttcttttccatgtatgttctgtctattttgtttttttccttgctgatttatgctccctccgtttcacaatgcaagtcattatagcatttttcacattaatattgatgttaatgaatctaaatagatatatatgtctagatttattagtatcaatatgaatatggaaaatgatattatgaaacggaggaagtaatttgctggtaacataaatatgcttcaggatctctgcattactagtaactagtaacacctgtgcttacatgagttcgatcataattctcatattttaatgattcgactaatggtgcaaaactgcaaatacttcctttttaatgtggtaatttctagtaccttcatatagcaaaaaaaaaaagggatgatcataattctcatcttttaatgattggactaatggtgcaaaactgcaaatacttcctttttaatgtggtaatttctagtaccttcatatagcaaaaaaaaaaaaagggatgatgcttccaaaaatgaacgccgtccgtggggatcgaacccacgaccacgtggttaaaagccacgcgctctaccactgagctaggacggcgttttgaatgaaaagaaatagatcaactataactacaatgatcgtttagaattgcaccatacatcaattgctttgtctcttcagatcaagagcatttgaacagaccagaatgcatagaacaacttttctgcaatgaaggcatttgaagcaagaagtaacgggaaagcataaaaataactagaatgctcaacctatataaacttcagtggccgacggaacaaatttacaggaagaacaaatcgggctgcagg

SEQ ID NO: 60264 - DNA, 21899 bp, Oryza sativa
  unsure (1)..(21899): unsure at all n locations
cctgcaccccctagtgaaaccacaaacctgcattgcaaattcttggtatcaggatcatttcaagtttgacataaagatacaccatctggatgatgcccactaataaggaaataaatcaccagcatgaacgcatatttctatatatcatattttggactatgaatatgcacataacagtggtgttccccatatttctaaccatatattgtagccaattaacttacccgacaagcagcaaaacgaatgccacaacccacaaaacatattggtatgctttgtatttgggaggctgattagtttggggcaactcatgtcgttccatccaaccaaactgtggccttgccaacaaaacaaatcccaaaaggaagcccgtcacaaatccaccgatatgagcaaagttatcggcatgaggtagtatcccaatagccaagttgattgcgattataaatagaagagttattatggctgctgcctgcaagagtggattagcttgatcaaaacaaacatcaagcaactgaatagtgaaaatgtatgtgcatctatctcatttactaaccttgttggaataaatagtccagttcataataagctcagaaagcattgatccaagcagtccaaataaagctccagaggctccaacagagatgtagttattacgaaggaaaagcgcagacaacacactcccgccaaaaccagatagcaggtatatggcaccaatgcgaactagtaggtaaggaaactagtgtcagtttacagattattaacatgcacggagtggtgacatcaaaatagaataataaatagagcactaaagaaagtcttaagaagaagcaaaaggtgacacaactatggagacaattagaaaaatgaagtcatttatgattttattttcatataagaatggcaacccagcttcgactactagatctgctagaagtattgggatcctatccgtttgagaaacataatgtcatcagaacagaaaccatagccatgcatttcaaaccaggtcaggagtgttcagtgtatatcttgacattgaaacatccacaaaacagaaattctatgagatggcatgtattcaaagatatatgttaacactaagaacgtattctcatagttaaaaatgacactgaatcagcatagtaagaaacttaccgaacccaaattgctgttcaaggcggattccaataaacagtaaactcagcatgttcacaaccaaatggattaggccagcatggagccagatacagctaatgagacgccatccttggtgctgatgaacaactttgttccagtcaagagctcccattttctgcaaactgccaatcaaaaagagagatgttaataggatcaccaatcatgttgttcatccaagaaagctgggtgcatcatatgatgcagagtctgggattttcattccattatctaataaaaatcttgttcatccaagactatattagtcagacctatattaaattcgcaaataaaagcaaacagcagacttctgtggccaactggccactgagctattatgttccttacaaaggcgttacaattaaaataagcaggcagacaagtaccgtcaaagagaaagctccaacatttaccagtctttggcttacgtttttttctgacagaactagtacactatacatattgttagtagggtatcagtatataataacacatgatcctaggcctgtagcaaccatgtcatacaattcccagctgcaatctgataaaagtatcaatatgaaatgtactaggtctgtagcttaaatactgacagcagccatcacgaatatcataagagactgtcgaaatgagttagtattgtgccacaaaaactacacgatttaaggcacacgctctgttccgaggttatatcccaaggtgccctattagcaacaaattgcaccacagggagactgaagctatgagtggattaagaaaccaaaagcaacgaagctctagatcagtccaagctatagtccggattgagatctgaatggtcaccatcggagcacagagtcacagagttccctgtctcctgaacttaaaaacattaaaaggtgtgaaagattgaattgaaggaaaaggaagtttgttgcaaaatatccttgtttggattccccttgggcaaagcttcggccaccaaagaaaaagctcggagatttcctcccgctggtcatactttaagtacacagaatcgcgcgctttcagttcatcatcagtgcttaaagatgagagtacttttaattagacctccaaaccacacccgagaaattctaattttactcaaaattgaccagttaggcagctgaaaatctcgtcttcctattcctggcagcgcctcgatcaaactgcaagatccgaaactcaaaaataaaccccccaatctacccgcacaattccgcctcgagcgcacccaaaacgcccccaatttgagcgacaccatggacaacggcaacaagataaaacaaaaaaaatctcaggagagtggacagaacgtacgtggcggaagacgggccgaggagcgggttctcgcggagcggctggaaggagaagcggcggaggaagccggcgaacgcaccgccgagcgcgctgccgtgcttggggcagttgttgacgtacatctcgacgatgaacaccgcgatgcaggcgacaatcacggtgggcacgagccacggccaccacttcctgtcgtcccgcccctcgtacccgccgtacccgtaccctccccccgccgtaccccgccgccacccggctcttctcctcgccgccgttgctcgccatccctccgatccctcttccccttcccctcagtggcgaagaagaagctcaagtggctactagtggtttccccggagctcgggtttggcttcgaagcgaggggaagaagaaatgatgcggcggaggaggaagggagaggagacagcgaccggcgtgggccccgcggtgggtggagggcctgtctcgctggcgcgtggggtcccccgcgacaccgggcggtgagccgttgctgtctccgcctcctggccccgacgaggcgtcgagagagaaagagagagagagcagagtggttggtccggctcgctcgcagtaactgctccacacaggggaggcgaggaggcgaggggaaggcgagcacgcgacgcgggcgaaggcgaggactcggcgtacgtgtggcgtgtcgtggcgagacgaggcgcgaagcgtgtggatccgagaggggggatcgttccacgccacggcaccgcgacggacgcgggtgcgtgttgcgggcgggggtgagctgttgcactgtcgctcggcccaggtggcgtctcctcttgcatacttcctcccaaaaaaatatttagattgatcttattttaaatcataccaatttttataaaactgttaaatatgtacatacatttagtctttgtactaaatattgataaatagataaaaagttctgccaaaattttaataatattatcaattaccaaaattttggtattgttttgattacagtctaaacatcctcaaaatcaatctagataagaatgtgatataacctaagataacgaatctagatatattcgtatatagattcattgtcttggattatgtctcgttcttaatttttttgagttatgtctcattcttaatttcttatttagggtcatatttttgagacggacgagcatagtatagccacctgctctgcacgggcgcccgcgccgactgggtaaacggcgctccgccaccactgtgtcaccctcaccgtgccagcgtagccaatgtacagtacaaacagtctacagtagatgctacgtactactgtactactactgggatccgtggaaaaggtgactgacacgtcgtcgacgcagccgcatgcagcagcagtggaggctgtcctcgtgtcgcgcattccgcgttagatctgggaagaactgtggtgggatcatatgcaagctgaccgcgtcgtaaatggaacttttttgtgtgtgggtgcgtactgtgcgcgtgtacggccggtgttgcatttaaccgcgccgtgcgccgcccgcgtactgtgcgtgcgtacgtacgtacgtggtggcgcacgcaacgggagaccccaagtccccagcctcggccacaccacaaccccaactctccaaggctgtgccttgcacgcaccgacgccgtgcgacggtgcgagggcgtactactcagttgcattgcatgcgctcgcgtaggcgtagggctcacaccgagctggtccgtcacgtatgagtacgtgctccagcttacccaggtccccccaccgacgagggatactacgactgcaactttaggagttacagtgcagccgatggataaaaaatcaacggttcaggtggcaggaaaatactgttcagaaaatactatagcaaatctgtacggcagcgattactgtagcatcgatggtgcaacaggatgacagagcgaatcagggcgttggctccatcgatccaacggctataacgtgctccgactggtaaagttagagtcgttactactacagcaccggatctcaattcaatgcaagcaagctcatcactagtgatgccggagaacgcccgcgaaacggtcgacgcattgctatagtattttctaaacagtattttcctgccacctgaaccgttgattttttatctatcggctgcactgtaactgctaaagttgcagtcgtagtactgcaccagatcttgatccgcttgcattgcagctggctgcaagccctgcaagctgtgtacgtgccttcaatccccgtccgtctcggcgtctcgatcgatcgccggtgaatcggcgatcgatcatggctctgcgatttctgcatgcattcaagtgtcgcaggcgaattgctagctggaaaatggagttagcaagcatgcatgatggatggatatgctgccaatggtatacggccgtggccaacaaatccaactgtacgaacagggacggctcgctcactttctttcacctcagccttcgtcgtcctggcctcctggcccgcatccaaagggcatgaattgaccgagcaactcatcagccaagccagacccccaatccattcctgaactcgtggtgactggtgagggctccacatgtcggatcccaagcttttgggtatgtttcgttagtgattggttactagccacactataccacgcctcacttttcactgccacaatttattatgtatgtagggatgaaaacggtcggaaacgatcgaaaaacagcctcaatcatttccgtaaccatattctcggaaacgaaaacgatatcggaaatatcagaaaaccggaaacggaataatacggacggaaacatgtcggtgcagatcggaaaccagtaacaaatatggaaacattaaactataaaaacatatatttaactttacataagtatgttatatgtatacataaattcaagcttatactatataaattataaattaactttattttagccatgcataaaagttagagatttgattgaagagtcagtcaatctgtaagctgtgggccaagtatagacatgctctataaatatcgacatatttagaatacggtaattaccatattataagaaatggtaatttccacaagaatacggtagatacggaaacgatcgatataacagcaaaaccatttccgtttttatttccatatgttttgccatttccatttttgttttggtcgactaccatttccatatcgctcggccggtagaaagtcgaaaacgaacgctagtcggccggtaatttccgttactgttttcacccctatatgtatgtgtttggttagcttaacttccttaccaatttcaccatacttaatgactagcaatttattcatcacattttatggttgtcacaacttatctaacattagttgtggcaaagtataaccggtaaccaaacatatccttactactgtagttaagacttctttcaaaatcaccagtttttaaaaggtcaaagaataaatagttaccccccttcataaaaaaaaactaatatatttgtagtagtattatatttgtttttaggcagaaggagtatatagtcttgacaataaattaaaagccagaaatcgaagaatcaaggttattcagattttcacaatttgcttaaaattccaatctctgtacttagccctttgccttattttacaaaacacatgacgccattgtaaaagattccacataagttaagtggctattagaagctgtggtgtcacgttgtctcgatggcaaaatcattttccgcagggcagctgtactgaccccatatgtcgcctctcgctaccggtggtaccgactaccgacgatgccacagcatttgctgctgaaagggaatcattggcttgccaagttaattagcagcagcagcagcagtatattttggtcctaatcaaaagggattatgctacttggtggttatctccatattgtcattgagtttactcctaaacaatctgatcttacttcctacacgccaaaggaacctcctagtttattgttgagctgcattacgcaaagctaaacaatgttggattacgcaaagctgaactatgctatagttctctttgacaggactgaactactgtaatattttcttctttttttttttgaccggactgaacttgcgttgttcatcactccaacgtccattttctaagaatcgatgtgaatgatgtgatcatttcagccaatgggccaggctccgatggcatatccatttcattgccaaaataaaccctatcactatttatttcaatgggccaggctctaaggacatatccatttcgttgcaaaaaaaaaaaaagtgaatgtgacgggacggcatcccgttcagacgggatgatatatctgagatatcgcctaataccttagtatcagccgatacttaccagtatcagtatcaggctgatactaaggtattaggcgacacctcggaggtatcataccgttcaaatgaggtatcaaacaatacttactagatatcaggtgatacatcaatgttatcattatgtccgaacggtataccttcttgtatcatttccaaaaaaagaaacttattattattatttattggtaaaaccaaagattgataatgccaaatgttgccaatataaaagatgcaaatgtgttgttgtctggtttgattccctatcaaaatttaaatttggtgtagttttgtaaatagatggagttcggtaaagttgtaatggtgaaatcatgttcagtttattgtcgtacaaaaatttggttgacaacaaagtgaacaaatcttaaatataattatgtaccgtataattggctgtatttagattggtccaaagtttagaatttggttaaaattggagacgatgtaactgaaaaattatgtgtatgaaaggtttgatgtgatggaaagttggaagtttggaaaaaaactttggaactaaacacacgcacaaacgtgacgaaatatcttataggccttgttgcaatgagccttttcggtcaaagagcccaattgtgtgctacaaggcccgcatcacgaaccacttgaacccaaagatttctcatgccaattcggcccacaccaaccaaccccgcaaaacctcccctaacaccccgatgctccgccgcatcgccgcactccggccgccgccgccgccgcagtcgcggcgggatatgcatccaagtccaccactgctgcttctgcgggaccacgccttcgacggcatcatggagtgcgccgctttctcgtcctctactccgtcctcctctatgcggccacccccaccgcgctcgccggcggcggcggaggggccatgtccgtgcccttctcccgtcttggcgccagctccgcctcgcgcccctcgacgccggccgtttcctcctgcgccacccgcacgcgttccaccgcgtcctccacgccccgcctcaccccgcgcgccgccacggcgctccgcctcgaggccgacaccatcgcctcctcgctgccggcctccatcatccgcatccgcaagctcctcctcctcgcccccccccccgcgcacaaccgcctccgcctccgcctcgagcacatcctcctcctaggggaaaccagggtaagctgcacgctgtgttccttcgggaggcgtattacaaaggtcaactcgttgagcccaatgagatttatgcggcgaggcggacaatgtaagagctgctcatgtggaattgaacccgcagaaggcgaatttggaccggatgttcactagcacgggtcgtggatgggatgagcttggtggcggtcgtcgtgggggagcagaattgagggaggagttccttggtgaggcgagtgaccggagagcgaatattaaggctgatggtgattatggtggagattgtggccatgactcgggagttgagtcactctacattgagtgaggactgaggagcagaatcatactgtggtactaacatcaactaaggaagcttgccttctagaacaagtattgacaccatctataagctctctttcttctgatggtgaattaacagtcggatgcagcaatgctgattgaggagaagatattgccacccgaggctaaaactagtgagatatcttgtgctaaaactgttgatattgtcaaatgaagactctgggtgtcggcatttaacttcactgcaatggtcggatggcatcttcgttttgcactccgttgtatgaagaaggaacaaagagagaggcatgggaactgaaaacccctcattattttgagcactcgttcttctgataatttttactgagtcttgtgagtactctcagtctctcacactaggagtgaatctctctctctctctctctctacctattggggattggcattgccatctcaaaattctgtgactatactacctatcatttcttatacatcgtatagaaacaattgaacttttatgtgtaataagtgttgcacggaaactccacctaaactgaattgtccgatgtcagtgttaatgtcaatatttaatcttattaattgttttatgttttccttgctatgtcttgagtcttggctaagaaatctggaaatacagtccaaaagaattaatttccagagttgatttcaaggaaaagtaagactggccttttggatcctgttgtcgtatctactcatagactggcactaatctttaccttctacttagttaacgaaggatcattgcatccgactacgatttgatgcataatcagtcttgaactatacattgcagacatgttatgtcttctgtccattgtgaatttgtgattgctgaaccttactatttagtatcatattttaccctgccagttttgtagttctcagaatgtttaacctgactgcaaggtctaacctattagatatgtgtttttcactttaggtatggtcgacaaccatacaggtagtgttctttaccatccaaagataataagatattggacttttattcagagcgtcatggttgtaaacagcatgctgattaaacaaaaagagtttctatttccatttccacttaaagtgactaatccagcttngactgttcttcaaaacattgttcaagtttggaacttctgcaatcccttgattaataatgattcttctatgcaaaacaacaaattttcacatgtgaatgtaacctcagcggctttcatatctgcaatgaaggaacgcggtacagattgaaagggcaaccaatgcacagtgcaaaagacattgatgaaaaatcagaaaacaaatattacaggaaaagtccattcagtttggaacagaatgatgaaggctcatgtagcactgcagttggcatgccttattgaggtctgcagcttgctcactgtttcaaatgcacagtgctggaatgtcttgtgttgtggttgtgagttgtgactgtctctgccatatgcacttttataaaagactttaactcttcaatatgcactggaatgctgaatgtaatgaattggcagtctgtaggatcaaagttcccgggtcgatgggatcgaggaacagggtcgagaaacatggtacgctacttacaagatgggaacgaaaatgacctcgtgttcctggacggtgttcccggattgaggatcgctgccaccgaccccgttttctgtgactatgggatttgttcttctgaatatcatttgaaacctctgaatttcaacttgcatgatattgtgaacccactaattggtacgtgatgtcatcatggttataatgtctgatattatctgccaaatatgctgctatcattgggctccattttactgctttgcagatgtttttactttctaaataacctgttttaggattttttttatgtcattgactgcctactttttttagtttgagtttttaagtgttaacacccaattatactttaattattctgaattctgaactaacttattgtcctcttgccacctgaaattgtcagctctcccttcaaataataatactatgatcctcaagtaatatcaactagtagtagcattctctgtacatatcagataatcgtgcttgtcatttttcttttggccttcttgtgtgatgggacttagttctgatttgtgtctcctatctagctttatgtccttttctgaaaatttatttgtttgatagtgtcattagatgcttatagtaaatggtctattcttgtaacatgtattgatgacagcatgggttaaaggatataggtctagtttagcaatcgagcataacctcatttatgatgttaagtgctgatgaagattgaaatgtataaaaacaatctatgttgtccacaatccaacagacatattaagcaggtctctctcgctctatttaattcaattgatagtaagcttttctatcagcttttgtacctctgctatcattttcgggtatatcttttgtcctctactttctgtctgccttgttgttgctacttcttatgggaaaaacatacaggattacttttgtgcgccaaacccatattccttttttttttctcaaaccattatgcagtgttttgctatttgtgctcttacatgggtgttttgaactgagctaactatttttcttgaatgatacagagcaaagagaggtgatatatggtctctacattgcacttattattctggaaatatcatctctatcatttatgttgcctatattagctggattcttttggcccacaggtatgttgacatcacataaacatcttattcctaattaattgtgctgaatggaattaagagcgtatggacgaattacgtaagttacgtttggtatggtgtgattaattgccgttgctgttaagcctttccagttaggtgtgctgggttgatccaatgcaaggccgtatttgtatcatcaataattgccattgcagccgccgcacgcacgacccacatgacccatccactcttggtcactcatatcagtgtttcagctttcagccttcagcctacagaaaaaaaggggggtgttattacaaacagctttttaactaattagtaccaaggaataatcatgtgggtaatagtaacaatttttgggaacaggtccacgtgaagattactattgtccagctctgtaggcacagctaacacatgctgacatgcaatactactgctgctctgcttctccctctcttggggttaaacaggatgtcatcagcattaggccaggaggtcgacgccaaacctaatatcccagtccagtgaacagtggccgacagaattagagttagagatcggattagattgaaccctatttagtggtaaattcatacaatcgatgacagtaaaaggttagtatatccttaaaatatagctgagctcaaactgagcgtgcttaaaagctcgaagacacagcttgagctcgagcccaaacataccagcaatgtagagggatgtattactccctccgtttcaaaatatttgacaccgttgactttttagcacatgtttgaccgttcgacttattaaaaaaatttatgaaatatgtaaaactatatgtgtacatgaaagtatatttaacaatgaatcaaatgatatgaaaagaataaataattacttaaattttttgaataagacgaatggtcaaacatttactaaaaagtcaacagcgtcaaactttttgagatggagggagtatctttttactcctgactccccgatgctagctttggacatggagggagtactaaagtggttaagtttagcatcactttgattaaagacaatagtactctcgtatcatctagttgtaaacctaacttcagaaagcaatgtttggcctaaagcaaaaaatatgtggattaaaaattgtacacgcgtgtccttgacgatttaaaagatcacattgaaaaataaactacaataaccccctccctcctctaaaaaaataactctaattgttttgaatggaaaattaactctaaaactatgtttgaaaatttatttatttattggctaacacttataagccgaaaggcaactgatggccacattcctcttttttatattgttcataggttaccaacccatttggccatgcacagatatgctaagctcaaaccataattgcccagggcttgttatctaacaccagtggtgctaattgtttgctccaagttgatttgcatccgacatggtttgaaggggaaataaatgctcagatggatgcttcaaatgaaatttcaaagagggagaaacgtccaggggtcttccggttagctccataaggtggtgggctagacggcctgngttcgaagtccccttctaattatttaatattagatcattccctaatattcatgtttttttaaaaaaaattcaaagagaaatgctttgttgaatttgttgaaagaataactgaagatcccccccgaaaaaaagaataattgaaggaagaatttatgtacaacatccgtcccaaaataattgtaatccaaattgtttagtaaatattaaggggtctgttcgctgcagctaaattgtagttgttgtgtagctgcgctacagtgcatgatagagaaaatatatgcactggctgtacagcgcagccagttacagctgcatagcagcgttgccgaacagagccaaggtttgagaagaaagactgtaatgccccttattaaatggtatatatagatgagatagataggagtggaagggtagttgagggtaaagtagagagaagtgatcaatgggaccattagtactctactgtgacaattattttggaacaaatttaagtcctttaaatacaattattatgggacaaagttagcagttaagttgtgcatgctcaaacatctttcttggtttgtcaccatgcaaacttatatgcaaacttatgtttagggatgcaagcggggcaggcaagcttttttttagcctgcttatctcatttatacttcattttttcttctaaattttgtattaccatgtggaaaatgaactcgcaagcgaatttttatgcggatagcgggactacccacttgcatccctacttatatttggcgaatgacctagctttgcaagtagggagtaatttatccaatgatcaaccggtgatacaaatgtgagaaaaagacacagttgtcattattagtatcgtcttgattgtcatcttttacaaagaaggctttttggacactacctccttttctaagtaataagccatatgtagtaccactatactaagattcagtccttcaacccatagtagaaaaaactagaaccagaggtgaccacggttcggtttcctttaaagaccggacatgtaatcgaactgctctgaaccggctgaaccggcggtttttcggcgaaccggacactaaaccggcactggttggaccggctagccatactaatgggccacgatgggctgtctaaaggcccaatggtgcagctagtggttttttttttagcaaaaatagcaagaaatggtgcactgggtgggattcgaaccctctggtccgggggttgaaagagccaagtgctagccatcaggccatccaacgacatgtgtacatgagcaaatatgtaatatacatgtagtttgtgaaccgcagttcaaccgcctgggtcaccggtcggaccgacggaccgctgaaccgagaggtcggctgggtcacccaccggtccggctttttttactatgcttcagcctccttctaatttcatagtttcattgaattaaaaggtaacctcccccctcaacaatttagtttaagtttcaattaacttcatttataaatgaactagtaactcctttgataagtactactcctatcaagcattggtcccctcctcttgtttaagtccattccaattaaaccttgtgcatctcttgaaaaaaaagagaagaaaaccggactttttttctcctctggcagataagcatttaggcccccatcgtttggcttacttcctaataagccaataggaaataaaaataaatttgtagctaaaacttttataaatatgttcttggtgacttaaaagctaatgttgaaaaagaaactacattgaaaatatatcaaaatcaatctcaaaattaagcttgaaaatttaaaatttggctttttctttagctgattaggctatccaatgtgagccttactctctagaagccgattgaaagaaaaagaaccttccaaaaggacgacaaacaaaaacgcacaaataccaaagtactccagtacagtgtatacatacacgaaataaaaaaaaaggccacgtcgtatcgtagacgagataaaatcttatcccactcgccatccgtggccgagcaatcgacacgtgtcccgtctaccgtgggccccatccagccccgcccgcgcgcctacctgaaccttccagaaggccgaagcgcgaaaaatcgaccgaaccttctcgccccttccgacccccaattgccccatccccatcccatcatccccccgccgagaacccaatcccgcggcctcgcctcatcctggccatccgtgccacctcggtgggttccgatacaacggcgtggatgcgcccgccgcgggggcgagagatatctatcactgcggccgggcccacctgcaccgccggcgccagcttggctttctcggtacgagtggtgggtcgcatcgaattcataggccatgttttagttccacacaacctatcacatcgaacgctaaaacacctatataaaatagtattaaatataagcttaaaaaaaaactaattacataggttgtgactaatttatgagataaatcttttaaatctaattgctccataatttgataacgtgacactacagtaaatatttgctaataacaaattaattaggcttaataaatttgtctctctatttacttatagattctgtaattaattttttattagtacccaaacgtacagtcaacgatataatacccgatatacacgaaaaaacaaaactttacacaactgaatcttaacacccacatacgtgcgttttctctttaaaatcgttttttcttttggtgctttttttccctcttttttatttgtttctctcttgctttgcttctcctcctcccgttggagtataaattttcctaatccgcaaacgaagtttccagaagacttccggtccgtaccttcgttttcacacgcgaaaactgcctttcttccggcatctggaagctactactactacggtcggtcctcgccggatcagatccggccgcctccccggcggatggcggagcagggggcgggcgaggcggatgcgggcggcggggagcccgccgccggcggcggtgatgacggcggcggcggaggcgttggcggggcagaggtcgctgccgacgccgttcctgacgaagacgtaccagctggtggaggacccggcggtggacgacgtgatctcgtggaacgaggacagctcaacacctatgtacgcgcccccgggattattcctcctcctcgtcgtcgtcgtttgcttgggatttagcttggtttggtttggccatgtcggtgatgtgtctggattttgcttgcttgctgtatgacgtagggatttaggaagatcgtgccggaccggtgggagttcgccaacgactgcttccggcgaggggagaagcgtttgttgtgtgatatacaccgccggaaggtggtggcggcggctgccgcggcgccgccgccgccgtcgccggggatggcgacggcagctgccgcggtggcttcgggagctgtgacggtggccgcggcgccgatacctatggcgctgccggtgacgcgggcgggctcgccggcgcactcctcggaggagcaggtgctgtcgtcaaactctgggtcgggggaggagcaccggcaagcgtctgggtccggctctgcgcccggcggcggcggcggcggctccgcgtccggcggcgacatgggcgaggagaacgagcggctccggcgggagaacgcgcggctgacgcgggagctcggccacatgaagaagctctgtaacaacatcctcctcctcatgtccaagtacgccgccacccagcacgtggagggctccgcggggatatcctccatagcgaactgctccggcgagtcgtcggaggccgttcccccgccgccgcctctccccccggcgatactcgatctaatgccctcgtgccccgccctggccaccgccgccgccgctgcggggctcgccatagacggcgagcccgacccgagcgcgcggctgttcggcgtctccatcggcctgaagcggacgcgagacgacgccgccgccgccgccgacgaagacggcggcggcgaggatcaggccgagcacggcggcgcggacgtgaagccggaggcggcggatccgcatcccgccggcggcggcggcggaagcagcacggaggcgtcgccggagtcgcacccgtggcccatataccggccaacccccatgtaccacgcggtcaggcccacttgcaacgggccggacagggccgggtccgaccaagacgggtccagctccaggtgagttggcccccccaaccctgtagaagcttctagacccctatattacttaattgcccctcccctacactattataagcaactaattatgattagtacgtaattagcggcgaaataataattactaccactagtagtactagatgctcttttgcttcttggcgaggaagaacagatgagagctcaccttgtctctcgatcgatcgccttgtaatccgtctgcctctttctcttgattgtgttgttgtaaatcatcagcgtaagatccatcaggatgccggtaaggcggtaattgcaacctgggtttaccagtgtattggctgcctgctgcggaaatgagaagtgcatttccttgatggtgtggtgtttattaagttgctcacctcaaactgttgttttcttaggtgcacagtttggtcagttttacaagtgttttaggtgttagtgccaaaaatggtggtgacatagggcggaagcactagcatatgttttgtactagatgtatgtattaggtttgatgctagaaatagtggcgatatatactcccccttctttctcctgtcactattcaagttcctttttagcaatttttttagttctttatttacccaacacagtttgattacaatccatatgagtaaacacattagaaatcatccaagggctaacactgaaatcatccaatagcactagcatgcatgttttatactacttgcatgtataagttttgctgctagaaatagttgtgaaatttaggggttattcggatgctagtgggtagccgcagtcaacacgaacaatgcagcaagctgccctcgcctgccgaatagccccgtagagtagaaagcctcaattaaccgtgattttgttttagagaagggatcatattagtacaacttttggaaaaagtcataaccaaacaaaggccttccaaacaattagccgtgatttgcatggttggctcctggaaatggaatcgtgtgttcacagaatccactaatcaagttatcatctccaaacgccgcgtgtagaagttgagtcaattcttaattttgaccgactgggtcgtcgaccacagagggtcgtgtcgaacacacgtagtgaaccacatagcgctagatttggctgtcaggcaaattaatcatgtcaatcctaggggggggggggggtccatgcagagagggattgattactcacaatttcgtatattttctggcttagccaacgttaggcagcggacgtcatcgccactagaaggcactggatgccctttgttccccatttttcttcttccaagctactcgtattttgtactacatggcatcagacagcgacgcatcgtcgaatggttgtaggtcaggtaagcacggcccggcctattttttccccctctgttttcgatcgatctttcttgctgcgtttcttcaacgagtagtactccgtactaataattttgtccacgacattgccacgtcgaggcgtcagagatgttgcgtaaactagtgggttcttacatgtgttgcccatatcacggagtattcacgtttgcctcgtcctacatgtgtcttaaaattgttgaacatcccaacacgaaacttgttacactttctcacatctaaaataaaagaaactaaagattgattcacgtaatttcgtactctccattctacaatataaagatgaaggtagtattggtatcaaaatgtatgtttccacgacatacccacccatatttgaccatagccaggcaaggatgggaaacggcggtaaaggcaggtgtatgtcattctggtcggttccatgtcattctaggagagatggtcaacctcattttttcgcttatacttattcttagtagtcaaaatttaaattttcaaccttaaatttggagttgattttgagatattttcatcaaagtttatttttcagcctttgcttttagatcgttaagaacacacatataaaagttttattcacaaattatttttcgtttgcaaatatgcctgaataagccaaacgatgggacctggtgaattcgacgatctgcaaaagatgatggtggtgcaacagagcaacttcgtgatgcactggggacgctcggaatgcggtagtggcgtaaggggttttggatggtgatggcagacaacagcaaatggtgttgtgatccacggaggcggagatggtgcggtgatgggtagctgggactagttccaattctccctttccatcctctcgggttgcggcggaaagttcaagtcatcgttgaaggtttaaagctaactcttcaagctttgtgtgtgtgttggtgtgtttgtgtgttttcctctgcatgaggattggagtctaagaacttgtatgttatggttgtgtgatatagaggctagattaataaaaaaaattcattatctaaaaaaaataagttgagatgctaacttcactatttagaaccgatcttggtaatttctaactatgtgcattaatgtacataaaatttcaaaaagctgcaactattttatcaaaataataatatgctacagctttagctaagtatttcaaaaataaatcaccataatatcatatgattttaccagaaaggtacaactttatatcacagacaagtgtgatccacatgtcatacccatgtgaaggataaaattactgttcttttaattttttttctttgcttttctttttgcagttttcttaaatacctagttaaaaatatcaacgttttcacaatgaagtcattattgatgagtaatttttttaaaaaaaggggtttactgcaagctaatcacttcctttgctaatatgtggcctactttggtatctgcacagagaaaagagcatgacgaaatagagaataacagtacttttttgcaatgatggaaggtgattatttatgtgtagaatatagtggaagcactatactatgtggatccaaacacattcctacttccctgtgccgatgtcatcaaatactgtgccgttagattaattatgaggggattaattttggtgtgtggtggagtgttggtgtaaagtccgctcacaaaaggattctcatcccagggtacactatgaacaggttagcatgaactagctattctatggttgttgatttatccttgactgcttcatcaaatgctcgcgtacttaggtgtgtgtgcatatggactgagcagagtgtatgatggtgagctgtgcacgcatttgcttttcttttgtagcgaaaaaagttttaatcatgtgtgatgttgtaatggttttattggtttgtatttggttttttgtgttccatcgctaaattttccaaacagctgaatactcaactctagatacttgagacaccaatttgagctgtgaaatcaatactccaccaatccctaaaaaacacaattctaaagatgaatttgaacctacactttcagtattaaactcttttggacagagggagtaataatttagagcaatctgatcagtcaagcatggtttcatatccgagcctgcactctactccactcagtacgaagtacgaacatacagagttacaaacaccgttcaaattcggaggttcaaataggaaccatggaatgatggaaacaatatcagaggtcatctcaagcaaagaaaatcacgtccaaacataagtccacccttcagtgcttttgtttctctcaaaagaaaataaaacttccagtttggcttttccagttatgtttcaaaatataactgggcgctcctaccgtgcacgcgcggcgataggctaagttgcgtgcgagggcaggaatcaacgggtccgcgtcacgacaaagaaaatcctccacatgtttttctatttttttcatcttttctttttctttcgggataaaacaaactttcaagtcaatattttttgaaacttttaaatcagatttgaaaacttttaagtcatgatttgaaaactttcgactcagatttaaaaactattaattcagatttaaaaatattcatcttaaaattcaaaacttttaactcagatttaaaaactttcatctcaaaattcaaaaactcaactcaagtcttaaaagctttcaattcaaattcaaaactttcaactgaaatttaagatgaaatattcaacttcgaaaattaaaaaattgtgaaaaaatggcaaaaagaaacaaaaatgacgcgtggaagttagcttttccaaaaaaaaaaaaaagaatgcacgtacgtggacgccattaaaaacatgcatgcacttaggctaagcgtgggccttatgggcctaaaacgcacgtcaccaacgcgcgcgaattagcttctctcaaatatacctttaagtgaattgaatactaaatatattctaaaattacgaatctaggcaaaatttccaaattcatagttctaaagtatgttctatccacatttaaaaattgctactccctccttccaaaagtctaagtcctatttctttttcaccaagattaaggtgtagttaactcatttatcatgtaacaaaatcaatgaacatgtaatcaataagtattaaaatgacttcttgagttttgataaaaaatttaatatagcatatagtgactacaaatacaacttagacttttgaaaaaaaataaagaatgaaatatgatttagatttttggaatgaagaattatattttaagacggataagccagctctgaaagtgtgtcatgtattctgcgaaacattccgtccaatggtggaagacacacgcatgacgcatgccggtcaacacggggtaaaagggttaattaaccacgccccacgaccaccacgacgataaaagttaaactacttggtactcaaaaactaccaaaaaccggcgactcgcaggaaatatcgtccacagtt

SEQ ID NO: 60265 - DNA, 3571 bp, Oryza sativa
  unsure (1)..(3571): unsure at all n locations
ttgtatggcagcctgagaagattgccaccaagtttccatgtcagttggtagatgctctgaatgaattgtaactggctgtggatcatgtcccacacaggtcatgaggagaattttttttttaacgcataagagctttgcatgtcaatatattagcggggggagagaattttgtatgactgtaacctgacatagtggtcatggggatttacacgaggagaaaattaaaaagacgagcaaataatggctgtgctattgctaggcaggctccaaacaagcaaaaaaaggaggaaaaagaaactaaaggtaacccaattcctttttgaatcgatcgtgcaaggttattatgcgaccttgcatggatgatggatggtgcatggccatgagacacggcgtcgatctagcgatcggctttggcgtgtcccgatcgcgccgacgcaagccggacggtatgggagggcaccgccgcaccggggcaacgcgacgcacgagagtcgagagatcgaaagcaaaaacagccgagagatactgcgccgcgccgcgcgcgtccgcccatgcatcccaattatggcgcaaccgcccgcgccaccgccggcgacgtcgcgtcgcgtcgttcgttcggtacgcggtgcgtagcgtacgtacgtccttcgcgccacgcaccgcgcgcgcgcatcacgcgtgtgggcgatcgatcgatcgcgcgcgcgcgcgccgagctgatgggctgatgcgccgcggcgccgggcggcctccttttcttgaccaatttaacacacacacacacacacacacatcccgtagcttcatcgcagttaacgcgcccgtgtcccccccccgttgcggccggtcgcgccgagaaagtagtggagtacgtgatcgatcggctgccgaattctgataggatcagagtatcagacagacgtcgtcgttcggcgatatccctatgcatgccaagacctgcaggtcggaatatacaaacacatatttaaattattaaacgtagattaataataaaataaattacatattccacgtgtaaactgcgagatgaatttattaagcctaattaatccgtcattagcaaatgtttactgtaacatcatattgttaaatatggagcaattagacttaaaagattattattcacaattttacaccgatctatataatcagttatttttttcgtttatatttaatacgccatgcacgtgtccaaatgtttgagtgacaaggtgaaaaaatttgccggaatgtaaacaggtcgtgagatcagacccctcaatcaccccctgattctctctgagcaaaagaagcatctcttaatttaggagtgagagttcaaggagttcacgaaagccgcgggggcctccccttctattgggnnntgggggggggggggcttctgcaaagattcacgttgggtcaatgtcattcatcagagctgcaatcttaatatataggggcggtagatgcttgcagtagatttttatcaaacttatagtacggttattactagcacagagggatactcatctgtgcacactgtttgttcagttgctcgaagcaaatagtgacctcagtcctactgtacagcgtatgtctttgctagctgctttagtcattacatcatgaacgaaaacataaaaataagacatgaaataaacgcgataacttacaaagcatacaatcaagcaaaaagaaagtgcattctcttgtaggccgcacgcctttcaaatgatgccaagttcatctattcaaatataaaaacgatgggcatgatgtacaaattaattgagacgcacaatttccacatgatttcattactagcttgcatttatgcattccatgcatcgtgttcataatcccaataaattaacatataaaatcgcaagtgttcactgattatattaagttttcgttcgtcataattggtaatcagctcatatatctcttgattgaattccattataaaaaaatcaccttatgttgtttttactcatctgtcctacaaacttgtcgtcctagtgggcattcataactgttaggaattattcgcttataaatatcatacaaaatggctttgatctcagaccctgtttagattcccggcaaaatttttcaccctgtcacatcgaacatttggacacatgcatagtgtattaaatataaacgaaaaaaataactaattacatagattacgtgtgaattgcgagacgaatcttttgagcctaatttacgccatgatttgacaatgtgatgctacagtaaacatttgctaatgacagattaattaggcttaatagattcgtctcgcagtttagaggcggagtctgtaatttgtaatttgttttgttattagtatacgttttatacttcaaatgtgtgtccgtatatctaaaacaaattggcacacgaactaaacacaacctaagctgaaaaggaaggaaggccgaggagagataggccagatagaggtagaggactgctctaggactgagctgaaaaggaaggaaagaatgaatgttcggtctaaaaataagtaagcattcagtccaaaaccaagagagtataatgtataggacaaaaaatgtttttacccattgcaacgcacatgtgttttttctagtaatagaaaaaaataatatattacaaccatgtcgtattgtggttacaatagctgaaaacaaaaatatcccccaaaatgaaaaaagggttgtacatcctgtaatgccgtaagagatgaggttgtacatcctgaaagccaaaaactatcaactaccatattcattcactgaacaaaataacaaaataggtccatcgaacaagttagcaacccagaccttaaagtcaacctcgcagattcgatcatcgatgaactgacaaaacaaacagtactaaatatcctttgaggatcctatgtactccatctagttttgtactccatctagttttgatagtcatattttatcttggcatacagaccaaagataagtaattatacttatcatccatttaaacatgatattattggttattcctcgtaaacaagcgattcattaatatttatatttctcaatgcacatgtagccaatcttatgtagaagagtggagagtcatacattaaatccagaaaaaatcattaagatgataggttgttggattgaaatatatctatcaaaaataaatttttcagatttagaaatatgcatatgaaaagtagatggacggagtacaaaatagactcgaacaaattgaatagatagaaaaaagcacactgaacaaatctaactctatcatgaaagacaaatcataaacatggagtgaatgtaagggttttttcagaggaccttgcggcagctttagtttctctcgaaatcaaaatttgacagatttgcgaccaaaatttatgtcggatgttaaatagcaaatccgataattgaaagcatattgatgtatgcagtcacaagaccaagcaaggagtactagaaagttcagtgatacgaatattggacgaatacctgtttaaatgtagcgagacgatcaacgcctgatatgatcgccactactagat

SEQ ID NO: 60266 - DNA, 2518 bp, Oryza sativa
  unsure (1)..(2518): unsure at all n locations
attattacgtcgacgcggtacatgccaagatcagtccatatataggtgctgtacatgccagccagccagccagcccaatggggaaaaaagcggcatatcgtcgcattaatccagcgtccatactccatactactgtacgcgccaggcatgcagccagcatgtcgaccagcacgcaccgaacagttacaccaccacgtcaatgaacgtccaagcaacgcatcccaacaccaccacgttaaccccgcgacgacttcctccgatcgaaccacgcgcgggccacccgaacgaacaagcgaacgaacgagcgatcatccacccgcgcgcgggggcctcgcgatcacgtacccgcgcacggcgcacggttgccaccaccagctaggtagctgcccgtgccgtgccgtgccaccaccccccacccccgcgatcagtcgatcgatcgatcgatcgcccgcgcgcacaccggggccggcatccgcatccatcgtcacggtgggtggcgcaacgcaacgtaacgcgcggggccgtgtgaccgtgcggctgccggcattaaaaacccacccccgttttgccagcgcggccccaccgcaatcgatcggcaagcaaacgcgagccgcctccctcccgcggacgttgcaccagaaaaaggaaaaaaagaaaacgtcccaccccgtttactccgttcccgcgccgcaccgcacaccgcgtccatttactccgctctccttcgatcgcacggaggacgggtcgggcgggcggggggcgcgtttgggccaaaatctgttgcgtctcggcgcggtggcggtggggggaccgtgtacgggcgttcggggcgtcggattcaaagccgcgcctcgtgagaagtttctcctcgtcgggcnacctctccaattcccaacgcttttttccacggtatcgcccgccacagttctcctcttcctctctctcaccacagcacggctgacaacgagtggcgaggtgtcaccaccaatcaagggaaatttaactatttgccactcttatgagtgccaactctccatatgccactattagatttggcctaacatatttgccactagagagagattacatcctaattttttgccactttcgctgagttggagcgccacatcatcatgccaatgtggactggcctggcgaaattacctttgtgcccttgtgcagaaacgagaaaacagggggaaacagaaacgcatcggcatccatctctttctctcgaccacagctgctcaaaccctaccgtcgccgccctgaaactctaccgccgccgccgctgcgcctgaaacccccgccgcctccgccgccgcctggatccctattggcgccgccgcctgaaccctactgccgccgccgcctggaacccacacgcgccggccggccggcgaggccgctactgcgtgacgcagagcgagtcccgtcgcggccggcgggagcctcacgcggccgccccgctgccggccctgacgccactgcgtcgcggccggctctcacgacccagccggcagcggcagggcgagtccccccgctagctcctcccctccaccgcgcctgcacgcgacgccaacgcatcggccggtcatccgggacgtatagctggcggaggtgaagtggatctgatcgtgatgaagccctcggagtgtcctccttggtaaattcattccccttctctgtattccccttctcttgactttgtgtgaggtgtgcagcatgctgttagaattgatcctggctccattttttttgtcaggatgatcctggcaatgctgtagagttgttgttaaatgtgcttcatatgtagcaaacttagagtatggattgctatcaatgtcagagcaagagcatgattggtgggttgataaatgcaaaggttatagtttagataaattctgtgatgatatgactagcaaggtaatatgggggcctagccaagaaattgtagtgtggggattagactttgatagtgggactgaatggaaggtaaccaacaatgaacagtttgagaagtggtttcagtctgggtggaaagagaaagtggtatatcttggggtagaagtggttactaaaaagggatacaagcctgctgaaagctatgtagatcgagttgagtcaacaactcaagttgtcactagtgttttaagtgtagatcttggggttccatcaattgctgaaggtagtgtgataagtgcaaaaccaactggtcagtcaattgctagatgtggtgtgataaattcagattcaattgatatttgctctccagttcaaatgaccaatgaagaagatactggtgacacttgtaaccatgcaccaaatgtagaagactcagctgctcttgtggactggagtaagttggcaatcattttggatggcttagatggtgatgctcatgcattgttggatgaggatgaactatttgatgctatgggtttcaaaaaaacagatgagagagcagcagccacagcaatacaagaagaacctgcactccctgttattccaattgaga

SEQ ID NO: 60267 - DNA, 840 bp, Oryza sativa
aaagttcatatatgtggaagtggaatccctttccactggaaggtgtagatgattcctatgaaacaatggaggaaacattagagtacaaaagcaacaaacctgagctgcattattgggaggtctgtactcaacagctggtgacgatggttccaaggatgcgttacctaaaaaaaatgcatcatgaacatgtggtaagtgtagatgccagttgagtacagctaatgaatgcacctcaaacaaagcaaaaaaaatggtgaacatgtggtatgtgggagtagcactataccagcaaattctcttgtagcaatagcatcatgtgcattctcctcctcttgcaactgcctagctaaagcttcatcagatgccaaccaggcctcaatcctgtgggtttctgaggagatatggactgaataggtatttggagttgccattgatgaacctgcaatgatttgctaattaacactgacaatacatcaagtaaatcaaacattacaaatcagaacctgtctaagaatccatcttaattcagaaaaaaactcagattagatgttcatgcttccaccagaagcaggaatgtgcaacctacacttcctgtaatttccatactacaatgtccccactgaccactgtgcctgatgctctattagaataccacatcctccatggctccatgtaaatgcatataaatttgactctttaaattagtaactacaatttaaaatttatcgaacattgttcaaatttataaacagtttccccaaatttagatgctcccaaatgtacacagctactagtaaagcaccatccagtttcacctgaacaggactgacataaatgtgt

SEQ ID NO: 60268 - DNA, 2831 bp, Oryza sativa
ttgattgacattactcggagagatacagctcgcaggcacacgagattcttctgcctttccaattgccacgaacccacatgtcacacgaccaaccaaaaagagagaatttttctttgcacaaacaaaaagtgagatttttttttcgccacaaaggtgcgaactttcttctctctcccactttccaatcaagaaacgaagcactcaaaccaagaacaaaccaaggaaggagagatcgctccctctcccagagcaaacgaaaggagagaactcagatggatgcgaactactaccttgcctctttccccggagaagcagcgaaggagaagagcgcgatgccgccgccgccgccgcctccggcaacctccggctccggcgagtccgcctcctcctcctctctcacctctctcttcccaaccgtgtggtgttcgagaagcttttatgcgagcgacgtgcagtggaagcggttgctcccaagtcaaactgatggagaccacctactatcttcctcttgttttcttctgcttttcttttctttatcttttttctttcattttattttgagcgatgaacttgagaacagtttggttgtgggttaaattaaacggtgcagaattgcaaagctacgtccttttcgtctgattaaggtggtatcagaatcctaatctgttagctcagcatttgtttttgtgtgtttaattggccatgacatcagatggttcagaccggtggcaggtcttcatcggagaggagaatgagagcaatgcaagttgcaaacaacaaacaggtccttccaaacgggttggtttcattccacagaacaggatagcaaccagagcacaaaccgttcaacaatatatatatatatatatatatatatatatatatatatatatatatatatatatatatatatatatatatatatgatttaaaattatattactatttttaggatacggaactcttaacacatgaaaatctaaacattttcaaccaatcagaactactagaaagataatctaactacttcaaaatttaaaatttgacaaataaaataactagttttttctaaagctatcttcactggacaacttatgaatatttatatttatgaagcgagtactctcctagtacatattacatatatattcttcttctcatgaaaaattaacttctcgctataaatccgaacatatattatgcgtagcaagttgttttttttaacgggtggagtaatattagagtatttaaattccttcaaattgccatccctctgggactttgctgctgttgttcttccacggttgctgtcagtgtcacccagatttgcatcctttccagctcgtagctactgttctgcatgtattggacttggattaagatcaaatgcagttgctattgtaactgcacaatagcaactgcacacaatcatgtccattcgttttcagatccaacggctctagatgactgctacagtacatgcataatagtacatctctgctacaggttttgctgcagtaccacttcatatcctggccttccgttctagatcatgtgatgtacatgtttttttgaaacaacccgcacaagacattgatagagtaggaaatgtgatgtacatgttaacggcttaagttacagttacaataacaactgcacaggatcttgatccattggacttgtataatatctcatctcgtgcttccattatcgtggtaacagttggcaacttggcatccagtgctggaaactatgccgtgtgtacatcaggatcgtcctttttgttcagttccaagatagaacaagtccaaaagatggccgtagtttttttagtcacagtggaagctgacatagccgtggaataagttctgcacaaaagttgccattcgagatcaactactggtagtagtagtcatcttctaccactgcgaatattcgaagggacacaaaaagatcaacgagtaaattagttcaccggaagacgacacattatcaccacaaaaagactaaaaacaaaaagaaattgccaggccaaaaaaggcaaaaaagaaaaaaaaagatggcacgaggcccagggctacggcccatcttgtcgccggcccaaccgcgcgcgcgaaacgctctcgtcggctctcggctcgccgcgacgcgatggagagttcgcgccgcggcgcgcgcgcgcgttcggtggctcacacgcttgcgccctcgtcctcccggccggcgcgggcgccgaccgcgcgtccgccgcatgcgcgcggcgtaggtgagcaacgcgggcctcgccgcgcgcgctcccctccttcgatcccctcctataaatcgagctcgcgtcgcgtatcgccaccaccaccacgacacacacgcacgcaccgtgcaggcatcgacgacgagcgagagcccctcggcggcagaagacactcacggcgatggcggtgacgaggacggcgctgctggtggtgttggtagcgggggcgatgacgatgacgatgcgcggggcggaggcgcagcagccgagctgcgcggcgcagctcacgcagctggcgccgtgcgcgcgagtcggcgtggcgccggcgccggggcagccgctgccggcgcccccggcggagtgctgctcggcgctgggcgccgtgtcgcacgactgcgcctgcggcacgctcgacatcatcaacagcctccccgccaagtgcggcctcccgcgcgtcacctgccgtaagaaaacgaataaaatcgatttgctatctatcgatgattgtgtttttgtagactaaactaaacccctattaataatcaactaaccgatgaactgatcgttgcaggggctgcaggaa

SEQ ID NO: 60269 - DNA, 5529 bp, Oryza sativa
ttttccacgaaagccgattgaaacgaaaccgcgaaattttgatgcgagatgaaagcagattccgagtgaaattttaaatggttttcaagaattcaaatttgaaacaggaaattagaccaaaatttagcaaaaaccgtcattaccattaagggtcaagatccgaagctcaatcaggaaggcgaaccctgctttcgaccttcttgagcttcaagataaaggggcaatttctttgccactaaaagaactcgagcaaaataaggaataagcacaaagtagaagctagagtttctgtcgtttgccctgtttgatcaaactaaaaacaaaagagaagaaaaatcagcaatgtgcattgccacaatgaaactggctcaggagaactgtcccatcgacactctttgaaacgaacaatgtcatatggttttaactaaaggtatcatcatcctataaatatcctggctccatgttgtttatggtttaccctgacattaacatcgaactcaaaaggagagaagtatcaacatcacggcatcaccgccatttcacaccgcagaagaggactctcaactgaaccataaaccagtttgtactatttttactaacaaaagcaagatgcaagtataaaaaaaaatgtaaaaacacaactttctgagggtgtccctaaccatgactaaatctttcttcactattctgtaatcttttctagaaataaggcttcctgcttgcttgttaggcccagatcactaaatgacatatcgccctcaccagtggtgaaagcacgccttgggtacgaccttacctgcatgtcacagaatggtacatgtatgagttccacaattgtctcagactacacaatttctaacagttccacaattttaacaagagtgaaaaaggaaatgcccactcaaatcaaatggtagcagctacactgtggaaatggttttccaagcatggcagtagcctattagttttaaaaactttgatttagcagaagcccttcagctaacaagatcagtagcctattagttttaaaaactttgatttagcagaagcccttcagctaacaagatcagaagtcgcacatactactagagtatatcaccagaaaagtcagcgaaggagcagcaaagaaacactttaatgtaccctgaaatgaatctccctatcctttagaagctaaactatggactcgtcgttctcacatccacaactagattcactcttctgggagtacagataaaatatatgtcgtcaaataaagggggtgaccttcaaaaaagaactaacagtagcgaattaccagtctgtaggttcctggcttataagtcctgccaatgtctaagaaatcaaaaaggaactgcaagaggaaagcatgtattagtggttatccacataaaacagaaggacagaaagtaagcctacctgaagtttatgagatttcagaaagcgacgcccctgtcgactaccatcaggcatgcggactacaagtgtgacagcaccttcctcgtctgcagctggctctgacggcaatgatgcttgtttggatgcaagactggactctagctcctgtttgcataaaacgtcaggaaccacatcacacacattacaaatggtgcagaatacaagtgcaatatgaattaaggaaataatggacaaagcctcaatggaactgcagaaagaaagcaccaggtttgtcatacagctttataagaacttgatactgctttagcgaattgcttgtcaacaaaatgtagaaaatatcaatataataatacaaaatgtcaggaaagaagatgccatgatgctaggtagtatccatctagactttatgcagagtttcatcaagtatatcaaccagcagctaagcctcaaagtagaaccctttgtaacatataaaatagagcagatcaccagagcaccaagtttcatatgctcaaaatgtgaacttatgatctaaatacctagcattcaagtattgaaaagactgttgttgatgatcaattaattccataattatttttaacgaaaggtttacctcttcctccagttgttttttacgcctttcctcttcctcttgcttctgtttttcaagggcagcttctcttgcagcagtttcttccaggcgacgaagctcggcctcctgtagggccttcaactctttttcttgatcagcttggagtgatgcaaggtattcatcatcctgtaaatcaaattaacagtcatgacaattcattgcatataccaacaaataggtcaaactaaagatcaaacctgctgctcacgtaacaaccgctgttcagttaatgctggtgatggagcatgctctacatggggataaagacttgggcttctatgagatggcattgagaacggatacatgggtccttctggaattccaccaaacattgcagcctcaagcataacagcttcatatgctcctcagaagaaatgccaccccacttttccaaaggaagaggcaaacagtgaataacatataatttaaccttagggtgaagattagtattacagaaaagaatacctctgatggaaattcatctccattattctggcgatcattcaaatttccttgaggctgagaacttgagggaggactatcgaccgtgtacacaggttgtgctgactcagtgttccagaagggatgcgtctagaacgacgtctaactaatggctgttcttctacatcttcagtctcctcttggagggtatcttcatctattggctgcctagatgatccaaccttttctgtagctaatccttgcctccgaaaagaaaggacacgtataagggatcaagtgctgggtagcaagaggattaaagagcatgttagtaaaaattaatattcaccttccagctgttccgcttgcagttcccttgtcctcttcatcaaaagaatgttctgtaatgtttactccctctggcggctgtgttattccttgctctgctgtctaacatttttgaaacaagtaggtaaggcacatgaaagagaagtttaacaaaagcgtggttgaggaaaattaatacacttgcgaataaaggatcagctgtagcaagctcattctaatcattcacatttttatatgggagaaaagaacacatggcagactaaagcaaaggagatgagggtgtgcaagcttacaattgtcattgcctcagcatccctttttgaagcttcaattgctgcccggatcatttcctcttcgatatcattgtcatagtcagtaacatgaaccaatggaggtgcagttggaatagaagggttcggctgcaatgagctatcaatattagcatgaagagaaggggcagatggctgctcatcatcatcatcatcaattacaatagccccacgaacttcaggaccatatgaagattcatgcccagtgacatcctcgataataggggcctgaccagaagggcctgtttgcgggttgctatccttaacttcgataggtatctctcgcacctctctagggtgtgaaacctgtgggccatgaccgaaagtatctgtggaaccaactctgtcaaaataattttgctgaaagtttgtgtccatcagtgcaaaagggtcacgcaaagtttcagggaacaaagatcttctaaatgcattatcaagtggtccatccaggtccatcatatcatcatgactctcaggtatattgttttgactggctctgttcctgtagaacaccagcatctcattcatcagttctagcagtacagtgtgggcatatggaaagcaatcttatatgtaaataaagttggatggaaaatagtaaaggtgtacactgtactgtctccttcattgaaatgtgcattgattgccgtgttaaggtcgccaccatgttcctgagttacagtgatgaggtaagccattataaatagatgaatatagataaacccaaaggaaaaatatcattgcagttaacaatcatttcagaggtactccctcacttactaattaatcatggtatattcccaaatgatcatcatattagtattcattaccaaagtctatttgttatttgtgcatgggagtaaatatccgcatacatccatgcacacaaccctctacaaccaacatgcaatgtcttgttttgttattatctaggaagtagcggggatggtgcatgcattgagtttgttaccggagtaaatatagtccagtatttactccaggagagttattggctttccttggtcttggtgctctcatgtaatatgatgatcaattgggaacggagggaataatacaacagagcatgtctgaggaatttgcactaagctcacttaccttttttttttcctttcctcccacacgcgactaagcccaggacagatcacactagatagaagataagcaaagcagaagagacagggacagggatggctagattgaggtgaggggcgtatggccattcgaaggtactctagatagcactatacccagctgtgttttttgtgttcaagttaaaatcaaacaaccaaatatcagatccagtaatccagcacaccggatggtagggactatggacaaaccatgaattgacagcttgcgaaaacctaactacctaagttgagttattgaacactctagatgagcaatcacaagaatttcatacaaactctacaagccccaacttgaatgcgcgtgaggaagtcatatgaaactggaactacaaatctaacagggatatggtatcaatgccaaatcaatccgagattccgtgaccaaaacccgcgctcccaccaaaatcagagcgcgataagctcgcaatcagacagagctaacgccacgagatttgttccaagcgaattcaattccgtaaaagcgccttcacagattcatcacgagttcacggcaagtaaaacaaatcgggcgcacaccacacctccacctcaaccccccacatcgcgccgcgccgcatgaacccccgcccggaggaggaggaggaatcacaaacctagctagctccacgcgaccacgcccccatcccgactcgcccaaatccgcaccccctccacgagcgcgcacgcgatttaccgcacgggattacaaggggagagatgggaggtggggaaggcggggagggggggcatgtgggatgtacgcacctcgagcttgcggacggcgagggcctcgtcggcgccggtgatgctgacgaaggtgtcgatcgcctcctgcggcggcctcgccatggttggttgggttgtggaggcgacgcgaggagaagggggaaagaggataggagcgatcgatctgtttgtgtttgtgtcaatgcggtggagcagcgatgcgccgatgattcggtatgtagttgtacgggtgcttctgcgtcattctcaccgtctcagcggtcgatttcgcgataacaaaaccaaaaccgacctttgggcatggcaatttggcaatccacgattccacgtgtggtggaaccatggaacgtttacaaagagtagagatatgtactcctactagagttggagaattttccaaggaaaacatgtagagtagaac

SEQ ID NO: 60270 - DNA, 3643 bp, Oryza sativa
  unsure (1)..(3643): unsure at all n locations
cccctgtacctactctcctcctagtacttcgtcagaaatgaacacctcacggtgctctgcctctaacctgccccacaagtccagtaaatcacacgcaaacagacagcaatctacggcgagaggaggaaacgtcagtgtcgcactgtcgcaacaaccaacaaaagcttgactctcacaccaattctaacgtacccaccagattccagaaaccacactcgggttaacttccaagactacaccgccacaccgggaggaagcatcagatgaaacatcagcattcacacaatacaatggttccgtgcgtcagcagcaacatttacaacatcgatcataatgtgcacttgtcagtatgtcaacgccattttaaaccgcgccggcgaccggcgtcggcgtcagtgccacgcgtggtgcctccgatcaccgtgctccacgccgccgcagccgccaccgtcccggacgatgatctcccccggcggcagtagcgcaaccgccttgccaccgtggcgccggtgcttgttgagcttgagcccgtccctgtgctgcacgccgagcgccgcctcgtgcctgccgtgccggcggaggatgacgtgctccgccgccgccgccgccgccaccgggtcgtcgtcgtcatgtatgtggaggacgtggtggcggcggtggccggcaagctcggtcttgtgcctcttgtgcgcgtcgtggtggtgggagtgcctgtggctgtgagctctcttgtgcctccggcgcgcgcgctcctgcgcctccgacccgaccacgccgtcccaccaatagtacagtggatcgaagagccctttccggtgcagaagccacaggactgaaagccaaaatgaggaacatatgttatcacgtttggtaagcaaagcacgcatggaaatgcaatcaacctgatgaagaagacacagcacctgcgacaagtagcaggccgtggatgacgaacttgaggaagctccagcatctcgtgctgccacatgagaatgatctacgaggtcagaaatgtgacacaaatagatgaagcacaagaatggcttcctactatatcaatacaaaacgccgcactgtctttgcatatggcatatagcttttgtcgatgggcatcaatcggagggagaaaagagaaagtgcgggctggaaggagtttattgacgcacctgcatgttgtaccagtgaagaaattaatcagcatgtgccacattttggcgcaccaggctttgatggcttcaaagaaaccccagatgccaccctttgtgtggttttcggacgaaccaatctagaaagttgtgttcaagaaccatgagtgtctgtgtgtttgattgctcaaggtactagattggacaaacacgctccaagataagttggcaaatgcttattaataggtaaccggacaatgctaaggttgtatgcagatctaaactacctcgttgcacttcaacaaaagcaaaaggacaataaattctagatcggctattataaggcatgaatatttctcaacctgtgttccattgttaagaactgtagctgtggttgagaattgggattcttttctgtcaagttcactgaaatctgacgccttcaaaatagctgcaatagcgcagaaagaaatcagatgtcgagtctcaagtctccaacacaggattatgaacagtagaatacatgctatgctctagtttatgtataactgaccttgacatgtatagttcgatgcttggtctgttgacgaacgcaaatcaaatgtccgaataagcttttcatcaggcttcatgataaagtactgctcctgtaaattgaaaaaaacagactaacttcactacttgaggagaagaaacttaatgactagtacataactagagcactaagtacaatgatgacttgatgatcaaatgtacacatcatgtacaacaacctcatacgaagaattcagaaaaaaaaaagatctagaaaactcaagcagtacactcaatcttgtatgaattcaatatactttgaaaggttcagaataaagtgaacaagcttggaaaaaaacagtgtgcgcaaaatcacagaatgtgattactatagtaccattacctcaacgggattgatgccgcttaagcagtcaaactgcaaaggaaaagagaaaccactgttaacatttcaggaaaataaagggcaagttacacatctagtatatggctagataaaaataaaagagtaaaataaaattttatgataaaatgtatcgctagtattcatatgatgcatcagcacatgtaagtattccagattgaaaataattgcatgacagttagaaaatcaatttctccttttgaactcgttaaaaaatagaataaaaataacaaagtaacctgtcaaacagcaatttcttgacaagatgcataccgtcaagctatatgaagcttcaagtcttccaatattcttggttttgactctagcactgccaacttgacttaaggcttcaaacgaagagatgttaatgctaattatcttccctgagcttctgaaattaacaaggaaatttaacatattacacatactgctaagcaaagaacataaattagtgatttataacatgaattgaaatgtaacaccagagtagaaaattgtgtgtaaaattgtccaccatgtcttacgtttagtgcaataatgtctgaaattgtatacatttaaaagtaaggttgtgcctactggtaataaatattcagtcgtataatgcaaaagtattattagtacctctgatagacatattctatgtcatcagcactcagctctatcatcaaattggtattgagaacttgtgggattcccacagaaaaggntatgaactcctgcattctgtaaatgtatctatcaaaaaactttatccaatgttggcatataagaagagaagagaaagaacttaaccggatattggttgatcctttcaaactttcccagaacaacgtattggggtggttggctattgtttaccctgtttttgtcaatctgaaaaaaaatggtgaatgatctttcaagaccaaaacagttttacaatttaataacaagatacttggtactcagttatgctatgatgaacaaaattaacatggaaacttaaagcacaagtgttgtagcaataagaaataaaagaaatagttacagatctactttttagtgttacctcccaaaatttggaaagctgatcgcccaagcagctgtcaagtggcgatgaacaaaagttaggctggctcctgaaagcttcatagccaactccaatcttattacattcaagaccatctaatgtaaacaggactctctccaacagcatccacctggaaaagtcatcaccaagcacttctagttgaccaccgccaacacccttcaacattttagatttagaagcacaatgaaacttcatgtgagggaaatattcttatctaaaattttcgattacctttcgtggagtcacaaggtagaagttctccaaagatggaagacttgtataaccagcaaagtcgccaactaaatttactctcagggagctgtcttcagaaacaactgttctattttctggaccaacaataacctcctggtgtgtaatgctaatttagcaaagataaccaaattttgggaagtgctttgcataatcaag

SEQ ID NO: 60271 - DNA, 726 bp, Oryza sativa
gatgagcacaagaacccggggtaggtcaagaaaccagtcacaggaatcacgtcgagaagtttttggcccatatgccacctcgggaatgacggatgcggggacccctatctgtcgaagttgcctaccgacgtagtgctgatagatatggccgaggtcgcgtgagaacgcgttcccgtaggcgcgtaggcccacgaagtagatcgacgggggaagagccttcatcaggattgcttgcacccacggcgctaccgttgtgcctgcctctatctcgatgaagggtttgtcctggagaggattgaacgcgtacttcttctgaggagacgggagcgggtcttgccactttcgattctcttccttgaacgctttcggcgtggtcacgagatactcattaaacgtccgccgcacagcatctaggtcgatcacctcaccgagctcagcgaaatgcgcaccctctaaccagcggagatcgaatatgccactgttcatcctggccccgacgaagatcaaaaacaccgaagcgacgtagtgtcgatcgacatgccactggtgatttcctcaaaccagccgggaaccatggcctctggggcgaagtctgggggctgctcgcctgccgacccgaagaggaggatagatcgcgccacctcagcaggcgcatggcgttgccccggaaactgttcgaagaagatgcgagtgagcaccttcgaaagccgctcgggggtgcaggaa

SEQ ID NO: 60272 - DNA, 13593 bp, Oryza sativa
  unsure (1)..(13593): unsure at all n locations
taatctatgtttaatactcctaaatagtaagattccagagggctaattattagccctccggatccaaacgtagattaccgacaaaactcattctagccaagcctgatttgttcatgctattgatatattcgaggtgttaagcaatataggggaaatttgtagctgtggtgatatttaccaggtgtagcggcgacgaatggtgatattggtatacacaggaatgaaaattcgagaaatatgtgttaatgagccgtatggagaaattaacttattaatatagactactaaatagcaagatttcagaggactaattattagccctccggatccaaacaagacccttatccttttgcatctcacttgtgcatgaatgatactccttctagccaagcctgatttgttcgtgctattgacagattcggggcgttaagcaatattaggggaaatttgtagttgcggtgatatttaccaagtgtagcggcgacgaatggtgatattggtatacacacgaacgaaaattcgagaaatatgtgttaatgagcagtatggagaaattacttattaatatagtagatttgctcaatttggatagaaacaaggtaatatagttgcatggattgtgctagctaatgtttaaagacaaaaaggttgttggacaatcggactggggtgaagacaaatgtttcacctagaacttgaaaatgccaatgagatgacaaaagttgtttggttatttatatcccttcagatctttctttacacttctatttccaaaagctgcaagtgtactgtgcatacaaaattgacaatggaggaccaatgtttcccgtttgttagtacgtttctgatacaaaactaacaatggagaacaaatcccgtttgttagtacgtttctcattgtttgccaggatgatgtctatatttagtaaccattgacacttttatagtacacactagccaaattttgcattcctttgcgatgattttaatgatttgggcaacacttttcgtatttgagtaccaaatcatgtagcattagacacaattgcgtggctagaaattactaaaggctagggtagggctcgattgatggactgttgatttttttttttgtaaaatttacatgatgatttaaaaaaaataaactttgattgtgaaggtcagcttatggctcaagccttatctgcgttaggcctgcctccacccctgattgtgtttcatctttcatggatttgtggctttgtcaaatggattaggaaactgagcacttgagcagtcaatactattaagcagacaacataccgtggcccatgggccaaactaattagtatgctcctggcagtatagaataaatctagcccagcttagggcggcacagtccaatccaatccaaaaacgagccagtgaactattgttcaatttgatcttgctactagtatagtatttaaataaacctgattaacatttgccagtatctaaaatcacaacggattcgactaaataagaattggtatactccacttaagaggcacgcatgtcttattaacattttctagtcacacagttcataagaccatggacaattttgatactagtactatataagtggtaatatgatcgccctaattctgctcagcattggcgctgtatccgtacggattcttcttggcccaattccactggtccctgcacatgtcctctattccaaaccgagcactgcaatcagcacaagcataaaacaatcagcatctctatcataagcacaaactataactgtcagttgaacagtgagctggaaaaatggacagacagatttgtgtgatcgttctgtagcgaatcagagaataaattacctccatccgagctccttcttggccttgtcagtggaagcgtaaacctcagtgcaatctccaggtcttctggggcaaatcttgataggaattttctgtggtttcacagccagaaacgtcagtttcgaccacattttcagattgggatttcagatgaggcgaatatcaaccatgcacacatggatgcataaataatactacatcagtcacctttccggacgcctcctcgaacgccttcaccacctcgagcaccgttgttccacaccctgttcctagattgtaagccacacaacctgacagaagaaaataaagaaattatacatcatggatgaattaaacttgtcaaacatcaaccagtttatggagtgaagaacatgtgtgtttgtagcatcgattgatgtaccaatgtcaggagtagcgaagagcttctccagtgcggcaatgtggccatcggcaaggtccactacatgtatgtaatccctgatctgaggacgatatatcaaattgtcaaaattttgcttcgctccacgatctcatccatacaaattgatcttgaacagtgtagtgctcaccgcggtgccgtccctggttgggtagtcgacgccgtagacgttgagctcggggcggcggccgacggcgacctgctggatgtacggaagaaggttgttggggatgcccctggggtcctccccgatgtcgccgctccggtgagcgccgatggggttgaagtacctgagcaggatcaccctcatctccgggtcggcggcctgcacctgccggaagtagttctccaggacgagctgccccaacgagagaatcgaattcgatgccgttagaaacaatgcttgcatagcaaaaaagcaatggtggatcatcgccatcgcaattcggcatcgtaatcaccgaatcggcgaagcgaatccgaatggcgcgtgacgggtgcatgcttatcacgagcaatggatgcgatcatgtcttataccttggtggtgccgtatgggttgagagcgctcagcttggaatcctcgacgcagggggtcttctccggctggccgtacaccgtcgccgacgacgagaacactatctgcgcgtaggtttgttgatttcagtgatcgaagcatgcatcggaatggaatcaatcaggtgatcgtgtagatgtatagtactgaccttcttgcagccgtacttggtcatggcggagtagaggttcatggtgccggcgacgttgttctcgtagtacatctgcgggtgcgcgacgctctccnnnnnnnnnnnnnnnnnnnnnnnnnnnnnnnnnnnnnnatacctgatcgatcaatggacgacgacgacgacgacgacgcgtttgattacgtgtggaaacgaacgagttgagatcaaaatcaaaaaggatttgagttagatggcttgtttgatcgaagcaaaacgatccaatccggacctcttggcggcgaacaccttctccatgtcgtccttgctcttgagatccccctgaaaacgaacacaaacatgaatctcaatctcaacctcgccggctcggttcaattcaactgtgcaagacgaagaacacgcgtgctgtttgggtgagtcacgtacggcgatgaagtcgaggcgggcggagagggcggcgccggcgatgaggcggacgcggtcgagcgcctccgggacggagttgtggaagttgtcgacgacggtgaccgcgaaccccttctccagcagccgcagcaccgtgtgcgtcccgatgtaccccgctccccccgtcaccagcacgctcgcccccgcacccttcctcccctccccgttccccaccatctcgccgttctccgccgctactcctccgccgctcaccatcgccgcctcgtcttcgtgtgtgcgcctctctctctcggtttagtagttcgcagcggacgcgggggggatttatatgggaaagggaaaccgcccgtgacggatcacgcgcggtgcggggcggtggcggcgtccgttttttctcgtgtgtggggagccgggtggatggatggatcgcgtgctggtttggaaaataaaacggcggggatcgcggcgagttcccgtgtcagctgccgtgcgcccgtgccctttttgacccgtatcaacgctggaatatcccgcggcgcgcgcgcgagccgtgtcagctgcaatggtaatggccggttgcatcggcgcgtccgcccgatcggcagtgcacgcatcgccgtcggatcccaacggagattaatacggaaggggatgagtgagaatccgggggctaactgacggtgagatatactgtatcttgtgcgtgcgtgcgtgatcacggtattctgcgagtaggcggtagtatgatcgaaggataattgcgtgtccatgtcatttgtatttggataagtttatccaaataagtttatccatggtgtttagagtgcacgtcgcttgatgacgtcattaggatatgtgttccgataaaggggtcaatttaggcctgggccggggagatcgattttttttttcgcgaacaaactaaagaattggacatcattatattataagaaatcagagttttgattacataacgcaaaacggatggtcattgtcggggccagcgagatcgagattccgagacatttatgagaatcctaaaatagctggtttttcttggtttttggtttctagtttattattttttctaagatttataaccacagatttgagtgataatgtaagtttctttggcatcttctgtcggtagtttctcaaacctggtcttaaaaccgtggcttatgatgcaactaaatttgatttagagtttaatttagacagattcttttgtcgctttcaatactgagcttttgccttgaaaccatgtgtacaaaagcctttgccataaaaatattttcattgttttgttctcctgttttcggcttataaataggcaaacctacaggagcgctacagcaaggcaaagagcaaaaggaaggtgggctttactccccactgtgcagatttcagaaagccgtggagtataagaaacaaccacagcgatagtttaatgcctggcatcacattcttgctccttttttttttctctcttcctctatcatggttggctacttgaccattccaagacttagaccctatttagatcggactaaaacttataagtccctatcacatcggatgtttagacactgattataaatattaaacgtagactattaataaaacatatctataatcttagactaattcacgagacgaatctattgagcctaattaatctataattagcctatgtgatgctacagtaaatattctctaattatagattaattaggtttaaaaattgtctcgcaaattagctttcatttatataattagttttgtaagtagtctatatttaatactctaaattagtgtctaaatatagagactaaagttaagtccctggatccgaacaccaccttaatcgcagataagcaaaggtacaaaaactaccaattgcaaggtgacggttttgatgcccaacaataattggatagacacgaaaactgattccctatcaatgcagaagatatgcaaaatcagaacaaacttccttgatgcctttaaatgggatgattctctgtgatgctttttttaatggccgtaaaataccgccagcgagatgacgtgggccgtaataacaacttactatcatgccctttccctgtgtttcttaatgggctggaacgtgcatccagggatgacaaatgggccgtaaagcccttttatctgtctttcttagtgggctggaacgtgcatccagtgagatgttgatgggccgtaaagcccttttatcatctaacttttttttttgccggcgtctccaccgtccgccgtcgccggcgttgccgatcaagcttgccattgctcgccgtcgctgcgcctgctttgcgaccggcacatagtgatgctttcaggaagcatacgttacgtacgtgcgcgcacacagtacatcccggtagaactaaagttttttatccgctgctgaagtgttgattactgaagtcgtagaaatggtttcatttcctgtgctgtgctggcgtgctgctgatgcatcgaaatggtagctccgttcagttgttcgcagatgatgtaccagaaattaggtgttcactttttttcttagtttaacttttataagtttgatcaagtttatatattaaaaaaaatagcatctaaaacaccaaaattagttcattgaatctaacattggatatattttgataatatgtttgtgttatgttgaaaatgatagtatgcatttttttataaattttatcaaatctaaagaagtttgacttaaaaaaaagtcaaagcgcttatgatatgaaacggagagagtacaactagaatgcaacaatggtcccagcaatggccactggttacttcttttctgtctcagtccatacccagatctgaatatacaatgtggccatccttttgatccaaccatccaggacaatgtcaaatggaaaacaggagaaaggtaactgatcatggggtctaccagatcaatccaatgattaaaggctgagcgcaaagagaatggtaaaaaggctatgcgagtgtgataattcccagagaaaagcatatgcatctttgcagatctctcccacatgcagaaaggtacgaagtttccttggatggatacatatggtggagtcctgacaagctgtcattttacaatgatcaggtttggagggaggatctaccggtacattatacctgatgaaaatgaaagcaaacaatgccatgccgacagtctgccttgtctttttgcactattcagtctatggatttcatcatagagaaaccagcccatacaaaagaagttttcaccactactgaaacttattccattatattgtgaccagtaagaaaaaatattgataaaagaaaataaacagaaaataaaagcactagaatgtgaggtatcatattcaaagaacagtaagtatctacttttgactccaacgattcaattatcacatttccatcacatattcagtttggaatgtagctcaattgatcatgtgaagtgtggtcttaactggatcagaacacgcttcagaggtacatatctatatcaaacttattatggcgaagagtaaagtttaaattatgcacagttctgaaccaattatcgacgaagagcggatatagcgcatcacctctccgctttctcttcataggcagcaaggttttcggtttctctgaccgtacgttcactgatccttcatcttcaatcaggcgtctaccaaggtgtgatgataaattctccacttcaattttcgccacatcctttcttactcctatgtcagtgatgtatctaccagcacagtacatcccagctgtgacagtggccattccaagtggaccagcagcaaaaagcttaagtggagtggacagaagagctgccaatggcactccaatggcggaagatgcttgcccacttgttccaatgccaggttcctcaacaggaagaagcccagttttgcagtagagtgcaaagtcctccaattgttctcaaatatgtcataatttccaaagccattttgaagtaagtacatggctctgtgtaccacaacttctgatggatctgattgggcaatggtgcaggttcccccacgcagctttgcaaggaaaacggctgatggcactccgtactcaagcagtatagagagccattccgaaggaagcaatccaagcaggtgaggacgacaccactatcaggcagctgaaacccacaatctgggaacgttgggcactctgatgaaggctctaataataggctggaggtggaattggatgaatctgatccttctgcttctttctttcgagtaaaatgaaccactttacttcctccaacataaatgcctgtttgccagtagaacatgaccaacagaagagtaagttcttgaaaacatttcaaagaatatgcaattaagggaacaccaaggctataaagtttaaggtgaacaattaaatccactggatgatagttatcatcccaaaaggttaaaaaaacactagatgataactgaatgaatcggcatgctgttaacctgtcaatccctttatcgatgcatgaaaaatgcaccttgatggtgaaaatagtgttttaaggagttgaatgcagacaagacagtttttcttgtatattgcagccctttcatccaggctgtcatgtgcaaaaacagcaaaacccacagcatgtcctccctagatgtggccctgatcaaatgtccacacaggaccactacaataaaaggagctctacatccgccaataaaatgcacttgaggggacatactgtccatttaggagaactacagagtgcatagcaacacagagcagaagtgtcctttacgcttcctgaatggagatgaaagacctctactgtaaaagaaaagagatgcattgcaaaatacccatggtaaatacacctgaactgaatggagatgaaagacctctgctgtaaaagaacaaagatgcatagcaaaattactgtggtaaatacacctgaaggtaaggataaaaaatgaacgtagccacgtagataagtttgacatcaactgttaatcaaagtagttatcaacttatcataggatactatggtgacttgagttttcagctactgaatcactaatagtacaatagtgtactaaacaagtcatttgtcaggttcagtacattatagaaccaaccttacagtacttattttattgcgagcaaccttgaattaacaagagggattcctataaaaaaacaaggaggctaatttccacacggagataaaaaaagcacagatacaaacagacaagttggtcagcagtaggtgagcagcaacaagtgccatttgttctacatgggaagcaacaaacacagcatgtggcgtcagatccatctggaagagttccggatagagtttgggcaattcagttgaaccctcaattctacgcataacccacacagagaagtagaaacattgaatcgatctttttcatgcatgtacccattttgccactattttacagccatcattctaccatactaatgttgtcaactctacacctacagaattaattatgaactgaagatagtacaaatgcacgatgatttgcgtgttactgctgagttctactacgaatctgtaaacagttaaaagtctgaacaatcactcaatcagagagttggatgattgacgcacttgtccaaccaaccacgtgatccgtacttcaagcagaggggtttgctcgagaagagaacatcacgcaggaagtatgaggcgaaagaaatcccaaatccgacagaatggaaaactgagacgaagacacgcccttcagttaccgatgaactaagcaagagacaaccccaactcgaaaattcagatcgcaaatgttccccccattgagccggccgaacaaaatttccagtccaactaggcaatttcgatcgcatttgttcctgacccagcaatcgcagtgaaatttccgatccagtagccgcacagaccaaaaaaaagggggaaaaaaatcccccgttgactcgccgagccagaatttcccggtcaagtcaacaaccattgatcagacgtcaatcgcacgagaaaattcgaagcagcgccggaggaggagagccacagagccgccgccggattagttcccaaacctaaacccgcaaccgccgccgccgccaccattggcgagtggcgacaacaattcaagcaaccgggatggcatccgaggaggaagaggatggagggggtgggcgcgcgcgtaccgtggtgggagtaggcgtacaccgccctccatgtgtagatgtgatcccccggcctgatctccgaccgctccaccctgttcgacagcagccccatcgccgccgccgccgccgcctcctcctccaccgcgtgtcggcgccgccactgtacctttctacccgtccatggcagggtgagtggggcggccaatggcgcggggctctccttataacgggaggaggcgcatgtgatgtgcgcgagcgagagcgagagcgagagcgcgagggcgaggcgtgggcggaaaggaaagggttggggttggggttgggcaggtaaagaatgtcgctgtcacggcgcacaaggcaccgcacccgccgttgcgtcgagacgagtgcgtcgcctcctcggcttcggtcgctgggcttccacttcacacccggttccaccgggctcggcggctcgaggaaattatgcgggtaacggcgaggaaatgttgcgaaaatcacatgcgtgacggcgcgcgcggagtaggtgaggttaaaaaccggcagccgtggatggggggaagcctcggatcgtgtgcgatgacccaaaggccaaattaccctctctctcttttttttcttttttttttattttgcctactctcggctgcattgcacggacaacttgttgagatgaacagcctatggtgaataatttatttactgatgttactacaggtgaaactgcacggtgatgagaaggtgaagaacaatcaggcgaggttctcgtgcagttcagctgtcaggttggtaggatgccaactccagtcacgccatccctgtggacgatctgatgacgagctcacaactatcctactcttatagagtgacgaagntcaaaaattttttgaaggctatagctaagatataacttaactaatggagcattgattttcctttataaaaattacacggtattttaataaaatttaaacaatanatttaaanggtagggcctagagctcaagccctagctatccgcctgaccctaccggataccgggcacctggcaatctggcatggactcgctgatggagtgatggagatgtcactgatgtttctttaaggtagtgtttggttggtgggataggatgtgatgggatgggacgaacccacttttaaaggtgtttggtttaggggtgagtgggatgggttggttcctggacaggaatattcctctcagatccggaaccaagccatccggaaaaatctcgtggacgagctcgtcccacctgggacgagcgcacggcgtgaggcgcgccgcttcgccacgctcgttcgctcgcaccgtcgcacgccactcgctcgcccctctcactcgcatcttgctcctccacccatcgtgagtgatgacgatggcggcagatccggtggtggggagggtggcggcagtgaatctgaaggcagggagggcggggagggctcgtcatcggtggcgaatccggaggcggggatggcggcggtggcgaatccggaggcggggagggcggtggtagcgaatctggtagcgaggagggctgcggcggtgtggagggctccgatggcggcgacagtgatggcgggcaagggtgagtgctccggccaccacttccgcatcgtcgttgcctctgactcgctcctccttccgcccgcgccgatggtagccgctcctccttccgcccgcgccgccggtcgcccctcctcattccgcctgcgccactagtcgccgctcatccttctgccactctacttcctccgcgagttgcgagctgcgacacattttctcactaacgtggtgcaacgtgactccatatgtcattcatcccatccctatccatcccttctaccaaacaaaaaattgagatcattccatccaataaatcaaacaagtaaatgggattactccatccctaaaactagggatggtatcatcccatcccacgtagtccccaaactaaacatatgctaaaagatttgatcaaaatgaactgacgtttgtttagacggaatgagagtgatgatttcgacactgcactttagctaaccgaataatgatggtgccaatatgactttggaaaagttgaaatgaccaccgatcgaacactaatctcttattatcatggacgttcattgcaaacagtgtcagcatcccatagtctagctgagaaacaggagataattaaattgagcgatcaaatcatcgaaaactttcttttacctaacaatgtcgatataatacgatgggactaaaaaaatgcggcaaaccaaatttcatgcagccaccaatttgcaacactgaacatcattcggtttcagcgcgcgtcaaggactcgagtcgatcgatgtgatattcagttttagcttatctcttgcactgtcatttttctgagattttgcaaaataaatagcacgcacttacactgtaggagcgataggagtgcacagccatgcagttgatccaacaaaacggtaaatgctgcgcgccgggcgtccgacgttagaaggaaaaatcggacgcctcggacgcctgcgcctttaaaacgatttttctcttaaattaattatccaatctacgatccaatcacaccgttatattcgttgcaattaaatctttacaacaagaccacacatgattatatttcgacaaaaaaatattttagcttctctattgattttttttttgaatattgcatattatctgtttcgatgtttcaaccagtagctttacgatgtttcactatgtacggatcaaatgttgcagtggattttgatattatggaacgtgccgttgtgacaaatcacccacatattttgaaaaccccctattaagggaatttggtttattttttgttccacaaaaaatgtttcatctagtgtactcacaatatttcactatgtatagatctaatgatgtagtgaactgaaatattccattgcaacaaaaaaacgcacatattttggaaaccccctgttaagggaattcgtttcattttttgttccaaaaaaaatatttcacctagtgtacttataatgtttcactatgaatggatcaaatgttgcagtgaactgaaacattatttcgctatttgctgaaacattatttttatataaggtgaaataacacccgatttaaacgagtgaaacattttcgatatatttagtgaaacaattccgatatacatggtgaaacatcgtgcaacatttaaaaataatttaataataagctaaaaaaaatttcatcggaatatatccatgtgtggtcttgttttgaagatttaattgcaacgaatttaatggtgcaatcgaatcatgatttggataagtaatttaagagaaaaatcagtttaaactagtttttcacgtaaatcgggcgctgacgtcatgctgacgtcagtgtccgatttttctccgaacattggacatccgagcccggagttacctcccaacaaaacagatatggattaattggagagagtggataacggaagaagaaatacactaccaccagtgcgagtgtgaaaaccgggttaacaaaaacgacccattttccatgaaattgctaatggtcggtttacaaaagacggatcgatttagcaagttgactgaaagtaatcagtcttcacccgttttcgtcaaagagtggttttcacctctgaaacgggaagataaaccttggtggcaactggcaactcgatttacatattaaaaacaagcaattagaagatactgggttacattcgatgactttggagcttactattcagaggtcgagagatagaatttctcagtgaaaacactccagcattgcgttctttcactcgatctgagctgcactgcacaaccgtgataactcgatccggcaaactttgggagcagatatatgggcgtaaccaaggttgtcagaatcgagatactagacagt

SEQ ID NO: 60273 - DNA, 9463 bp, Oryza sativa
ttagggggtgtttatatggggctaaaactttttagcccatgtcacatcggatgtttggacgctaatttggagtattaaacatagactagtaaaaaaactaattttataaatgagagctaatccgcgagacgaatttttttaagcctaattaatccataattatcaaaagtttactgtagcatcacattgtcaaaatcatggcgtaattagactcaaaagattcgtctcgcgaattagtccaaggttatggaatgagttttgtaattaatgtatgtttaatactttaaattagtgtctaaacatccgatgtgacagggacttgtatgtgacagggacttgaaataagtccctgaaaccaaacagacccttacactacaagtctatacacaaccggctgcgggtatggagaagtactctgcacacgatatccgaagctgatcgaataaaataatcgtcgttattcgccgggatctgaggcatataaaaatgggcaggagtatatgcatggacctgcgtctgcttacgttcgttcatcatcggtgagtgagggtgagagtggggggccgcccatttgactctcgccgtcgacgccgcgtgcgagtcagccccacttgcgattgattttttttaccccgtttcatcctctgatcgatctttaccgctagctgcagttttcttgggcggtaacagcagtagcggcctctgttttatctgcgctgctcgtggactctccacatgtccagctttatctaacacgcttgttattatagccattctctccagccaccctctcgcctcctcctcctctcatcatctcccatccttcctcctcctcaactcctctcctctcttcgcttcttctctcatgctagctactactactagcttctccttctcctgtcgcacggtgcggcggaagtggtagtagtagtagctttcttggtttaagcaaggatcggcgaggacggacgccggcggcgaccgagcttggggtgtgtgtgtgtaaagttgtcttctccggcggatgagctgttgtttcttggctcgcgcctccggcgtgtccggcttgttgccttccatgtccgcgacgctgcaataattcgcttccatatttgctgccgccatgccatgtatagccgcgctgctgatgcgccctccagccgttttaatgcgtgccaaatcctctccccgaggctcataaaaattattgaattgttgggatctgaggggatccgccggagttggtaggatcacggtggagtgattttggccggaggaagaagaagaagaagaaaaactggtgtttgttttgtcatttgtagtgagctcgcgtgatgagcttcggtggcatgttcgatggcgccggctccggcgtcttctcctacgacgccggcggcggcggcggcggcggcggagtacacaactcccgcctcctccctacgccgcccgtccccaagcccggcggcgggttcgccgctcccggcctctctctcggcctggtagattctcacgagcttttccacttcttttgtttgtgattctttgccgtgcttagatattgatttacttttttaaaattttaatcttgtgttggtttagcaaactatggacggtagccagctcggcgacgtgaaccggtcgcttgccatgatgggcaacggcgggagcggcagcggcggcgacggcgactcgctgggacgcggccgggaggaagagaacgacagccgctccggcagcgacaacctggacggcgcctccggcgacgaactcgacccggacaacagcaacccgcgcaagaagaagaagcgttatcaccgccacaccccgcagcaaatccaagaactcgaagcgtaagcgtcaaactctcgatgacatcaggaaaaaaaataacgaagcaaattctgatttttgatggttttttttttctctacgtgcgatcgtgcagcgtgttcaaggagtgtccacatcctgacgagaagcaacggatggagctcagccggcggctcaacctcgagagccgccaggtcaagttctggttccagaatcgccgcacccagatgaaggtttcgcttgctgttgcacagatcaatccatgatgatgtttgattcttctcgtgttcgtttgatcatgattttgaatttttttttggttcgatttgtggtggtggcgagcagacgcagatcgagcggcatgagaacgcgctgctgcggcaggagaacgacaagctgagggcggagaacatgacgatccgggaggcgatgaggaacccgatgtgcgcgagctgcggcggcgcggcggtgctcggcgaggtgtcgctggaggagcagcacctgcgcatcgagaacgcgcggctcaaggacgagctcgaccgcgtctgcgcgctcgccggcaagttcctcggccggccaatctcgagcatctcctccccgggcccgccgtcgctgcaggcgtgctccggcctcgagctcggcgtcggcagcaacggcgggttcgggctcggcgcgctcggggcctcggcggcgatgcagtccatccccgacctgatgggcggctcctccggcctgacgggggggcccgtgggctccgccgccatgcgcctacccgcgggcattggcggcctcgacggcgccatgcacgccgcggcggccgacggcggcgccatcgaccgcgccgtgctcctggagctcgccctcgcggccatggacgagctcgtcaaggtggcgcagatggacgagccgctctggctccccagcctcgacggcgggttcgagacgctcaactacgacgagtaccaccgcgcgttcgccagggtggtcggccagtgccccgccggctacgtctccgaggcgacgcgcgagtccggcatcgccatcatcagcagcgtcgacctcgtcgacagcctcatggacgcggtacacacgcacgcacgcacgcacggttaactccaaaaacaacgcatttgtttaagctgtgtactgacgcaatgcaatccgcggccagccacggtggtcggagatgttcccgtgcgtggtggcgagagcgagcaccacggacatcatctccagcggcatgggcggcacgcgcagcgggtcaattcaactggtgagccatcgatctcccccctctcccctcgccgcgagctagctgttcgtccatggcgtctcgccggctcagacacgccatgccatgccatgcgcagatgcacgcggagctgcaggtgctgtcgccgctggtgccgatacgggaggtggtgttcctgcgtttctgcaagcagcacgccgagggcctctgggcggtggtcgacgtctcggtcgacgccgtcctccgccccgaccagaacggcggcggcgggtcgtcgtcgtcgtcgtacatgggctgccgcctcctccccaccggctgcatcgtgcaggacatgaacaatggctactccaaggtaattaaccaaaccaaaagcaagcaaaaacttctacacctttctcccgtcgattgtgtttgcacttgcacgcacggcgcagcaagcatgtggcggctacagtggtggcctggcccgagagagacaccgccattaagaccttgtacagctcagtattttatgctgggtgaatccaaagccgcgcgcgccgcgacgacggacgcggcgcgccaaccgatgcagcgtcgccaagtgcccccaagtcaatgcgcccccgtacgcgcgcatggtggtgatgaccgccgtggacgcgcgcgcgcgcgcgccgaggcgcgcgtaacaacaacggccggtttcgccggcgacgactcagcgactcgtcgtcactcgcagcagcagccagcaactgctgcttgcttgaccttgtactgcgagagagctaggcgtacgcctcgttagatgagctctcgattttgaaatgtttcgatgcttccgcagcccaatattctcgctgcgtcgtccgtccgtgcgtgcgtgcgtgccaccaagatccagttttttagtgtttctttatggagttcatcacagtatttttatacgacctcgagctcttggttgcactgtggtagtagtagtactatattactgtttctttggctcatcttctctgcgatgctactgtggtggagtagagcttagctagggttttttcgcagcggtcaatcctgaatttctggcgacgcatgccgacctctggatttccactatgctaacacttggtgtttgttattcatttcgactgatactaacacagtagtctgtcctcttgtgcgatggctgcttccggtgctggggttttaccatggtcattttgtttttggggttttttttgcgtgccttttgctgctagctgcaaatctgcaatgtctagttattgttactgctacgtgatgaggatgaatgcacccgtctttttcacctgcctccgccattactgccttgtcgaggctgtgacgaagctgagctgagctgagctcgccgtgatggcagtaactgattcacctgccggtagctaggctaatgtgtgtgtgtgtacgtgtgggcaggtcacgtgggtggttcacgcggagtacgacgagacggcggcgcaccagctctaccggccgctgctccgctccggccaggccctcggcgcccgccgctggctcgcctcgctccagcgacagtgccagtatctcgccatcctctgctccaactccctccccgcccgcgaccacgctggtgagctcgccgttcgtgctagtgctagctccggtggccggagttcgatcttactaatggttcttgtggttttgcagcgataacgccggtggggaggaggagcatgctgaagctggcgcagcggatgacggacaacttctgcgcgggggtgtgcgcgtcggcggcgcagaagtggcggcgcctggacgagtggcgcggcgagggtgggggcggcggcggtggcggcggcggggacggggaggacaaggtgcggatgatggcgcggcacagcgtgggcgcgccgggggagccgccgggcgtcgtgctgagcgccaccacgtcggtgcggctccccggcacgctgccgcagcgcgtgttcgactacctccgcgacgagcagcggcgcggcgactgggacatccttgccaacggcgaggccatgcaggagatggaccacatcgccaagggccagcaccacggcaatgccgtctccctcctccgtccaaatgtaagtttttttcatcttcctacacatgaaaatctctactactcctacataaaaaaaaaacctggcggtggtgatggtgattgtggtgaatctgccttctagagttgataggatcttttaaggctagataaatggggtatatatatatatatattaaaataagttgcaatgtacgtattttgttattgcaagttacaacaaaaggactatgaaaaaaagacacgaatattaggaaatgatctaatatcaaataattagaaggggtgaggtttcgaattcagatcgtctagcgtaccaccttgtggacctagccagaagaccctgggcgtttctcacaaaagaactatactagtgtacataaactagaaggttgtagtaaatttatcattaggttcttttggttgcaattctttagttcttcaaggatagcaagaaaaaatattgtacagggccctgcaaaagtgataaaccctaaatgcaaaagagggagaggcactataattaagctgaaaacttttacctaattaacatggcactgagtgagcacagcctatgcattagctgcacttggcagttgttgctaaagctttacaacatttcaattagtagtacctagtactgtactaccatgagggtggctggttgtatgcctgtatgggtaatgcatgggctgagactgatgagctagcttagtgagtgacagaagcaagaggacaattcggaaaaggataaaaataccgggttgacatttgtgagagaaggctagctgttaactttctccatgttttggaagcttgcttgcagcctagccttgctgagttgctgcccttgtcctggctcagaaagcctgtcaggctttaccccgtgtctcttttttatcttttcttttttattactttggagaggatgacatctttttcttgtttttaacttgcaactcctgatttctgactgcattgattctggcagttgctgcaagcacatactagtgctccatggttccaccaagactgctgttacaaaattgtctccaaaagtttaggatattttatatacatgcagttgttgaaactagaatgtactattatgatattatctaaaaaaagaaactagaaagtaccactctctccgtttcaaaataagtcaatttttatatataaatctagatataggctatgtctagatttgtgtacaaaagctaacagatgaattagatatgattcatataccaatttttcagctttgcattttcaacgaattttcatggtatggcaagttaaaattttccctctagattggagaccactttacaactttcatctgcaccagctcattctatctggttaatttattcctgaacaatgttcgaattcaccaatatatgttcaaacccaccaagaaattcttgccttgaattaagttttgttcacttctcatatcttgaaaaaacaaatactaatgtctctcctgcaggccacaagcgggaaccagaacaacatgctgatcctccaggagacgtgcaccgactcatcgggctccctcgtcgtctacgctccggtggacgtgcagtcgatgcacgtcgtcatgaacggcggcgactccgcctacgtctccctcctcccctccggcttcgccatcctccccgacggccacaacaatggcgcctcgccgtctccggcagaggtcggcagcggcgcctcgccgaactccgccgccggtggcggtggcggtagcaacaacaccgggtcgctggtgacggtggcgttccagatactcgtcaacaacctgccgacggcgaagctcaccgtggagtccgtcgacaccgtcagcaacctcctctcctgcaccatccagaagatcaagtcggcactgcaggccagcatcatctcaccatagataagtggacatttgacgtggattccgactcgaccatttttgagtcgaatcggatgccatctcaaatgtctaacttttgaaggttagaagactgagaggacttccgcggcgggcgatggccgaccgaaactggctgatggatgcaactcaatcgttgatcaggtagagttttcgagaggcgatatgcgagcgaggataaaaataaaattaagttatatatagtgtgtggagtatatttgcatagatgagcaaattaaatggggtgagttgcagagggatcaagtcaagaacgaaccttgcgctaggcttggctcaagctgatgtggtggttcgggtattgacttagtctctggtgaaaataaacccctagggctttgatctcctatatatatctagcagtttgcttaatttaaccattttgtgaagttttttttaattctccaaaatgggggaaatatagagaaacaatactgatcagatccccaagatcgttggtgtttgtttagtttgcataatgttggaatgagttgatatataaacatgtttattttggcatactatgtttaatcagaatgccgttgatagattaattgagaacatcatcaaaatcatatttaaattttcaattttattctatgtttgtttatgcattttttttggaatcatttttctatcatggtatcgttttaaattgtgaaggaaaaagtctatgtttttctattttagaggtttcctccttgggaggtctcccaactattaattgagaagtaaaaaaatagagctgtttcattgacaaaatacatttctcatcttaagaggtatatataaagcgagatatgcatatctcatattattggtcagaaggtttattcgtcttgatagagccacaagggtatgtacctcttgaccaacagtccaacactaaatacctctacatctaaaaaggctcgaaaacaaatacaaaagagattttacaattttactcccagttattaaattaattttgatactcacttgattttttaataatgaaattaaatcccagcctctatataataagatggacgtacacgacctttactatatatcagagtcctggtttatcacaccataaaatggtatagatgctcaacaaaacttacttgattatagggaatatcaaacacatatcgtattagtaaactttcatgtatgcttaatgaatatttccagcaaacaagtacgtatttgcaaactaaagggagtgacgataattagagaaacagtgagaatccttacttatttaggttggattgaatttctaacctcaaaattttagaaatatgttcccgtcagttacaacttactaattacagtgttaacttgaaaattttaaatgaagtaaaaaatggtaaatagaagagggtagtacaactttgtatgtacgtctggttagctagttctgtgttagagcaggtaattaattgcagcatcacttttcggccccctttgattcaaaggaaattcataggaattttagaggatttctttcctataggaatttttcctatatagccctttgaatcaaaggaatggatcttatggaatcctatgaaattcctatggattgcctaatgctatgcaaattttggaggaattctaacatgaggtaaaacctcttggaaactttccttttaagtctttatctctcctctaattcctgcgtttttcctgcggttcaatcaaacgactattcctgtgtttttcctgtgttttgcaatcatctattttacacttacattcctatcaaaaacctgcgtttttcctattcctatgttttctcattcctgcgattcaaaggggcccttcctatccaaagcatacatatatgtacgtgaaacataagttaagagacatgccgtaatgccttgttaattctctgtaacacatctgtcagtaagtcctttgttgcttgtctaactttgtagtatcaagctgattaatgtgcatcagttgtccgatatggctctttaattatgtacatcgacattaataatgtcgagctacgtgtgtatccgcagttagtgtcaacagtgtggccattgttcatgacagcaacatactgagatacccacatttagtgtgatgctactttcttggtcgatcgctcatccctatccttttatatttagataacggtaagcaaccacttttgggcttttggcctctaagcacgtcatattatattgtcaataacactaataacttcctgatacctcaggtaattagatataaaaaaagtaaattttattttggatcactttttattaccaatatttcgtttcgaatcaccatttaaccaatgtttttcagtttggacaaggtatttttacttttgtgtcacttt

SEQ ID NO: 60274 - DNA, 2115 bp, Oryza sativa
tgcacccctcttaaaacattttgtttatcactataattgagaagatagtctgcggcaatatagttcactcgagagttttaacaaatctggaccatgcaccaaagtattactacgtacaacctgcgtatcgtactatctttgctctctccaattttgaaatactctcggtataagttttcgagaggcagagtgtgcactgcacattgcacacattgaggggcgctttgaatcacaggaatgaaaaaacggagaaataagaaaaacataggattctgacaggaatgcaagtgtaaaacaggagattacaaaacacaggaaaaacacaggaatttgaagagagatagagactcaaaaggattctttccatgaggttctacatcatgttaaatttcctccaaaacttgcatgaaaaaagacaatccataggaattttataggattctataggatccattcatttgattcaaagggccatatataggaaaaaatcctatagaaataagatcctctaaaattcctataaattaccttttaatcaaagggccctgagattggcctcgagtttggctggtagcctgatgtaaacagatgactctcctcggtgatgaaagggggtacatcagctaccacccggtctcatcttttcgtttatacttatacttatacttattaactaaattttaaatttataactttaaattaaagctgatttttggaaacttttcattaaaatttattttaccgtctttacttttaaatcactaagagcacgtattttatttgcaatatatataccgtttggagccgggtaaggataagcatccgcgtccgttaactgcattggtgtgcgggtccctctgccgccgggcgggcaataaattgcgtttgctgcccatcctgcgcaagctcagagacggctagctgatcacaaattcacaagatctctcatatccttgccttgcaaagttgcatgcacccccaccccaacatctgtgcctcctgtctctttgcgaggacgtcctttactaatacttacatattacttttttttaaaaaaatgaaaaataaatcaggaacatactcctccgtaaaaaaaaactaacctcctagtacaacagatttgaacagttttttattttttcaacgtagggagtataaaatgcaggaatacttgcagccaggaatgaatgttatacttaggatttaaattgaaactcacacgaaagttgtgtttagatccaaagtttggatccaaactttagtccttttccatcacatcaacctgtcatacacatataacttttcagtcacattatctctaatttcaaccaaaatccaaactttaggctgaactataaacagccgaactagcgctcctctttcaacaccggtgccaagaaagcaactgtacgggctgtagacggtggaaaaggcccgtggagacggagcgcgcggcggcgctaagcttttacacggaattcgcggtggatccagcgactttcctagcgaacacggcgactgatcgaacctgccccgatcgggcgggtatggccgcagctgtaactgtgcacgtacggtacggcggccactgttgactgttgggctcccgcggaagatgctgcttctggtctgtagcgaaggcgaagtcacccggacaccggaagcgacgggacggccggccggcgacgtcgtccgtgcagccaggtagttcgttgtactagaatgaattatatttttagttaggttagattttttggggatggagggagtagctgcgccatccggtccagttttctgtagagaacttgacatatagctgtagctagtagtagcatccagccactcaatcctttgcaacgacagatcgaccgatgctatagctagtagtagcatccaaaggtttactcactccgttaaaaaaaaaccctcttaggacaacgaatctggactaagatagttcggatttattgttctagagggatggtcatatcccctcctagtttaatttttttttgaacagatggagtacggcaaatagctgtctgattggttggctaccacaacttaccaccatgtttgattactccctttgttagtatgatttaagttttttaa

SEQ ID NO: 60275 - DNA, 4443 bp, Oryza sativa
  unsure (1)..(4443): unsure at all n locations
catctcttttccattgttaaaaaatggtcatttcctactctattattctccaaatcagctctccaaggttgtaaagcttaaactgacgtagacatgcaacaaacaagcacaaatggaagttgtgctgtacctgaagattcgtccttttttgacctttgtttattatatttgatctcatacaacaaaagagtattcatttccaattatttcgcgagattttattcttatttcaattttcacctcacgatttgttttttcccctgagctgttcatttcaatattttttgtagaaaaaaaaactcttgcccatcttaaactagttatctttttcatacatttgcatgtcaggcatcaaccagtaccaaacacctgatgatggctcaaaaaattgccatcaagatgtccattgcaggccacacctggaaacagataactttaattattattgcaacaaagctggttcagatcaggaactactactaaagtgctaagtagcacctattattggcatgttattctacacctccttttggctgaaatggccaaactctctcttgatccagtgaccagttccagtcaaaaatggggcaaactgacacagacagttcagaagaaacacacaatgagtggattaattgctcaaacatgcaggttgccagatttatctgatgctactacagctctgaaggaaatttttgcatagatgtcatcagttcagatgcatgcttgaagcatagatgattaatgttcatttaatcatttattggttggtgttagttgttagtgctactagtagtgtggtacttactctgcatgacaatatgatactactagatcttatccacagatgacagattctatgccaaacctgcagcttgtattgtttataagcaatgcttcctccactagacaaaattgttgattgctagctttacacaggaaagaatttgatgagaacatcaacaaggcatattaaagtgaggccttgcaaagtttcagttagacagcatcacgaaaagatcaagagtcttttccttttctttttcatccagaggaaactaaaagaaacatctagtttagctaatgttttgctttcatgacacaaatctctgctcttcaggaagaacttatcaactgaactgaataataatgacaggtagaccttttctctacagtgaattaaaccgtgtcactttcagattatgtgctgatctgatcagcaaaaaccaacgaaaaataaaatcttccatgtagcacgaactcgtgcaaatgcaatgtccttgactttagttggaaagtgaaatgtcctttgcacggctgcatcatctggacctctattttattttatcttttttcttaggattggactatggatgttgcatcttacttgaagcttaaaggcaatcacgattgattgaggggtatacgtggttgctcactatgacctgagaggaaaaagaaaagctcccttttcttctggactctctgaacttaattagtatttgcagcgattggtgacgtctaaagatcagcaaactaccattatcattgaaccagctaggcatctcaagattgtttttgacgaacaagacatctgggttgcctctcatccactttcggcaccgtctctctgttctccttttcctattcggaccgtagcaggtgcactacagtccacaacattacaactacagtatatcaattacaattattttcttaatctttcacgaacacgcagaataattacaagtcaatatattagaaaaaatagaggttttgttatacaacgtaatcagtaagacagacctatgcctagagggaaaaagaaaacacaaaatagaaaagaaaggaaaactactgttgaaaacactgatatatgaccgataaattatagaaaaataaagtaggatataaaataattgataggtaaaatttttatatatacttatttttgtctgtttaaaattttagataacaacgtaaatgatgaaagacatacttcagtattaaaaccagtaaagatttgattgatgaattacaatctcaccagtgtgatgaaatctgagcattgtagaaagcaggaagggggaagcagaaacaaccggaagcccacagccacagttcactacaagttcagttaccagtcgcagttggcaatttcagataagcacagaaactctcgacatgtctcatgcgaaaagtctatacgtactaactttttcttattaaatttttactaacactgacatgtcatgctatgagtgcatctagattttttataacttctatctacttgaattaaacggttgagatgattgttaatataaatttagtaagaaaaatttagtatgtgtagcggtgctctttctcgtgagatggacctgaccgttcgcccgtctcggttcatgtcaaaatttaacaagatcagcatatgaccatggcggctgcagccagcgaacgagagctcagctcagagctcaagagaggggaaaaaaatgcttcgcgataaatacgatatttttttttgagatttttttctttttgagaattcgataaatacgatacgaccaataaaaggcaagcgagcgacagcgacgactcgcgccaccccgccttgaaaaaagctcgagtctttggcctttccccatgggcgaaaaatccagcctttttttgagtctttttttcaccatcggtgatcacacacacggcacccttcttcccggcttttctgctgctgcccatcgtcttctcccccctcccctcgaaaccaaccaaccttcaacctaaccccgcaagcaaacgccctgaccgactaaccctcgccaccgagcaaactcgagacccaaagccacgcaactttctttgtgttctttgatttgttcttggcaatcgcatcagagatctattgattgattttgaagcagaggaggagcagagaggtagacgaagagctgcaagattctttgcctgttcaatcgaccgtgctttgtgagagcatacgacggcggcggcggcgagggcgcggcgtctcacctgccccgacggcacggcgaccgaggaggggaggccggcgacnagatgggctccttgccgctgaggagtggtagcagcctgcctccaccgtccttctccaagtcgccggcctcgctgctgctgctgtccaagtcgctcaccctctactgctgagagagctcgagctcgagctcgagagctcatgggcggtgtcacctcgtcgtccgcggggggaggcggaggaggggagaccgcgctgggggacctgccggagagctgcgtggcggaggtgctgcgcaggctggacccgccggagatctgccggatggcgcggctcagccgcacgttccgcggcgccgcgtccggcgacggcgtctgggaggccaagctgccgcgcaactacgcgcgcctcctcgccgtcgccgccgacggggaagccgccgcgctggaggcgatccccaagaaggaggtctacgcgcgcctctgccgccggaaccgattggacggcggcaccaaggtgcgtgctttggccgcaaccctttttcgctgtgttctatttaaggctcaaaaatcatgtagtttgcgaacttttgcatgtttatgttcgtgtgaattgatactagtttgtaacacaacattgtgttgtgatcttgtggaaattattacgcctgtgattaaccaaaagtataaggacttgaaatgatcttattggttgagctatggcttataaaccgagaaaaaaatgaacgaagcaactaaaaatggttttaggttaggatgtttgtacttctactctttagcagtttaaaagttaaggctgaaaaataggaagtggtgaaaaaaataactagattaagtttcaaaattcaagttgtggttctggcttataagttcatgggataatgatttgtgcccttgtgtttggattgttttggtctgattagcttcagctatctgtcaatttgagaaggagctaagttacttgtttatttaaagtctctcaggtttggattgttgttttcgtcggctatacatatgaaatttgttttgttgaatgtgtaggagttttggctggacaagggtggtggaggtgtctgcatgacaatctcttcaagggcactttcaataactggcattgatgataggagatattggaatttcattccaaatgatgagtcaaggtgccttcaccaaaaccaactctcagatttgcagcttatactggctaccatttgtagaaaactttttcaatgatttcatatgatacatagggatatgaagaaagaaatatagtggcatttaatctgttgaattttgtactggaggaaatcattaattcatctcatgtgaatttgttagcatttaggatatgtagttattgattaccttatgttagattttaatgttctgttttcctgtgcttgtgttgaa

SEQ ID NO: 60276 - DNA, 1492 bp, Oryza sativa
  unsure (1)..(1492): unsure at all n locations
catgcggttgcttatctctcacaaatttggtggtttgaggtcagaggggaggttgaattctgcttcccagaaggtacatatagcctatttttccgtcttcatctaggcaggccactcaagcgactaggacgacgggtttatagctccgagcacatccatggctgggatataaaaccagtgcgcttccagctatcaacttctgatggacagcaagctcagtccaagtgctacttaactgatcctggggtctggatcaatcaccacgtcggcgatttcgtcgtgaagagctctaatgaactagtgaagatccaatttgcaatggttcaaatagattgcacacacacaaaaggtggactctgtgtcgattccgtggctgtaaaaccacaatacctcgcgaagaagaaagcatctcggatatatgtgtaggttcttcgatcaagttcagctgattctcatcgataccgcatagctttgtttttatgcaccacttgtgtgcttgcttttgagttttttacagatcctgtaatatgtagttcatggggtaagtgatttttatttcctcttgtccctctagaagcatgttacacttgtaaattgttaatttagcatacagatagcttttgtggctcatgatccttgacaccctgtgcaccaatgttgttcttctggtagtgtatcaaaagctttcatggagcaatttcatcctcaatttctgagttctcgacttaatgagaagtgctagtgcgttttgctcatcagtaacttctgaagccattttacacagttgtctgatatgttgctgcagttcatcagcctgtaactgttgaggttcatgcgcaaagcaacatgcttcttcagctctgctcaattaagaaatactaaatttgtgatctggttttcactttgattccagaaaatgataaattaaagcagcaaacaaaacaatattttatccatgatttaagtttacaacagcttgtggttatcagtaatcaaatttcagctacaaatcaaacgtccatggatagctttcgctctaggttgtacaggacgctggaccagtggatcatgaaagaatcaagctaaaggcagcttgagagacatcattatgcaccatctccattccttcgatatggcatgtagcgatgatctttggaggcgttcttcctccgccgcttctccatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60277 - DNA, 969 bp, Oryza sativa
tacttcctcaaacaatactccatgatgaaaccaatcttacatacagaggagagaaaagaaaaattggtttggacaaaatgggaatgcatttattagatatcgtcgattgtcaattatttatgaaatgataaagctatcaagagttacaagtgtttgtaaacatatattggtggttttctaattttttgcagatatattaaaaatgtgctgcatatatacttttctcacacacaattcatgttttctgctacaatgaaccatctttagggattgtgtttactacctatttaaaggttcattggcaacaagttctctcattcttccttttgtgagttaatgtcaaaatcaatcagatatattccaattttctctttggaacaaaatgaaatgagtgccatgcagaagactgctgaatgtgctacttatattgaaacaactcatatgcaaagaggttatacagtttttatctagcactaagtaattgtcgagtcacctacatttgttgatatgaagagccaacacaaatgttgatattttccaaaaatcaactgaaacgtcgaatttgaaatcaagttgtagaaaagggtaagaaggatgtgctcatttcaaacaataggagaactgtaaactatagaaacttgaagtcttaaggacactacactaaccctgaagtcactcgccatcataagcaaagtgccaacattatctgtctggaatctggactcgtcatttaggggctctttggctaggcagcagctgtatgtttcagctttagagttgtccttagaatccatctcattgagaaagcgtacttcaattgaaatctataacttcctcgcattctgggaagttcgtttttttattgtctacaatttttgtagcaactacaagcattaggggaagcagtaggaaatcaatccagaggattatctgatgacctgatatgctatttggtgccttttaagaaca

SEQ ID NO: 60278 - DNA, 965 bp, Oryza sativa
gtctagtactactctactaatggtaaattaatggagattaaccacagtgcatggtaaagaatttctggctttttattattaacacatgtatgagatctaaagaaaaaaagtatgatatctatctattgtacccttcttaaaccggaagcaacatataaacatttttgtaatatgtccagttgtctgcacaaaagttaaaagcaaaaggcaacaaaacaaggactcatcttgatttttttttgtttcttttaaacaaaaaagaaggcctgggtattagccaagctaggtggccttggaatggacagcaaaaggcagcgatgatagctgcagcctccctttgtgcagcacacactgcactgcagcattgcagcaatcctcctctccaaaagcaggacacaccatcactagggtagtagaccaccagcacaccgagcctccctcaaaagcaagcactgcatgctttcaacataagcctagcctctagccatccatctagctcgatcaccacagttcttagccgaagagaaagaaagttaattagagagttcatatatagctgaagtaatcaagaaccaagaagaggagaggaaggtgatcgaggaggaaggaaaggatggtagcggaggaggaggtggtggtggtgtgggagggggagaaggagggggagatcgactacgtgttcaaggtggtggtggtgggggactcggcggtggggaagacgcagctgctggggaggttcaccaaggacgagttcttcctcgactccaagtccaccatcggcgtcgagttccagacccgcaccctctccctccaccgcaagcgcgtcaaggcccagatctgggacaccgccggccaagaacggtaaccatccatgcacacaccgatcatcttctttcctcgcaaacgcatcagttcatacgcaagtatctagactcatgacttaaaaatactggaaagatcatttt

SEQ ID NO: 60279 - DNA, 6977 bp, Oryza sativa
tcgttgctgcgtttttgttagcgtttacgtgttcaagctatcccaactgatctggctgttcttgcatttgattagtaatttggtactccatatacttactccatatacttacatagcgtcaatgactcatgttctgttgcttgctgcgagggagatggtgtcacatgcatgtcagccaagacaccagcttcattttgctttcattgtgattaattaagccgggagctaattggatcggtacaaggactcgtggaagattggatttgtattggttgggaagataaggatgcatgtatagtggctgtcagttttcatgaagccagctgaaattaaagctatgaaatgcgatgctactactagtagcttctgctaaagacaacgcgtcagaacagagcacgccgaccaccgaaagtgatccctgcaagaaccactaatgcctcctttttgcaggagaagatttgatagaaactgtcatgtagcaaatcagtcattacctgcctaatctaacctgcccttggattaggcagttgtcgcctaattaagattttgatctgttttcaatgcaacaaagcgggaattctgtgtgcaattcgtgtgttcccgagggagactgatgtgttcgtggcggaaatatttgaatttttggaggaaatttgagcgaagtttggtctttttggtttcgcaggtacagggcggtgacgagcgcgtactaccgcggcgcgctgggcgccatggtggtgtacgacatcacgcggcggcggacgttcgagaacgtggcgcggtgggtggaggagctccgggcgcacgccgatggctccaccgtggtggcgctgatcgggaacaaggccgacatgccggcgggccggcgcgaggtcgccgccgacgaggccgcgcggttcgcggaggagcaggggctcttcttctccgaggcgtccgcgctgtcgggcgacaacgtggaccgcgccttcctcacgctgctcgaggagatcttcgccgtcgtgtcgcgcagggcgctggagctcgacgaggcacggcggatgcgcgacggcggcgccggcggcggcgaggtgctgtcgctgaaggggaccacgctggacgtcggctccatcatggagaccagcgccatgaagaagagctcgcagtgctcctgctcgtgagcgacacacagagactggatgttcgctcgtgtaatgtttttgtttcgacatatcgattattacacattcacatcatttcacctcgcgttcttgtcaattatagagaaggattaggcatgtaaaacattgtaaatttggtgattgacaagaaatggtttagattcttcatctgtgactgtgattatctacgcgtgcgtgatgctatgattcgtcgcttagctaacagagcaagctagctcggtttttctaatgccacataagcgcaacgtggactttttcctatttcatatacaaaccattcaggcgcacctgtgagtgggccgcgtggcctcgtgatgccatatttgggccgtttcttcactgtatgggctagaaagctaggcccaacaccagaattcggcccagagaaagttggagatgaccaggttgtgcaggtcaaagggttcggagttactaatcaactccaaacgctggcgccggagttttcatttctgaccccgttggcctttttaaagatcgaactggtgattgagtgtctccgacgagcatagcaccgagcacgtcgtgggtgactgatcgagacgtaaaaactccattaatttgtgtggagatgacagtgttgtggaggtcaaggaggttcggagttttaatccccgacccaccggagccggagttttcgttgcccaacccgttcttaccggtcagtccagcaactaggagcagctgtctgccatggcacggcagccagcaatgctttgccggtgttttaccgtgaagccatgaacatgagctagtccatggtcgcatttccaatcatcgacttactgaactgaacacgaattttcaaacattaaacggtgcgctttttacgaaaactttatatacgaaagttgctttaaaaattcatattttaaaaaaatagataatacttaattaattatgtgctaatagatcatttcgttttccgtacgaaaggaattaattcccatcctcatgaaacaaacacattatttcaacagaagttcagcgacgttattcgtattcctattcttgaccgaggcaattctgctgcatcaactgaataagggcatgtttagtacctaaacaaaatttttcacgctatcacatcgaatgtttagacacatgcatggagtattaaatgtagaaagaaaatcaattatatagttcgccaggaaattgcgagacgaattttttaagcctaattacgccatgatttgataatgtgatgctacagtaaacatttgctaatgatggattaattaggcttaataaatttgtctcacggttttctggcagaatttgtaatttattttgttattagactgtgtttaatatttcaaatgtgtgtccgtatatccagtgtgacacgccaggaattatcgttcacgaaataaaccggccctaagtgcggctgtacatagcagcagctgcagcgatcgtgttgtcttttgtgtagtgggtactgttgctgcagctcaagcagccatatgagccgaacaaatggacgcgcagaagcttttggactccttttgatccatccactccagttggcctaatggcaactggtacataactacctacctatgtatgatccacaaatcctgaaaacaacatggccacttgctcatcggtagctgttacatttgcctacttggatggataccactaccgctgctgctgcaattagcaacatcttccatgaagatcaattccacgcagtccttgccgcacgctgctccgacagatgaactgggttctgcactggtgcagcaaaaacagaaacgtgatgagcagttgagcaccatgatcctgtctgcagaaaccacacccatgaacagaattgaacctcatctcagactcaaaagatcttcgtgctagctgtatcaaaatttgggaggtacaacgaacaactcttgatccatgtacatgtgatgcgacatacatacatatacagccgaaacaacttacaactagctagaggcaaaagggagctaaaatgttgggatctcatcagggaagtcaaccgtatcagaggcattcaggctcatgtgagaagcaagcagcaagctggagagattgaccgcatctgcagtgtcaactacttaactaacatttattccaggctagctagtgagatgctgatatgctggtctttctgtagatgttgttgcatcaatcatgtgtgcgcagcatagctttggtcggtcagaaaattgcgtcatccttttcgtcagcgctttcaccacttgcatgagcgatcgatgtccaggttcagttatctacaacgcactggtcaacctggaaccacgcaaaatccaaatcagtttattgcagtataaaagaactgaattaacaacgaaaactctaaatcagtttatcagtggaaaagaactgaacaatgccaaaccctgaatcaattgtatattcatccctagtaaagaaatggactgaaagtctgaaactcttggcagtgagaaagaactcaagaagtcaaagtttcagtctgatcagttagtggttagtgaacttagtgcgattactcggttgttcttaattggttctctatatggattagtttgatcatattgcagatttttttttccagacaaaggaaactatgctactgcatgcactattctgtatttaccaatctgatcgaattggagttaatcctcctcacctgcaattgtttctgtcacgcgtttgagctcaagcctctcgcctcacaagctcgcatcactctcatcctcttacacgaagacacgaacatcctgcaattcaagatgcatcaggttgagatttccacgtttacctttagtttttgcattcgcataattttgaaacgatgatgaacagtgcaatgacgcagtttcagtaatgtataaaaaaagcgatgcggtttcagcggtgcttactcccagggcacgtcgccgacgagcatccagtcgccgtcgccgtcctcgtacacgacggcgtgctcccactcgccgtacccgtccatcagtcctgctcgatcaccgtacacaaaacattattaaccgccattactgatcaatgtttggcagattactcttgcatatacagcgaggtgaaactagcagctcaccaatggtggagcagtagaacatgtcgttgagcgcctcgacgagctcgaggtagtcgccgtacgccgcgacgtccaccttcctcaggtacggcgtcccgtccatgctcaccttcacgaagtacgctgcctgaatcctaaaccgaacaacgaaacccatccatcagaggagacgcgacattgatcgatcatcacaaaaccattagccgtgtaagaacactagaaattacatcgaggacgacggcggcggatggccgttcttcctgccgcgcctggccctgcgagcgctggctccgggaggccccagcgtcagctcggtgagctccacgccgtcgtcgccgtagctcgccatgacccaacaccgtgtcgccgccgctgacctcgacgaagaagacgctgatggtggcgagctgtgggctgcacagagcgagctatatatatataccgttggtgcaagcgcggaggcggcagcggagtgggatcctctgcgggcgagcgggggtgtcagcgtgtcaggcggcgagggcgaggcgggagcagaggatccggaggtggtggggggggggggggtgcagcggctgggacaggcggcgcatcggcggttgggccggttgggttggcaccggaggctgccggcgagggggatggcaccgtgtcgccgtgggacccgaccggcggggcgccaggtggacgccctggtctcctgcgtcgtggctgccttgcgcggggaatcaggtgtgaccgtcttataatctgtggccgccactactgttcaatgtgcattctgcaagtcaatagtactcctagacaagtgaatcttgttctggtggacgtagcaaacttgaattgcaaatctaagcgaatagaacaatatgggatacttgcaagtacgactagtataatacatcatctgttcttaaaaaaaaatactaacttctagtgataaatctggacaaatatatctttagaagttgtttttctacgtgacagagagtactccatagttctattttaaattataaggcattttgattttaattaaggttgcagagagatatactagcctccacttcttgagttcgtttgtggtggttatcaacctacatttactcgttttccgtacgcacacttcctaaactactaaacggtatgttttctcaaaaatgttccatagggaagttgctttaagaaatcatataaatccattttttagtttttttagctaatactccctccgtttcgaaatatttgacaccgttgactttttagcacatgtttgaccgttcgtcttattcaaaaacttttgtgaaatatgtaaaattatatgcctacataaaaatatatttaacaatgaattaaatgataggaaaagaattaataattacttaaattttttgaataagacgaacggtcaaacatatgctaaaaagtcaccggcgtcaaatatttcgaaacggagggagtacttaattaataatacgttaatctatcgctccgttttctatgcttggagattagttcccaacccacaccaaagaatgcagtcaatatctacagcaacaaattagttttattgaatctataattgaatatgtgttaatagtatatttgtcttttgttgaatttgttattacttttttctattgatttaaatcagttttagtttgactaaaatgtaaaatgaattataatttaaaacaacggaggaagtaattggtagggtgcatgatttaggggttgttaagatcatcctagaaggacaccattcgtacaactcattatggaatttgtgacagcgttatggaaatattccaagttcgcacgaaagcttacactaaactgaattttatttttttttaaaaaaaaatagccgccgtgccattgccaccccacccaggcagccaggcaggctgttactccgtaccaatggagagcgaacgggcacagtagatccggattctggcgaggggggtaggggacagggttcccgcaagtggccacgtgcttgttccgctcgctcgccgacttcgccgtgatgctccgctgcgccctcctgcccaccaggtgcaacgcacgcagcagcagcagcagcaaacatatgagacgaccaagcccagtactctgccagtggtgtaccgtgtacgtgccgtggcgtcccctcacccacccctgccagtctcgtcacacatcgcacgctccggtgcggtgcgccccgtcgcccgcccggcccgcggcctcgccatcgccggcaaaaagccgcgcaccggggaggcaagcacgagcatcgtgccccgcgcgcgcccacacgcccattctcggttacaaaaacccagtactccagcatttagagtaagtacaataacagctgtaagctaacaataacctagtatcgagaagagaaggaaagagacagaagaaactatagcctcgcgtatcaagaaaggaggaaaaagtcagaagaaaacgggttacattcagttgattttaatacattgtatatataaaaggtgaaaccaaatattaatggtgtaatatatttttatagataactattatataaatagattattatattacctataaataatttggagctaacatttaactctgctattaaacttgctcttatacgcacgagcgcaggcagcgtaagtacgtacgtggcggtgccgtgcggagacggggatatctcgtgg

SEQ ID NO: 60280 - DNA, 3554 bp, Oryza sativa
attattttttagtattactggagtattgcgttcaggtcggctttcggtttggttgggttccagaggacagttgcgctgctgtgttggcagaggatgtactaatccatctcggattttgatgagtgtgtgacatgggagtatgggactactcgagctctacaagacatccaagagctttttgatgcaaccacgtttgactagccctttgtttttttctgccccctttgggcaaaaaggtttgttggtgcttgaccggcttcacgccctcaaaggcatgagacgtgtcagttcgtgtcctattgcagagtgcatactgcatgctccctccgtccaaaaaatataaactttagttttcgtgtataacatttgaccgtccgtcttatttgaaaaaattatgaaaaaaattaaaaagacaagtcacgcataaaatattaatcatgttttatcatctaacaacaataaaaatacgaattataaaaaatttcatataagacggataatcaaaattgaacacggaaacccagggtttgtccttttttttttttggaacggagggagtactactcaactacttgtacgagcaaagtttttaagaatagatgaagctgcttacttccttttaagaatagagcaagagtgggatcttattggacaaagaacatatctagattatttatagtcctagcaaatatccagattttagttttacatatttttgaacatccagattttagatttttatattttaaaatagaggtagtagtaattaagaaaatagagcttcgcgtgttgtaatcttgcaagagagcaaaatgggaagtaaatgcttaacacagtccaagcaagcaacatttggatatacaccgaaaaaaaatgatgggtctattaatcttttgaacagtttctaatagcgcacagcagcaatccacaaaagcacaagtgacagcccactgtgcttcccgtatggcccatgtgacaccagtcttacaaccacaacacgagtacacgacgataaatagcgtccacggcatatggcatgccgagttgacatgaactcgttcaacttcagctctactagaatcatactactagcgacacaagaggaccatgtaataacacatattctgcctggctgaagaccaaagctaatccaacctcccggagagctactgctatatagcagcaaccgaagaaatgtacatcctggtgttacggtatttatttgttggcttctcgttcgaaattacatgttggcaccactcctggagaatcatgattgttgacgctaacatccacgccctgagtctggtttgtcatcagtaagggaagagcatagaccagagaggaaaatgtgagtgatcggtaaaggtaataatagatgagcccattgcattaacatggagaatgtgatgtacctgtgagtttgaaccttgtccatgagtacggacgggtctcatattaagatcaatcattttggaatcgatgttaccctggtcatcgcagttgccatctgaggctggatcatcagacacattatgatggtttgccatttgctcctttgttactgagtgaggggccttcttttgatccgtccggttttcaggatctttctgttgcatagcaacatcatccatatgacctggtttatctcctggaaactaatcaaaatttcaaacttcaagcactagaaaataaggcgtgagattacaatacgaagttggtttctaaacaataacctacttcaacccgttgccttaggagcaggtatcttccatgggttcgtttcccaccaacatgaacagtcatatcacaactaaggcaaagtgatgtaccatctatctcgcaatagaagaaggctgcatggacagcaggacataatcacaacaagctttaacaggcaaaatatgataagaaactattcataaataagaaagaataccgggggcattttcacatatatcacagcgttgaactttattagggtctgcaagcccaactctcacgtgccgcctagcaagcttgttacacatatgcacctgcatcacaacattggaagaaatatcagaaaatgcagcatgaatatttaatgggttattgagaccaaagctgtaatatttgtttttcttcatgctaatgataccacatgaaggatattgcacagctactaaaataacttgtatagactgattgttggtcaaaatctacaaagtttggcctcttcaaaccaaaatacatcttataacaatcaatggagcgagtaattttgttgatcgaagttctcatagagctgaatatggatatgcatctctaacatacagagtacaacaaccaatctggcaaactttcagtaaacaaatccatgcaaaaatgtcagctatattaacagtatctgatttcttatgttgcctgcacataatcagcatacatcgtgttcttcagcagatccattactgacaaaccttattaactcattaaacaggtgctcaactgacataaagacataagtaaggactaagaaccagaaaagatgacctttcatagttggaagagaacttaactgctcaaaacatagtcgtaaaacagaatagacgtacaatgttttaatgggtaaatcaatataatataagaatgtgagagcacaatgggatatttgaccaaaagatctgcccacgaaggatgtttcataatgtttggcctcattagggatggggccacccacatacaacaattccatttccggttggaactttcatctacaacctggttgcacttttgcacgtactgatgatttttaatcatgtcatcagttccaaatattataaaaaaccaaagaaaccagtgtcatagcattggttacggagcgcaaaactagttgagcagctaaagaatgagtaaaggatgctctcatgtatgtttttattagcaattgaaggtagcgactggaatcatgtacagtaacatagtataagacatactactctgtcccataaaaaagcaaaccctagctacgaatctggacacgaatgtgttcaggattggactttttttgggacggagggggtattcattaactctagaaaatctgcaattcagactctgcattctgcaattaaagtgaggcagaagcataatcttggctacaaataacagtaaacatatggactgaaaaatcgtgtaaacacaagtgcaaaatctatacctaactatttctttactattgaagaatttcaacaagggaaattcaatcattacttctacagaacaatgatcgacttaagtattacacatagccaataaggttaacagaaattccaaccaaaatggcaaaatcacgacaagctcatctcgcactgtcccacatatggccatgaatgatgatgcctggaggtgtctaacgaccaccaagctagatatagaactcagggtagtgtgatcttctaagaaatcccgttccgaagtaacccaattgctggattcaagtacttatttgaacttattatgtatgttttatgctgtaaaagtgcctccttcgataacaacatcatagaattatg

SEQ ID NO: 60281 - DNA, 11308 bp, Oryza sativa
ggggggattttgggggtgtggctccgaatcaattgcttggctgctctgccgccaatgggcgccgtcacgactccctgtctttctctttcttcttctctccctgctggcctccgggctccggtaccctgtgtccctgtccgtgggccaccaccaccgtccaataggagtacctgttggacctagatctctgcaaaggaatactagagttcttgggctggttataggccggcccagctatcctttgcagaactcctccagtgatccggtctctaggctgagctgcatgccctgtgcagtccagtaaaccatcttttttttaatgctattgtctctattgtaaaatcaaagtccactaaacacattattctaaatccagtactttattataaatccatcctcacaatcacattccatcaacacctccaatcatataggtctaggcgtattagcccgttgaatagttgcatacttatactccattcacttcatattataataagtcgtttggattttttttccatagtcaacctttttaaaaaattgactaagtttatagaaaaatataggaacacttctaacacaaaacaaacatattattaaagtatattttgcatctaatgaaactaatttggtgttgtagatattgctatttatttttataaatttagccaaacctagaaaagtataactagaaaagaagatcaaagcaatttataatatgactaaacagatttaggaccaaaataatatagcacagacgtcactatatgctactagcttcgtttcaggttataagacattttgactttgatcaaagtcaaactgcttcaagtttaactaagtttatagaaaaacatagtaacattttcaacccaagtcaaatttattatgaaaatatattcaataattgattgaatgaaactaatttggaattataaatattattatatttgtctataaacttagtcaaacttaaattagtttgattttgaccaaagtcaaaacattttttaccctgaaacggagggagcactatgcaagcacataacaagcctttgaatgtcacccttgccgttatagtccctcatgtactaatcgttttttttaacgtaaagagagactttgagcttgtttgggggagtttctagctgctgcagattcttttagaatcagaagctccccaaacagtccagcttttgatctagattctaaaaagctgtagttgtagaatcaaaaaaatgaactagaagctaaaaactaggaaacccaacttttccatattctcagaagctggctaccaaccaattgcttctcataattttaagcttttcaaacagaccctttattaattactaaaatttggattacattccttatttaatagctcaagattttctgctggggcacacaatcttcactccaagcaaattcttgaactaaatgccagctgagtcaatgcatgcaaatgcacactatctttatgtggatcactttcacttcttgtagacgttgcatcgctcacagattattccttctcacggatgagcgtttcattgtcaagctagccacaacctctacgttgtcagatacggagtacattactaatcgtattttcacctgtgaacttctcactccttcccgtattttcagcgtaaacgattctatcgtcacatcgacaaaaacctttcgattgcactttgcacatggctggtccaatgcaactgcattttcattcatgcacaacgcttgcttggccacgttaatgtgcttgtgcagcgtcactgtgcagagagaacgtgcgtcctacctgctacacgaatgaacgatattaattacttagcgtatgtatatatggcgtaaaccatgtatcagccgtacatagtacgtggattattactgtgcgcagcggcgcttaagtcttaagtgccattttgccgtacgtacctggttgttgactgtgcgtacgtgtctctggtttagtttattatgtctcgtccgtcggccgtcgctaagactcttgctgacaactgactgactgcaatcagcggcggagctagaaaattaattcatcggtatcaccgagatcagaatacactaatcttgtttaacttttagtgtcatatataacacacaattcattgggaggattgactcaacgacgacaaagctaatatggaaagtatggacgctgtcaaaatgaaaaaaaaaaaactttacatagctcctcattcgaaacaaaatctggatgacagatcggctgcaaatccgtcaatgtctatcagttttgctatagaaacctttaaacggcacaacaccttttcaaggattacactttcgtacatcaaatctgagagaagatctttcaacagccgagacacaatacactaaacacacacgatggcgacgagccactgcttgactggtggatcaagggacatcccaatggaaaaaaacacaaacgaaagcaattaaatcaattcatatggtggtgccttggaaaacctgatgcgaatgacacaaacgagtgttccacaatcaggagactcaattgtctcaactagtgaccaaaatcacagataagaatgcgaggctgtcggttttcttgttgttctccctcttgttcggttctttttcggctttgtctctttcacctttggtgagtctgtaaataatttctatcctacctaatataacaccagcaaaatgctagctacggtttcaaaatataaaaatttatagtgtcatcttgattgcctaaacaatataaccatagatttcgccacaggttaccggggtcagctgacctcgatagttctactgtaactccgcccctgcctacaatctcattatcatttttattatttatcatgtcgtgatttgtaattcacaataatccgatccataatgtttgtaatagttgactgtacattatttaaattaaagactggaaactctataataattaattgtggtctttttaaacaaagtccaaaatgaattaattacatatatcttaaaaaaccctcaaaaagaacacaaggaaaataagcgagatttaaccactgtaccaaatgttcagcaatgaacagtgaccatataatccctggaaatccgtgcttaaaccatcaatcatattctctccgtctaaaaaaactcaacctataagtgtatgtgacctctcctacgacaacgaatgtgggcaaaggatagtccatatttagggcccctttgatttgtaggaaaaatgtaggaattttggaggatttcaatcctatggaaaaaaaatcctatgaaggcctttgagacaaaggattgaatcctatccaatcctttaaaattcctatggaatgggtaatcctatgcacattttggaggaaagttagcaagaggtctaacctcttggaacatttcctctgagtctatctctctcatctgattcctgcgttttttctgtggtccaatcaaacagccattcctgtgtttttcctgtgttttgcaatcctctgttttacaatggtattcctgtcagaatcctgtgtttttcctattcctctgttttttcattcctacgatttaaaggggcccttatagtcttaggagagatcacatcccctattaagttggattttttctgtgatggtgggagtatatcgcaccccagactggacgatgaggcactgattgtagacaggtgaaagttaaaagcgagaggctgaatgtttggtaggtaggttggcaccagtacttggccgggtacccatctgcattcttctgccttcactagttcactgccaatataatgcgacatctgcgacacagtactgtacgtgcgacgggctctgaagcagagcaatggcaaaagcaataatgtcactcatggacatggacggcgagcgatctgccggagcaaagcaaagcctagctcgcccccacagggacagcattcatggcgctctcgtctcgtgtgccccccctcaatcgccattgccaaccagaaagatcgtactcttcccgtggtttctactgctgctctccggtggccgccgccgcctccatattagggccatcgccttcctggcgcggccaccggtcaaaacggttatttttggtccggtctctcctttttcttttccttttcttaccaagtcttttttttaaccattccgtgagcttcacatggcagacaggtgggccccgtgggagttagccccaaccaccgtccactctgctgcctttttcgcggtaaaaaaaagcgagtaaaacgaaaggggaaattcacctgccccattgtgaatagtcccgtcgtccccttcctcctcttcctcctccctctctcctttttcttcttcttcttctttcgaggagaggaaggaggcagccgcgcgcgcgcggaggcgggcaacctctcctcgactcctctcccccaccgtttcgtcgtccccgcgtgagaggtaaacgagctcctcatcgatcgatttctctctctctctcgccgcgaattcgcttggtagccatgcacgcgcgcatggagggaaaccttttctcttttgttgttgtcgtcgtcgttggtgcatgtagcttcgccgtcgttagtacgtgacaacctccggcgacggatggatggatcggtggcggcgaggcggccgcgcgccggccggcattttgctatttttttttcatcatgatgacatgagcgcgactgcgtacgtgcttggtggtgcaggaaggggaggaggcggagatggcgggggaggagcggccggagcggatcgtggtgtcggtgcggctgcggccggtgaacgcgcgcgaggcggagcgcggcgacggctccgactgggagtgcgccggcccgaccacgctcacgttccgcggcgccgtccccgagcgcgccatgttccccgcctcctacagctacggttcgtacgccgccgccgccgccgaatgcattgcaaaccgctctcccgctcaccttctcgccgtggtttccagacagggtgttcagccatgagtgcggcacgaggcaggtgtacgacgaaggcgccaggcaggtcgccatgtcagtgctcagtggaatcaacggtaaccaaaaaaaaaagaacaaatccattacttgtttgcaacgacgagctcttcgtcgtcttcttcgtcgcgatgaactcactcgcgagaatctgctctgacattgctgcagcgagcatattcgcgtacgggcagacgagcagcggcaagacctacaccatggttggcatcacggagtacagcatgtcggacatctacgactacatcgagaaggtgatcaatcgcgttgactgaattactgttgattttgtttgcataattgcgttcggtttttgatttacgagtctctgctctgcagcatcctgagagagagttcatcctgaagttctcggcaatggagatatacaacgaggctgtcagggacctcctgagctctgacgcaacgcctctcaggcttcttgatgatccagaggttacctttttccttgacatggtttgctgattaccttcaacaaaaatcctgcaaaatttatcacattttgctgttctttctgaatgcaaacagaaaggaacagttgtagaaaaactcaccgaggagactctgcgagacaaaggccatcttctggagctccttgctgtgtgtgaaggtgtggaaatgaattttctttctttcttcccagtgaacctggatatagcaataagagtagcagctcatttgtttcttcagtctggtgatcattttgtttttgcttgtgtgacagctcaaagacagattggggaaactgctatgaatgaagcaagctccagatctcatcaaatactcaggatggtttgtgctcatatcaagctaaattgtttgcaacagactttttttgtaaaaaaaaaaccggttcttaacctgctttgttaactgtagacggttgagagttcagctaagcagttcttggggaaaggaaactcgagcactcttattgcttgtgtggtattgatgaaatacctgcatcttgtaagctttgtattattttgcacatgtttttccatagaatctgagtttcttgtggacagaattttgttgatttagcaggaagtgagcgtgcatctcagacggcatcggctggtatgaggctaaaggagggcagccatattaacagaagcctgcttactctaggaaaggtcattcgccaactcaggttcacagaattctcttctgtgtctttcaaatcattctacaagttcatttttctctctctttcttttgaaacaagacatcttcatttcatttaaaatgatttctgaacaacttcttggtggtgtagcaaggggagaaatggccatatcccatacagagattcaaagctcacccggatactgcagtcatcactgggaggcaatgcaagaacagcaatcatctgcacgatgagcccggcacactgccacatcgagcagtcgaggaacactcttctgtttgctaactgcgcgaaagatgtcgtcaccaatgcacaggtcaacgtggttatgtcagacaaggcactggtgaagcatcttcagagagagatcgctaggttggagaacgagctgaagtttcctgcatcagcctcttgcacttctcatgcagagattctcagagaaaaggatgaactaattaagaatgtgtgtactgctcttggatccttctgttttgatcttcacatcgatgataatttacagttcttcactttcaaatgtccccaagaaaagtactgaagttcttttttttggggggtgaattttcagctggaagaacagttgaaggaactgatggagcaaaaggacaccgttcaatctcagcttgataatttccgcaaagttgcgagcgacggggatatcaacaatcacttagcaaggcgatgggtacttctcttatgcactaatgtgttatctaaaaaaaattaacaacgcaacagtgttttagtatccaactaatttaaccttactctgatgttcttcacagagtcggtcttcagactcgattccgcgcattgtgtcagaaggtgcattttcatcttcagatactcaagacattgactatcaagatcaaacaatggatgaactgtcagtacctcactcgtttccaccaagcagccaaatttctgacatcacagaggaacacgaagcacagagagtagctcatcgagctgaatctgagccccctgaggagcactgcaaggaagtgcagtgcatcgagacaaacaagctcaggagcaggagaagccaagaattcttccaaacacctgaaaagaagacacacactgatgatcaaaagcatagcgaaagcatgtcaaattcagcagaaaatgccatcaagctatatgcgtgtgattttgagccgtcatttgatctcgagaagcctgaaactgaagaatctcttgccctgaagaggtgtgtggttagctccagggacagtgcgcttactaggagtagaagctgcagagctagcttcatggtcattccgaacagctggttcgatgactcggcgagcacgacgccgtcgtccgaaaccttcagatattctaccagaaggccagagaaggtgaggaaaagcctgagtcctgatgagatcgcagacaagagcacgggcaacgctgaagaagacaagagcacctgcaatgctgaagaagagactgctgtgaatgacatcggctgcgtcacagaagtgaagcagaagacagaaatgaaccatgcaccccaatcttcagagcaacaccaggtacagtaaaaatgggaaatctctcttgagaattctctctccataaaaaccattgactgcaacatttacatttctcttgtcaagccgatttcactctggtgtactgtctgtctactattgattcatgcagccgaaaattgctaaagaagttgccacggtctccctttcgaaatggcacatcgatttcgagagaaagcagcaggagatcatcgagctgtggcatgactgcaacgtctcgatcgtacaccggacctacttcttcctcctcttcaagggcgatcagacggacagcatctacatggaggtagagcacaggcgactctccttcatcaagaactccctcatcgcagacggcgagctccacgctaccaccgcatcaaggttcagagacgcatctctgaaagtattctgaacaccgtcttgatgagcagcatgacaaacaacattcttggtggtctttgcagcttgaggaatcttcggcatgagagggacatgctgtacaggcagatggtgaggaagctgcacctggccgagaaggagaggctgtacggcaagtgggggatcgacatgagcaccaagcagaggaggctgcagctgtcgcggcggatctggacgcagaccgggatggatcacgtcagggagagcgccgccctcgtcgcgaagctggtcgagcacctggagaaggggcaggccatcagggagatgttcgggctgagcttcagtttcaagccacgcagatctttcagctgggtcggcgtctactcccgagactgaattcttgcccggccatggcgatgaactgatgatgatgtctcagtggtagatggatgcgtagtggaggagacgatgctgcatgtcaggaaggagaggagagagattttgccgccggaattgaactgatggattgccccgttctatctatgcatgtgaattgtgattcagattttttgcttctggcgtgagttcctgagttgtggaaaagaatcggcgtcgagctcctctccggcgaagtgtggcacgccgccgccggaaccgcgtcgctggcggcggcgcggcttctgctcggcggcgaggcagcaacaacgacttgggccggaacgagcttctcactaacgtgtgggccgaaatgataattgggccgggcagccgcatggacctaactgttaattctaagtaataggagggacctagtgaaaataatgcagccacgacgcttcctattcccaagcccaatctgatccgcacaatattagatcggacagtacagatagtagcgatccaaaattgagggtataaaaagcaaaatctaatattacaagggccttatgaaaaaaattccaaccgtacgttctttgacccgatctgagccgcacatccgagatccaacgtctcacagaacaagccaattcatattgggccaatggcctatcagattcgactgggccgagaggacacggacaagtgggcctttgcttaactcgacgtgggcccaaaaacccttcgtccctctcacttcgcttctcttgtcccctcccccatctctgcgatccaaaggcggcggcggcggcgagctcggtggcatggcgatgcggctggcggcggcggcggcgttcgtgcgacgcctcgtgccggcgcgaaatccggtgatctcggcggaggcggaggcggtgacctgcgggcgcggggacaagaagaccaagcgcgggaagcggttcaagggctcctacggcaacgcgcggccgaagcgggagaagaagatcgagcgcatcaaggaccgcgtcgaggtgccccgctccaccccgtggccgctccccttcaagctcattgagccaaagcccagcgcgagctcccccccgtcggttcgtgaggctacctagggttttcctttccctttttcgatttggtactcttgtccaactcttgcgcctgcgcccacgcttgcgtgggcacgcatcgtttttttagttcctcatattgggctgtgtcagatatgtattgtcgaatcaagctgccatatcgcaacattgtagaatgcagtccatatggacgaaaatatcatcaccatgtttgtttgtccagtgtccttttgctgggtgtcatctggatggtgataatacgcagtttatgataattggaaatggaatttacggttttggattgattgttttgtgcagttgctgataatgtgatccacggttgttaatacgaacacaaaatggatgggtaacaaacgacttagccaattagccttgttttgtttcgtttggcagttgattagcatatattcagtgaattatattttcttttaagaaaatgatgcctggtactttgatcaatttatgttgtaaactgaaataggtccgagtagtagcgagcagccaggcactcgaatcactagtataagtctttgtttctttgttatcgtcataactggattaatatgtgtggattcatggtgataaaaaaaatgttttggccgaagccaacatttccgtgcattgatgtttattcataactggattgtatcaaacttctgatcttaggttattctgcacatcgcatcttgatattcctaatgcattcctgatagattagacttgaagcttgccctgtgttgagattggtggatttcataatgataaaatatgttgactggtgtttaatataccatcatcttctagtgcatgagcttacgctccgctatattggtaattggtgataacttgtcttgacattcatgtcgggctaaagagacaaccttactgtttattaatactacttacttgattgtctttacaaagtcagggaaatgtatattattttgttgcacgtttctagctggagataggaccccgacactttatactcagctctcacatcatgcttgaagaaacatattcatctcattgcattgccaatccgaagctctggaagaattttagtgactctggcagtacaaagctctagaattccatgacattcctctttgcttagcgatatctgttgccattgcaaaatagacaaaaaaagaataatgctatgtgatgtgtaccaatggcttgctttgcacgtttcacgtggtgaaactttgtagcgacaagctgacactctaatgttagtttaagctatgctgcgagataaacaaattttttagtctcctttttcagtgctagatagggaaatagggaagagttccagaagggtaatttgttctggtcttttggtagatcaacttttgtgcatgcaacagcttacatatgcagatatatgctcatattagcaagtgttcctttatgcttttctttattgttatttgagacatcataatgtatactaattactgtaacagtgttccttttcacaaatcctcatcacaattgtgtttgtacaagaataagagctaatagatctaaagcataatgaagaatcaacacacatattagtgtctttacatctataagatatacatggtatggagattttaaagaaattaaattatgtttataagttcagattttcagttcaatagcaattaagaatggg

SEQ ID NO: 60282 - DNA, 770 bp, Oryza sativa
ttgaatgcacaatttgggctactctgacatgttggcaagttgttgatagtactagtaaattctactgcaattttctttgtgaagttgacaacttaatgtttagaaccaagtcttaatttacaatttatagatcatgctgtgtcaaagcttctgattacatatttggctgtgtactactgttagcagtcatcaccacatgtccacacactgttttgttgcttagatttgcaataattatatgctaggatcccaggttatccgcatggaaatttaacacgcctgtggattagcctggttctgaccaagaatccgaccaatcctgttcaagtacttactcgagtgaagtttagacattacataaataaaactaataacaatctgtctggttttgtcaatggataatggaggtgtattactgacgagtgacgaaccaagatggttgccgtcaggtatggatcatagatcgatgaacagctcctgaccatgacaggccagcgaccacaatggaaagattacgccgtacgtacgatcagtcttcattcctcataatttcattgttcgtactcctttttgtaacaccatttctcgtagcaaagcaaagaaaagcatcatgcgaattgactaacagcagcacacaccacataaattctgctcgatatttcaacgtcaccattgtcacctgagggccaatgtaagggggtgtttgtggttatcagtcacattttgttgcatctagtattagggaagtttaatcacactggcagttgttt

SEQ ID NO: 60283 - DNA, 2720 bp, Oryza sativa
tgcaggataggagaggtcgagatcgaataggccggcgttgacgcctcctgttcattcctggacatgtcactggtccgagaaaccatgtccattccacttctgctaaatccaagccctttttctctgcacatacacatgtactgcatgccaatgccaagcatctctgcattcacgacaggatgcgaccctgttcttttctccaacaaaatttattggataaatttttaaatatttgtgacacgtttttcaaactgctaaatgatgtgttttgtatgaaaacttgctatatgaaagttgttctaaaatatctaattaattcatttttcaagtttgtaataattaaaatttaattaattacatgttattgccgctttcttttacgtgaaacacttaacctttattttatctttagaagattcaaccaccatcgcatcgcaatgtaccgccacaaagagagatcactgttacactgtatcagtctcaagaacattgggatggagaggggaagaaaaagactgagatcactgtagtggtgcatatatatatatacacacggaggagaaaaaggcgatgacagagatgaacattggatgccagtactgtatctactagttgggtcggcatggagcgtagggctcaccggcggtggccaccaccacgacgtacgtacacgacgccggtcgtagcaggtggccgtgccgtcgtagcgtgaccgtgcacgcaactccggccggccggccgtccgcgacactgcagtacgcagcactgcactgtagctaggatattggtaagatcggtatcactttggcgtgacaggataccatgtatcgtaagatatattatgattagtgtcaagatactgacaaacttggtaggcagcattggcactgtggctagtataaccacagaattcttaggtccgtttgcttttcgattaacacatactccatccgtcccataaaaaacaaactttattactgaacatttgaacatttttttagtacaacgaattttgataggctcctattcggatttactacctccgtttcaggttatgagatattttgacttttcagagtcaaactgcttcaagtttgacttaagtttgtagaaaaaaataataacattttcaatccaagacaaatttattatgaatatatatttaattattgatttaataaaactaatttggtattataaatattacaatatttgtctataaacctagttaaacttgaagtagtttgactttaaccaaagtcaaaacgttcagtaataggttggtttttttaacaaaaagtagattttacctcaatttacattagcacatttttttaaaaaaataaatggtgtatttgtgcgaaaactctagacaaatattttttaagtttaaagtaattaaaagtcaattaattattcaacaatgattttctcgttttacagtgcactaatgactattatgcagtaggattggctaggatatgcggtaaagattggtatcattcagcttgataagatatgataagatactaggatacgtgttgggacatggtaaagagcctcgcaacactgttacttctttcatcttaaaaacaccataaatctaaatatagactacatttagggttgtaagcgggccaacccgcgaacccgtttatagacaaaatttatgagtaacctgtgggttgactcgcgggttaactactaatttggcctgtaaataggtttatgggttgatctacttgcatctctacgacgcggcaagccgagccatgacgtgaaaacctgcagattaccctttatttaacatatatgtaggttcacggatcggcccgcttaccttcctacctacctatattagaatttagtattttatatatgcgacggagggtgtaaccgtgtaagcggccgcagttgccagcaattctgcatggagggtcgagggatagaagcagtatacaagaaggtcacaaagctgtagaaggagctagggaaggttggcagcagcagggcggcatggggggggggggggggtgacctgaccaatggggtagagaaaggtggacggcgacggcaacggcatcatggaatggcgatggatggggcggagctaatggccaaatccacgcactgtggacggggacggctgacgagatggcgccacagtgccgccgcggcaatttgtcagattccccgtcctacgtggaccatccgcgcacggctcgacctcctcccaacgaccaaactccctccgtaaaaaaaaaaaaaaaaaaaaaagaaagaaagaaagaagagagaggagtaagagacaaaccttgagtttccatgtccaacatttaaccatccattttatttaaaaatattatgaaaaaaattaaaaagacaagtcacgcataaagtattaattatgttttatcatctaacaacaataaaaatactaattgtataaaaaatttatataaaacagacagttaaatattggacacggaaatacaggcttactttttttttttttttactacgaagggagtacacagctcgatcgacgcggtcgagctctcgcgttgctggccgattcctcgcctctcgttcgattgtcgtcgccgttcgcaacgcaaaagggagatttgtatatagtacaattttggttagtacggagtattagaaaatcttagcagtggagatcttacaaagttcggtcgactaggttacaagatgcg

SEQ ID NO: 60284 - DNA, 7686 bp, Oryza sativa
agttataacctcgttcagattacctgcacgtgcgacggtggtgttatcgcgtcgtgtccttcttataagtgtcgcttaggaggtttgttattgcctcttcgccataagatagttggatcgatgattttggatgcggctggtctatacaaaggatgagtggatctttttctctcttgctctctccagatgcgatctttctctctcgctctctttataagatagttgtttggaggcgttggtggacggtttagtggcggctgtgttataggtttggcagtgtccatctcgcattgtcaccacaaattggtggtttttcttttctttttcctgttaacaatctctcaaggatgtagttttcaaaaaaaaaaatactatatcgatataaaacattgcaccatcttatactatttgttttaaaaaaaaacactaagatgcatatacataccactatacatgcaagcacccatgagtgtgcacactttaccatacataataaatgaagactagcagtaaatttctaacctccatatctcacaaagttttgattgaaaatatatatgcatgtgtgcaggggcgttcctacactatactacccgggtaatgaccccgggtagaattttaatatttagatggtttagtctatattaactatattattagttaaaaattaactaataatatacatgttatgacaggtaaaagacctcggtaattttcgttctggattcgtcctgcatgtgtgaaattctaaccattaggtttttttaccctgatcaatgtactcataccatcacgaaatttaccactgtcgcttcttctcttatcaaattttcgaggatgagaaacatgttagtaaaccttttcttgcttgcacaaatgctcgaaaatgacatggatgagacatatgttatttcggttgtgtatgaaaagcttttagctactgcagcttatccaaaatcttaagcttcccaaatagtttagattattacctaaatcctaaatcaatactaactacaaaatccaaagaaacaggctagtgataagaaaccgggaaacacaaccttttagattcttactagctggctttttattatttcccgtcccaaaatataacaacttttagccttttaaatttgtcccgaaatataacaaattctgcatcaatattcacttctcaaccaataacaacattccactgttcaatttacccacctacctattatcaaccaatcacaatctcccaccatttaattctacttactttctaaataaccgtatacaactctaaaactttttatattttgagacgaaaggagttattgtttttcataatctctagcttctcaaacataaccttgtaaaaaagggcagaaaaggaggcatttccttttcttagctgtccaaaatgagagcaaaataagattaaacacggcagaaaactcaactatatgagaagaacatgacacctaaaggaaaccttcattgcggctggtccataaaaaacaaaaggcaaaaacacatgttcagtcaacgataagtaacttgccaagacacgaaatttggagtgtggcgccgataactgataagataggaactggaaaagcatcaaaccagcaaatcactaatcagcaaacagtccagctttggttagtggatctaaaaggaccaaacccaagtgcgtcgtcaaacttttctgcttaacgatcacacgctgcccaaacaaaactcgccagcggcatcgctgggaaaggacacctggtgacatgtgcgagactaacagcaaatgtggctatctttcactgaatttccaattcaatagtaacactggaagagtgagagagcagcctaatccacctgctcactctacctgtctttttttatgtcagggataaggtacctgtgtttacaaattacacatcaataaactgaaaattaatgctccacgtgggcaccgtgtccacataacatagtgtcagtcaacagagtatttgatgttgattacacacaaagatgattttccagagtacagggatgattactgcacggaacgtacaaggatcaagggctaattaagtttggtactgtgccaggtagtacttgagggtatatttggttgccaggcaggttgtcgcaatttgctgacagaagtagacaaacttactcaaggtttggtgttcagagttcttaacaagtctaacagaatcttgtttcttttttaacataagccagcaaatgcttatgttatattgagcagatgagtagtagaaatatgtataacttcaccaaagatgaagaaactgactccagtagcccgaagacagccgagaaaagaaaaacgcacacatatgcatcagttttgtaagttattgatgcctagtaatttgttggaagtgaattttcctacaaatatggctaaccaaacagctaatgtttcaaatcacttatcatccaaattttgtttgaagttaaaacatttatatctttgactatcaatatttagatattaatatgatttaacattacaatatttatcttttttcatcatgacaagtatttttcataaataatattacaattcatatgttgttaagctatataatttttttaaagattgatagtaaaaaagataacatcttttacttaggacaaagctaaaaagataggtaattgaaaaaaagagtatttaaattagtttaactttagacgcatcagattgtgacaagttagcaagcaaacatcccctagctagtgagcctgagtgtttgctcaggtggttagtgtcgccggtgggcacactacctgcgagcgttcgaaccctacgttcgatggctcgtgctctcctggggaggttttgttttccctttttttcccgagactgacttcggttggttccggttaggtataagggtaaacatacacgtgagcgttcactggtactgcacgtttccggtgcctccaatttcattcttagcgtgtgttagggatacgcaaacgtgtgtgcgtgtggcgtggacttgtggtgtatgtgtggtgtgtgttcatgtgcatcctgaattttacttccctctaaaaacacatcccctagctagtagctgctggtaaactaccgtcctgagcaacagagaagcaaagcaatgagttgacgcgaccgaatccgcgacgccgccctcgcaccgcaagggccacgccaatttggtgctcgatcgatcggaacgcgcgcggcgctccacggccatgtcccaccgcacgaaccgcgcggccgcccgccaaccgagctagcgcgcggccccggccgccgccatgctaacacacacccgatgcgttgcattgcatggccgctccacgacgcctcccgcccgcctcgcgccaccacggccacgcggtgcaccagctatagctagctagctaggcgcatggggagacgctccacgacgcccactgcactcccgacacgtttcccccaaccaaccaccacgcaccaacccaaaaccatccatccatccagccagccaagccaatctcccggctccctccgctacgcgccccacgacctttttcccatcacccgcccgcgcgcgcggtcgagcgcaacgcaacgcaactccaccgtaccaaccgcggcgcggccgatcgatcgacgcgaatcccgcatgcgtatacgtactattctacgtgaagtatatgtgtagccgatcgagccgtctcccaccgcgcgctccctccctgcccccgcgacagcgacgccgagcgagcgagagcgcgcagctagccacagcctccagagctatagctacagcgcgatcgagagagaaggggggagacagtgaggccgagagcgagagggccagccacgcacgcacgcacgccaccgcgctccattggccaccccctcgccatcgccacgattaaactactctcttgctactccccctccatccatccacacactccaccatttccttcttcttcctccatatcacacggttttcgtccatcgatcatcagagctcgatcgggcgccatggatggggaggaggacagcgagtggatgatgatggacgttggagggaagggcgggaagggcggcggcggcggcggcgcggcggacaggaagaagcggttcagcgaggagcagatcaagtcgctggagtccatgttcgcgacgcagaccaagctggagccgaggcagaagctgcagctcgccagggagctcggcctgcagcctcgccaggtcgccatctggttccagaacaagcgcgcgcggtggaagtccaagcagctcgagcgcgagtactccgccctccgcgacgactacgacgccctcctctgcagctacgagtccctcaagaaggagaagctcgccctcatcaagcaggcacgcacatcgtcgtcctcatcgattcttgatcgctttctttcttgcttgccttttgcatcgattctgacgcgtgatcggtgcgttcttgcagctggagaagctggcggagatgctgcaggagccacgggggaagtacggcgataatgccggggacgacgcgcggtcgggcggcgtcgccggcatgaagaaggaggagttcgtcggcgcgggcggcgccgccacgctctactcgtcggccgagggtggcgggacgacgacgacgacgacggccaagttgatgccccacttcggcagcgacgacgtcgacgcggggctcttcctccggccgtcgtcgcagcatcatccgccgccgccgcacgccggtgccggcttcacgtcctccgagccggccgccgaccaccagtccttcaacttccactcgagctggccgtcgtccacggagcagacctgcagcagcacgccatggtgggaattcgagagcgagtgagcatccacactgttactactaggctactcatggatgatccatcgatcgccacagatcatgcatgccacgatcagaatttcaattcgccgcgaggacggatcaaacctgtactagatcggatcagagcaaacatagcagagaagatgatcaaaccaacagtgatgtgtacatagctttctgtagatcaaaaccccaggcagtctcctctccatccagccatcagcatgcgaaaattctctctctctttttttcccctccaagtcttactcgacttcgatgttggttatcacaacaccacatcatgtaatccagcaacacgccgagatgaaaaaaaggttaaaaagcttatagagttcgttcatttgatggatccaatggccgcttcagttttcgcctttatgatttcttccaatggatggatcaatgaatctttatgctttcttccaatggtggatcgatgaatgctacaaaaaaaaaaactagataggttcaagaaagaaagaaagtgaagagaggaaaaggatgtgtgcatccatgtagatcaagattcccgagcaggtgaggggatgagaatcgaacaacacacattcgctcactcacacgtactacgctacagtacgggacaatacagagtggcacagatcacagaacatgcgagccgccattgttaatttcaagcaaatgtaagaggcgcgtgggattagtcagcccaaatatatatatatcataccatttgatcggagattgattttgtagtgtagtgtagtcctgatcagtttagcacaccccatttagacacaaacctttgcagagttgggacaaattaacccgaactcatggcacctttggaacctaattaagatttctacagagttttcatatatagtagtttgattcctacgaaaatctttcaaaatcctcctgttccaaacgagcccttcagcttgctgcgcttacaggataaacgactgatgagtagtcgcatttttctgcaagatcagaaggccattttttatgactaaagctagaattttgtgagaaggctgaagagtgcaaggctgagtaatcaatccggatacaagcagtagcagttttagtcaaagacaagacccacccaggacaatgacagccaccatgttaatccttcgtttatcctaggtagaagtgatagtaataatttacccggcatacttcttttccatcctgacagcgaccagctccaacgtgtcaacaatccagtacatgctagctcacccacaaggccacaaactaaaatggtgatccaaaaccaaaatttcacttatcaattaagcaacttatttacttacagtaattaatggcgatggtatcacccactgtttcttgggcacgtacgtaaccccggacgaattaggttgctttctctggcgaacgatcaggtctctttctttcgtcttcaactgttgtgtgggctccatggcataattacatgtcactgttcagacacagtgacgatcagaatcgttgaacacaaattctatgttcgatgggcactagccaagcagccaagagtatgaaactctgaaaaagaaaaatggagaggaaaaaatattgagttgagcttgctagctccagaatatcacaggcgcttgtcgtgttatcttgagggtggttagcattgcttccatctaaccgatatgggttccactcaaatgtgacaactcatgagcccaacatattataagcaaattgcaatcctgtcaagaacaaagaccccatcagtgaaggcaaagggcaaagcaaagcaaatataatggactagcaatatataaaaaaaactcttcacctagtcacagaattgtagccacttgtacaccctgtgatgtgaatgcaagggttctgtcatcaagccgttgtccacgtggattgcttatcacttactcgtgtgacattaccttggatgagttagaatatacagaggcttttctcagtggatgcttgatacactccaataagagactgaaagactccaagcacgcagtttcaatttggatattcaactttagatgcgattaggtgtcaactccagataagttgcagatcattcaaaagatgagcaccacgcatggtagtacatcaatttactacatatctggaacacatgatttacgtaatactagtaataattaaaacaaagatttgtatggaattcctagagatgaaactcagtggaacaaacagggtcttgcactctcatcttcatccatggacgtgttgtactgggagtttgaaaccaatagcatctttgacttgattactgatgcacaacgactaaatgatttggactaaatgatttggatacatagcttttgggacttatctgggcaggcgtgactcgttaatttaaaaagctcccatgcttggaacaatccaaagactgagggtagtacagccatcaaagaagaaatatgagaaaatgatctcaaattattctcacatatctttcaaaataaacatatggactacatcatacgatcgctcgctacaagtcactgttacgtcctaaagatactctgcatctcatatatgcttatatacataatattccaggctgatgtcaagatcaaggtttacttctaatttaatgcagtcttgtattcataatatatcttccgtccccttaagttccattagaccatagcaattccatggtagctcagtagctcaccatcatagtatccacgtcactttaggagaaatcaccaaacgatttaagtacctgaattaattgcattcatgtgataaactggtgataatagtcaaaatcataaataggaaagat

SEQ ID NO: 60285 - DNA, 781 bp, Oryza sativa
agttattcataatttatattcccaagatttgacttaaacattgtcctaaacgacttccttcacgagtatggagggagtatgcgtttgtgttcggcactcacttttcccaacccctcctcctctttttcagcacgcacgtttttcaaacggctaaacggtgcgttttttattaaaaagttacatacgaaagtttcttaaaaaaatcaaattaatctatttttttaaaaaaattaactaatacttaattaatcacgcgctaatgaatcgctctgtttccgcgcatactattccggttgggaacgtggaccagcgaacacacccaacttgcgaacgaagatcgagaccggtctaccgttgtatttccggccgaaatcctcctagagagtttgtagtgcgcaaggagatgtatcatcatttcttgggtggtgtagcacaagtgatagatctgctcgtttgcacgtcgtcgtctttggaattaaatttgaaaatatactgtttatctaatttttttcaggaatattcgggatgaaaattttttttacaaatataccatcgatctcgcgcaatcgttgtgcgaaaatgacgtggacatgatgtcaccagcggtatcgcgcaatgaaaacgcgagaccgtgcgatatcgcgcggtagcggcgcgagaccgcacggtctcgcggaagcaaagagcgagtccgctcggtatcgctggttgaagcagcgacaccggcatggctgtcccggccgtcaatggttaattacctaattaactattaactaataat

SEQ ID NO: 60286 - DNA, 20109 bp, Oryza sativa
  unsure (1)..(20109): unsure at all n locations
tcttacagtgggccattaataaatacatcatctctcttctctaccaattatatttattcttcgtctattatgaagacactattctctcccaatgcaaaacttgatagtgtctagtgcataggttctcgtgttgaagctgtgtcttgcataagatccagtttcttcctctcttcactctctcttaattaatatagtgccacataagctaaaagtcctacatggcaatgtagttaatgccatagacaccatcctagatggagagttgtgactgcccttaagatggtgtttatagcattaaataagcagccacctaggatgaaaaatgatgtggcaagtgaataaatgaggaaagagaaggaaaccatgtcttgcatgagacatggtttctacataacatccaagacaccatgtgagataagtagcattaaagttaagtatggaatagtggtgtttgcattggaagagtagggtctagtactagtttcttgatgatgtggagtttatagaaactatatctagtgtggagattatgggtaccacatacccacacggcatggttatccgactagttataggggataactcatatctatgaaatatgtaacagatcatgacttgggtattacgtttccttgtatattatggaacagcctagagtcctgatttgataatgttgtaaagtatatttaggaaaccgataccgtattggttaagatttctatcatgtaatcttgctcctcaccctatataaggtgggcaggaggccccctctagggggtatgacagaatatgatcgtcagatctatactacacccggcggattcaaatccccaaacaggagtagggtattacctctcattgagaggacctgaacctgtctaaattcttgtctccgcatccatccacttttaggtctcgtgcgctaccctcttttattattgctaaattcatgtttcgacagttggcgcgccaggtaggggttgcgtcgaatttcccgtcgagaagtgcgatggaatcaactccatgagtcgccggctttgtgttcacttcagggcagatttcttgcatgaggagtttgactttctcgccgccgacaatttcagcaaattcctgttcgatctcccgaacactgcagtgatctattccaagctctccaagcagccaacttcaaatccaatctgacttcggtcagcctccggtcaaccgctacattcatcacatcaatctccgacgtcagcatatacgaggatctacatggctcagccgctaccaagaaatacatcaactctcagccaccgccaatgttttctcgtcaaatatcaaagtttctggcgagattcaattattaacatgaatcggagttgatgtgggctcggagccgactgatcggactcagccatgcatactccggactcatatctggccctgcacgccgatgacatacgtgcatcattaagagtttgtgtgacaaacatttaccaggtctatcgttttaattttcttacataatctagaattaatattgatttttctagtcatctaattcacagatttctaattattttctgatctgttatttttgtgtgcacatacatacgtggcatccgccgccattgattggtgccttcacctccacggttgatgaactccgccgccgttgctgatggcgacattgtcttgactgccggccgccgtcatcgccgccgactggtgccctcgccttcacggttggttggtcacatcaccgttgttgggcatctatgtcttcaccgctggccgcctcgtccgccgccaactggtgttctcgcctatacagttggttggtcacaccactattcatgggcgtccacgtcttcatcgaccggcctgcctctgtcgccgccgactggtgtcctcgcctatacggttggttggtcacaccaccgttcatgggcgtccacgtcttcaccgccggctcgccttcgccaccgccgactggtgtctccgcctgcacggctggtttattatgccgtcgttgttgggtgtctacgtcttcaccgaccggtctgcctctgtcgccgccgactggtgtcctcgcctatacggttggttggtcacatcaccgttcatgggcgtccatggcttcaccgaccgacttgccttcgccgctgccgactgatgtctccgcctacacggctggcttattatgccgctgttgttgggcgtctacgacttcatcgccggcctgcctccgttgccgccgactggtgtcctcgcctacacggttggcctattatgccgtcgttgttgggcgtcttcgacttcactgccggcctgcctccgtcgccgccgactggtgtcctcgcctatacggttggtggactccgccgccattgatggacctcgtcatctacaccaccggcttgctcccgccgccgccaactggtgtctttattgttattgatggacgactttgttcccacattggccacctctgccatcaccaaggggaatattacaaagctaagtcatcattaaattttctttatatgatattttcttttttctctgcctcactacatcaactggtttgccgttgactagtgagtcggtggctacagatgttatatcatattttttcaacaattttcatactatttatcttgattgctcgcgacataatctgagtacaaaagtgcctatcgagttatggagttccatcttcctatgatttccgtttggtttgccaatggatagttgccattgagccgattcctagcaccgggggctcgttggatggaccgagtaacgcaaggtgctaagtattactcggaataaatcaaaagcatagagataaaataatttattttctgctcttaataattgtaaaagtacccgagtagtaaactctgatccgtgaaactttgttccattaatgacgaactcatgtccctcatatgcatgtttgggaagtgcctaagccgactcccaatgcttggggactatgactagttaggcagagtgtttaaacgtaaggagtcatctgctcggagaaatcaaaattgacaagaggagaaatacatatttataaatattttaaaatacttaaattttcctcgagtattatatttatatcagatactactcatcctatatgtttgttctttaggatccagatccagatatgcataaaagggattcatggctttaagcttatctcctacgctccaggaatggatcagtcagaacatcaccaccggcttgccctcatccgccgccaactagtgtcttcgcctatacggttggttggtcacaccaccgttgttgggcgtcgttgtcttcaccgaccggccgcctcgttcgccgccgactggtgtcttcgcctatacggttggttggtcacaccaccgttgttgggcgtctacgtcttcaccgaccggccgcctcgtccgccgccgactggtgtttccgcctgcacggttggcctattatgctgctgatgttgggcgtctatgtcttcaccgaccggccgcctcctccgccgccgactggtgttttcgcctgcacggctggcctattatgtcgccgttgttgaacgttaacatcttcaccgaccggccgcctcgtatgatgcctactggtgctaccgtcttcacggttggccacgtcggcgccactgctaataggcgtaatcatcttcaatgcaagctgtctacgtctgctgccgactggtttcttcacctccatggctgcatgattctgccagtgttgattggccttatcatcttcatcgccagtcgtctcgtctgctgttgactggtgtcctcgctctacggctggtttataccactaccactactgatggacgtcatcgtcttcattgctggccgtcttgtctgacgctgactggcttgttcgcctcgacggccgcgcgtctttgtcatcattgactagcgtcatcctcatcgcctgtttgccttcgccgccgcccatggtgccttgactttcatggctggcctattttgctgccattcaaggacatattcattttcgtcatcattctacttcttccgtcgccgactggttaagccgccgccgactagtgtttttatcttcacaactacgcgtcttcgctaccagtttgcttctgttgccgtcgactcgtgttcacttcatcatggctatgcaaccttttcaccatggtggagcgactttatctttattgtcttctgcaccggcaaaaccaattgccgctacttcgcaagttttgctgcttcaccaaccacgacatctacaagagcctcaacatctcggcatgcctcaccaaatatgatgtcgtgttattttacaacaacaagtggtgttacaatcttcaatatttctacttggacatcttcaacatgcatcttcactctagtgatggctgttcgacgacaggaagctatagttctcgactctatgttcaattgctttccaactaaccaaagagtcgggggctacacaaatacaagactcaaaattcgacaagttttatgtcaagatgaagtaatcaatcaatcaatgagtcaactctaggagttattatctttatcttcgcttcagagccgaaatttgacttcagcgactccaattattacaccggcatttggatttctagacgctgccacaatttactctaaaattttcaactatcaagtttgagatttaatctacatgtccgggagtttagagttatcaaccaatcagctcagttttgttgagttggacaacagcatatactttcctccaagtgaagcatctgcaacagctacaagaccaagttctactggcatctttataaatcaaggggcgttgcatcagtcttcgttatgcacacgctcgcatcaaggaaactactcgagctttgatatcttctcaatagtttgatggattattgtcactgacatcatcactagcatctctgcttcatcggccctgacatctccgctattgctaatggctgattatgtcttcgccgacttattatttcaccttcacgggttacctactacgcaaacgctgatgagcgtcttcgtcattatcatcggctgctacaccgctattgattggatcgccggcatcgtcatcttcatcaacatcctgtcaagcctcttcaacatagcctacactgctgccgttgatgggcaacttcgtcaccatagccggctatctttgttgccgctaatcatcattaccgtcggatgcgtttgccgtcgccgactattttcttcatcttcatgattggtggattttgccatcaccgttgatgcgcgtctacgtcttcatcgacttgctttcgttgccaccgactgctttgtcgttgttgttgggcaccttcatcttcattgctagctgacctgaccgctgccgactggtttctttgcctccacggctgtgcgacttcatcacctttgattggtgtcactgtttttactaccactgacatcttctgtcagctttgatgggtgatatcatcttcatgttagtcatttcgtctccatgtcgactgcatcagctattgccaatggacaattttgactatgacagaaggacaagctatatatttgctcaggggcttatcaactcaaacacagggatcataccttcaagttggattttgttctgagattattttctatgctcgaagactggaccaatcattattccccgtaagggctatcaaccgaatacttgcgccagtcgggattcaatttttatatctattttggagtatcccataagggataatcactcagatcaaaagctattcatatgagctacacttggtctatatcactcggaagatttattactcgagagcatgttacatacgtcatcctttaaagggtgttgaaggcatatttttttggcctaggcctaatatgtctgtagcccatattttcaggtgtggcctgtcacgttcttttagggacttaggcactttttgcttatgctaaagtgcgcgtgatcaagtgcccaataccttaaaatccttttataccgcagttactcaactttttaggagttggtacaatgcattttaaaaggtgcccagcagtgaacttttttcatagctgtcctactgacttttttatatagttaaggcgctgtttgggtttataaagcaattgattggataaaatatcattgctttttgccacgtaagtgtgcatttttattgaccaatattatggcttaggctgattatatattgaggtcattttccaggcagttggtaaatcctttatgagtttatttactcggatgttacaccacatatgccatatatttttaggtgtggtgaaaccatgtgtcttttagggacttaagcacatctgttaaagcagtgtgcgcatggcgtatgcccaatacattggaaatttctttattcacaacatacaagcttctttgtagctgttttgctatgtgaatttttaaatgatatagtcaactttaggttgcacgcatcatatgttacaaagcagtcggtatatcacttggatcatattattcagggattcacaccgcatatgctatatattaatattaagtcactcggttgactacaattatcaaaaccactcagttggttggattatttactctttgactatatgtttagtttgttcaactatccatatagtcggggcctacacctattaggtacatctagtcgatgcacctaagtctacagtcaattatttttcagccctccacagtcttcaaatttggtaaaagtactcgggggaccatggcgaagatgattgaagcactcggctttgcagtaatctagtgcgagagaagattatcttttcgactgcgaatgtctcaggggctactgtggagattatgggtaccacatacccacacggcatggttatccgactagttatagaggataactcatatctatgaaatatgtaacagatcatgacttgggtattacatttccttgtatattatggaacggcctaaagtcctggtttgataatgttgtaaagtagatttagaaaaccgataccgtattggttaagatttctatcatgtaatcctgcccctcaccctatataaggtgggcaggaggccctctagggggtatgacagaatatgatcgtcagatctatactacacccggcggattcaaatccccaaacagaagtagggtattacctctcattgagagggcctgaacctgtctaaatccttgtctccgcatccatccacttttaggtctcgtgcgctaccccttttattattgccaaattcatgtttcgacatctaatgtcttgggttgagaatgaccttattgtagcagtagtagttgtactaatggactaatggactaggcaggcatgactgaccgcgcggatgcaggcccgcgcggctggtcgccgatcaggcacacccaccgccgccacccctcccccacactgcgattgaattcttgaagggacaataactgattcactggatgaaaattgaagtccccaaatatttcgagtaaaattaaaatctgtctttttattgctggacatgtatcctattgactggccaaacacgatcgaggcaactgaatttttagagaaccgttggttcccacacggacgccccaggaaaggacggaggtagcgttgggaagcgatcgggaactgaatagaagtgttcaaccgaaaagaccggaagagatcgggagggcaaggataggatatagagaaaaaacaacctgcaccatctattaaattgaaatcaatatgtttagattaaggttaatatgaaatttaatattagttatgtgcgacatacgccatgaatctttcattagttagatgcatcaatagtggtctctgaaaaagaaaaaaaatattggttggtttctttaagtatatttattttgaattgtcatcgtgcttagtttagatatatatctaagcactacttttcttttagtactcctgccaatcgaggcatcgagccttttgctcttcctaaccccagtcgctcccaatcaagacatcgagagctgccagatttaataacagcacagattttctcccgattggaagaggattggaaaaaaaaaaaaaaggaaagaaagagggccagcctcctggccttcaggacattagacaagttggcccatactccctttggcccagtaacacggtgggggcgaattcccctcgcttgcgtacctcgcgtacccgagttaggtaaagattagttcgtcgcaaaccgaatgctttgtagtcaacacaatcttacacaaaaatctcacacatacctggaagagatggggcctgagagatgacatgaggcaggtcatagttgatgcccctaatgtgcttgtaccgcgaggtgatcatccccagggtggatccgtcacccccaccgacatcgacgagctgctggacgccgtcgaatccttggaagcgttcgagcatcttgctgaccagaatcactgaatgctgcgccatggcgtggtcgaacagcgcgcccagccgctggttcttccccatgtactcgaagtagagcaacccgtgtgccctctcgaacggcgccggcccgccactagtcaccgctgccgctatatgttgcctacaagaacatgcatagcagcatgtgatgtattttcgttggcggtactcttaaaattaactctacctgtagaaatcaacttttacagacgggactatatctagctggttatctggaaaaatgaaaacccggatcggatattggaaaaaatcgtcaaatttttatagcgataggaagaatacgtatatataccagggcaataggtggtcctcgtcgacaacgaacacagtgaagggagccagcgatccctcgccgttgtttctggtgagccaccggcacaccggcgctggcatgtagcgccggagaagtgcgccgtcggggcttgtctcggtggagcacctcaccacatcgaaggatgcgaggtaccggagaatccgatccaccgagacggccacctcggccttgtccgtggcctggattttctcggcaagctcatccgcggtcagcgcgtttccagcggccgcgctgagcgcatcgagaagaccaagctggaccgccgctctcaggaccatggagcggttgtaggcaaacatgagttcttgcgcgtacaagcaatgctcatcctccttctcttgagcatcactagcagcaacaattttttccatggctctaacacgaacagtcgtctaatcctgtgtagtgtattgcatttgatgcctcttacatggtataccgagtatgtataatgggagagcgggggcagggaggtgccgagtcgtggtgagcgaactgtctcttatttccattgtgtcctctcttaataatgacaagtgcgatttttttccatggtcaacaatcctgtactagttttgctagctttgtgattaacttcagacaacactgtacatcaattttacaagagaaaagctaaataaaattattcaagtttttatatttaactagttacatacctgtgcattgcaacggtaccagatgatacaaatatgatttagtttctttctatgtcggtttttataattggttggattttttttgagcgttttttaaaggaggaagtgattttttttctttaactagagggaacggttcttttgttgttggaggggagtaaggggacgattctctaaagtattatgacaattaatataagattataagtagttttatgggctacccatgtgtaagacgtccgatgaaactcgaaaaatcgaacgcccacttctgtgcttttgtagcctctagctttctcctttagctctatacatgcatgttatatgtagggcccacatacccccacttttacatacacgctctctttgcacactcacttatttctcttctcttccctaagtaacttagttaacaatctttaaacttttttcctaaattaccttttcaatttgagatataattacattgttatatttactacaattaattaaatattcaagcaagatcttacatgattatattatgaataacaaacaattatattttgaattgaaacatgtttgtattatatatgaaacattgaattttaactgttgaaacattaaaagaatataacatgcaacattttacaaacataaggaaaaatacttattgaaacatctaaataacacaatgtacaacatttaaaaaaatctattgaaaaaatgaggcagccaaatgtttcagtagactacctatgaaacatcaagatgcacttggtgaaacataaaaaagtagtcattgaaacaattaaataatttgtgaaacaccatgaaatacttgttgagacatttctctatcaagtagaaacattaaattttaacggttgaaatttaatgcctccatttttgtttcaccattttgacccttgatagagaaatgcctctatttttcttttctcaggatataaatataatcaagtgatatcttgttataaatatttaattataattaataaaatggtgccatcggatcatagattaaatatgtaatttatgagaaaaatattttatatttgttaatagaaccagacatgcatgcttaagagagtttggaaagaaagagtttgtgagagacactagtgcatgcatgtgagagatgatagggagcatgtgtggagaaaaaacatctctgtgtcgttttgtacagtgtagaaaaagtacatagggtgtggtggcatccgacgtctcggatgggactttttgtttagaagtattgtctgtagttttacggttgaagttgtaaagttctgctgtagagtaaggaccataaattttatacaaaatttagttcgccagtgcgccaccgccagccgctagggccgccgccgccgccgcacttccccagctgccgccaccgccgcacttccccagctgccgccgccgccgccaaccgctagggccgccacagctgctgcacttccccagccgccaccgccgcacttccccagctgccgccgccgccgccaaccgctagggccgccacagccgctgcacttccccagccgccgctgccgccgtcgcacttccccagtcggcaagaaggtcccctcctcctcctctaccagctgcttgttggtttggctcgcaagcctaactagctagctcgagctttcaaacgagccaagccgagctaggtttctagctcgttaggatgacgagctgagcgagccgagcggagccgagccgagctggctcactatccacccctagtctacgcgctgcagggaacagggctcgactgaagttgattgccgctactgattgccatcgcccacatacctcatgctgtttgaggtcatcttatcgctttaaggtactgataacaccaaaatttggtacttttgtttagtggattcggttaaataaaaactcgattggaagatggaaatttatccagatcaagccgagtttttgagcagggctgcattggttttgttcgatctccaacaagaaatcaagttcagggccttgctatcgagttgggctacatcgtttcgatctccggcgagtaagtaagttccgtcaacttcacttgtatcggtttggctagaacattctcggttaggtccgatattctattcaagttgatgcaagtgttgcctatcagatatattgattctatctttaacaacgtcattgtttacagtcgtattggcttagttaggactttctcgattaggtccgatattctgactaagttgatatttctctaatcacattgttattttagattgatcaatatatccatcacgtttatatagatctatcggctaaataagtttttgttattatgttcaatcttatattatctcggttaggtccgaactattagattgctgctaaataagtttaattctagtaaaccgaaaggtttttatgcaacgttcatcggagttctagccgatgagttatcattattgtgggcttcagctataagatgtatcggttagttagccgatatatattcgaaatctacctgcatcaggttttcagccgatgtatgctttaaccatcaataatcaactatcagctatcagtttcagtcatcagttataagttaaatcctatcgacaattattagttatctgattagttgaatttacattggatctaaagccatttgataaaaaccttaacgacatcggctgacctcaatacatcacatcggcttattggttgatcggctctttgatcttatacaatctgtctacctatgttgttagttgctggatttagaacctgcactgaagctaagcagatctcctaggccttcgtgtgttggtgcagatttttgcatcaacaactataccgatggctgggctcgaataggatgcacctgaaaccaagtatggcctattgatataatcttttgcaggttcatgtcgatgaaaatagaccgactcatgaattattcacatgcgtggcgaggtttgggtgggtgggtctatgtgaaccatctaggcccctgttgttaattttggttattaatgacaagcaataattatgaactaactattttaattgagcgatattttttagttagaaccacacgttgtacatgccatggacgatcactgcggattaaaattgatggcgcaaagaaatggaacaaagacggtatatctagcattttattttcaatcgattgatgagttgtgcgatcgaacttttgctaggtttatttctagctttgccgtactttcaagaagggtaatgaccttggtaaaatgatgataaaaatgccacattaggtcatttgcatcaacacttgtttcaacaaaattttctttgatcatttgttggccattggcggtctgaccgggatgccaaggagccgggaggctgccctcggcttggcaatacagagccgctagagccgatgccggtgttgttggaattaatgaatgggccttagcccactcgaagattaattctttggaaaatcacaaaagcccacctcatgggatggtatgcatgtggagtttagtaccaccttgcttattctaggagagggggacctccttaaaagggaggatgccctcctagccacttgaagcatgtgtagtggagagaagaggggaaacacacgcgcgcgctcgctcgcctcgcctcgccgggccgggccggtggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacttgtcgtcttcacgcaacacttgcgaaatcaatctagggtttatctcctactttgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcaaccggtctttccgtcacctcggtacgtgttcaatacgttgcgcatatttgatctgttcatgttgtactgtgtagtttacatgtatagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtctagtgccaatattgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcaacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctatgtaacatcctgaaaattcccaacaataaaaatcactaaaatttcgaactttttaaaacttttgcatcatgctggttgttatgattcctgttgcttgccaaaccataaatgatcactaagaaagtaaagaaaagaactacatttaagcaatagatatgatttacgagaatatatttaatcctacaaataattatgcacaagatattaaaatcaaataaaataaaagttattattaacctattttatcaaatattaaaatatttgaataatataggtgggtgccataatacgagtacccatgaaatgatgatcattcaaatgaactgagctctctgtatatataatagaattacgggagtatttaattcgatatgtagatcgattttgcaccaagttcctaattgcatttagggattgaaatttgatatattaaaacccctccatataaaataaactaacatatagataaattgagctaatgtgctattatgttaataacgatctcattagaaaattatagaatctttaataaacctcaaaaacaaattggtaaaataaatataaattaaaaataaagattaggtgtggatagtaataaataaaatattgtcgcgaccatatttggatcaattaaatttaattgcgatagcataagaatttaccctaattaaaactcaaataagttatataaaaataaaatatgagtaatattaacctagggtgaattcattagttgagataatacacatattgagtaaacttcgtttatgcaagatttagaaataatagaatcaaattcatataggaaataacctaaaatcgggaataataggaaagtgcactgttcattgcccgccacgtgttcgacctggtccccagcctttcccctcccctgccacgcgcgccgctccgcctcccctctgccgcgtcgctcgccgtcgcatcaccgtcgtcgtcgcgtcgagccccgtgccgagccgcgcccgtcccgctgccgcgccgctccccgtcgcgtcgccgtcccgcgtcgcgtcgccgtcccatcgccgcctgccacctcgccccgcgcgcccacgcaccccgtcaccgcccgtcgcgtcgccgtcccctcccgcgccgagccgctccgagccccacgccgcgccgcccgctcgtcgccatcgccgcgcgccgtcgcccgtcgcgtcgcgtcccgtcgccgctcgtccgtcgccgtcgcgtctcgcgtcccgccgcgcgccgagccccgcgccgccccgagccccgcgcgccgccccgagccccgcgccgccatcccgtccccgcagccgcgtcgccgcccctccccctcctctctttcccctcttcttcttcccctcttcccctcttccctcttccctcctcctccttcccccttatctctctccctccccttataaaagcctcactattccccccccttctcnccgtctccaccacccactcctccacgccgtcgcgccgccatcgtagtgccgccgcgccgccatcgtagtgccgccgcaccgccgccgttgtgctgccgcgccgaccgtttccgtgcccgcaccgccgttctcgcgccaccgtgcgccgccgtcgctgccgccgtcatcgccgctgccgccgccggtgagtcgccctccgtttccctcgagtccgccgccgccaccgctcgggtgggaaagagagagagccgagagaaagagagggagagccgagaaagagaaggagaggaagggaggaggaagccaggagagaaaagaaaagaaagggagagaaagaaaaagaaaagaaaagagaggagaggaaaaagggaaagaaaaagagaaagaaaaattaagagggaaatttaaaatatttacaaattttagaatttaattatagggttaataaaagtgtagttagatgaaattttactaattaaatacctaaaatactaactcttaagtataggattaatgaaaatataaatggatgaatttctatagattatagattatttttagtactctccataagaaatcaattcacagtattaatttagatgtaattaataattgaacaaatgtatgaattcccgtaaattattgtggattatttttgggtaatctctataaatgatccgattcacggtataaattcggacttaatcgctaggaatttttagacgtacattatatttaattgtttagtcataaactaaattaaaacgtgtaatattataagataattttaggatcccgtccgacatttagctcgcgatagaaatttctaacccaatatatggatataatgctagggtagattaatttaaaaacttatgacaacaaaatatttatacccgcaaaatactttaaatcgaaattgggtttgccgtagttcgcagatagtaaagttaataaaaaggaatcgactttcgcattcgacttttactcggatttaagtgaaacttgaacctaaattcatctaatttcataagctttccaatgatatataattcactattggataaaatatatttataaaaattaaataattaatatcaagatgatgcataatggtcaacttaaaaatatgctaataaataaaattagtattgtacagcagaataattatctttaatatgttctgtcactgtagcaaccacataaattaagtataatcgatgtttgaagttaatgggtatataggaaaatattagtgccatttattaatctatgtccaaatataattaaaacccacgacttattagttatttaaatagagttaggcttataattattaggtaagtaaaatatagatacacatagatcggtcctaagcttgtttatggcaaataataacagagctagtatgattaaatcacctatatgaaattaatcaatgacatatcccatataatagcatatagtgggagaggtgagcaacccttagttaaccaagcagtaaatagaaactattcaaataaatgattcaatatattaagatattgtgcacacatatattgtacatcccattatagatatatggtatcgtattaatttgcttgttgcatatattaatttagagggagtacgtgacgaacatgaatattagataaatactagttatacatcttgtcctcgtataattacagatcaactgtaaatttggattattcattgtaaaattatgtgatgggataatccgtaaccataatatgattaacctaaacaattctaacatacaaagcatgggtaattgctaaccttttatgatttattttgacaagtgaaatatgtacataattaaattaaagcctccattaataaaataataatacaaatgattcacagtaattatttgaccgatccaaaatccatccggcaacagaacctctagtgtataaccgttctatttagatagatgcatgtgtaaccataatccttccttagccattagctagactgaaccaccatgacaacagaaagactgaggaaccttagctcttagcttgattagagtccattagcaagcgcgaataatatgagcaaccctaggttcgacctcagcaaatatattttgtttgtgcatatttgattgttgcttgaatattggtttttctcgcgtattatagactttgtgtatcggttagtcgtgaggcaacgtctgcaacttccaggaggtgaaggttgatcaagattatatcgagaataaggattatcctgagcaggcaagtcatcactattccttgaacatgttgatcccaattggagttattttgtttacaaataaaattgcatgcaaagatgaacatcctacttgtgattatgccatgccttgattattgtttatcccttattccttcgtaaccatgtttacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatattgataacatgatttgtgaaaggagaaataaactaaataactgttttcgactggggcggacggaggatttgggtggtatctggaaaaggctagtaccgtccccggt

SEQ ID NO: 60287 - DNA, 6804 bp, Oryza sativa
atacataattctaattataatcttgaaaaatactatgttatttgtgaaaatatttaagctcctattagctcatctctatacgtgacgaagcttttccggctccgacactgattacaactagggttttgtttagtttgtgtgctaatttttttaaagtatacggacacatatttgaagtattaaacgtagactaataacaaagtaaattacagattccgttcgtaaactgcaagttgaatttattaagtctaattaattcgtcattagcaagtgtttattatagcataacattgtcaaatcatgacgtaattaggcttaaaagatttgtctcgtaatttacatgcaaattgtgcagttggtttttttttcatccacatttaatactctatgtatgtgtccaaatatttgatgtgacagaaaagttaaaagtttgacgaaaagattttgaatgtaaacacggcataggacgtgctcgtgtaaactccaacgtgaatttactgggatattgcgtattccgtgtctcccatacccacacaaggagtcaaaacaataaaaaaattgcgtgtcacaatcatatggtagccaaattttgttttttttaataaaaaaaagagaaaatcggaggtgatgaagtgttatatattatctgatgataacacaaaaattacgttacgtgtttgatgacaagaccaagagatctgggggccatattcatccctaacataagttaatgtgcgggttggaagatcagctttgcaagatcatctactcacttagttcccaaatactataagattttgagtggatgggatgcatatcctagtactagaatctagataggcttatctagattgatgcgccacatccactcaaaattccttatattttggaacggggtagtaaatataatgtctcatgcaaaatgaacaaactttgatattttgtgaaaaatgaaaaactttgtagcgttgtattagaaatatgagccttctttacaacatactaaaaaaaaattacccatcaccgcaggaatcaaactgttctttttaatttttgtaaaaatctgcaaaatttctgtgagtttgctacgcttgcagtgatgccatagtgtttttaggaagtgacaataattatgcaagggaaaaaactgtagaattttctatgtttttttacaaaatatttcgatattttcgcttgtacatgcaaattagcaatttatttaagagtaatgtgctaataaatcaacaacatttttgaaaaaaaaaagtgtgtgaatctatctagtttctgttgcctaccgtaaatcattttctgcatgaacctgaggcgtacaaagttggcctagctctgaaaaaaatctactttttttcgcggggaaaaagaattaaaggatgcacttttggaacatgccacgatagatctactttgtttcccaaccactctaaccaaaatgattgtcctttcctttcagttcactcctttacaccaatgtaacatccaatcttaatcttatcaagtgttcagtaaacactaacaccacataaagtcccaaccacttggtttggtaggccttgctaaaatgtctaatcacttttcaattagattaattcctgcatcgtcatgataaagaccagatctcaccagactctgcagccctgtaattagcattagtcattacttttttttcctgaaatcatttacctcaaataatcttccattgttttccttcatggaataattttgtgttcatgtcgttcaactggtgttatcattagcaagcacagtactacacttaatcatcaattaatgaaacattccatgaactgaaaaaggaacaggctgtgatgctggacatattgggttagcattaaacccactcgagtgattagctttgctttctttgcaagctcaattagttggttaatcgcattcattggggtaaccggtaacctctcaaatctttttcagcaacagaaggcacaagaaaacagtgtccctatattctggcgacacaaaatccatgcaaacacaaaattcatgattgattttgtagtggatcaaccttgccaatttttttgtaaattcgatttttcatgatgtgcaagtggttagctttaattgaagtaaatgttgggtttaatatccgttaaaaaactaggaaacgaataacggtgtaattaaccattaggcagaattgcttcgatattatcttcttagttattatatatctgaaaaattaggaatgaaaattccaagccgacacccaacatatctacaagataggacattgcattcgcatcatttaaaacagagcaacatcatctctccagtacttgcacccatcatccaccacatccatctgatataactctcgatatatctctatctccaacaattaatagataccgcaattaacaaaaatcccaatccaataacccccaccaaaaactaattaatctctgacatccataatgtctgcaattaatcaatctgttaatctgttattagtagttactactaacaattatagagtatattaattaatttaagctaaaaaaatggggcccacaaagcagaggaagagaacccatccatccaaccattcataaaatctatctagaattccaacttaacaccaaatctattggtctcttgtcctcatcaccaaaccccatcttcatcgtcgtcatcttcaacccccatccccatatcttcctttgcctctccttcaagcatcatcaccaagtaaaaagagaaaaagaacccataaatttgaagaattttagcttcattcaagaactcgatcgaggagggccaagaaaggtgtgagaccttgatttggtcgccatgtcgagccccatgcatgttcgcaaggcgatccacttcgtctccatgaaggccaagctccagagcttcggcggcctccgcctcctcctcgtcggctgcctcgccgcgctgctgctgctgttcgccgtcaggacgctgtcgttcacgacgtcgtcggcgacggcgacggcggcgagggaggcggcggaggcgggctgcgggaagctcccggcggcggtggcgcaggcgatggtgcactacgcgacggcgaacgtgacgccgcagcagacggcggcggagatcggggtgtcgctgcgggtgctgcagctgcgggcgccgtgcaacttcctggtgttcggcctgggcctcgacagcgccatgtgggcggcgctcaaccacggcggccgcaccgtgttcctcgaggaggacgcgtcctggatcgcctccgtcaaggcgggccacccggggctcgagtcctaccacgtcgcctacgacacccgcgtcaccgacgccgatgagctcatcgccctccgccacgagccggcctgcacgtcccagccggacctcgccgccgccgccgccgcgtcgtgccgcctcgccctccgcgggctcccgccggtgttccacgaggtggagtgggacctcatcatggtggacgcgccgacggggtggacgccggagtcgccggggaggatgggggcgatctacaccgcgggcatggcggcgcgcgccaggacgcccggggcgggcgccaccgaggtgttcgtccacgacgtcgaccgccacgtcgaggacaccttctccaaggcgttcctctgcgacggctacctcgtcgagcaggtggggcgcatccgccgcttcgtcatccccagccaccgcgacaaggacggcacgccgttctgcccttgatgagagatgagcttcgccttcgccttcgccgcgcacatggacaccgtgatgacaccattgccatcgtcgtcttcttcatcttcttcatcttcttcttcacatatgacaccaccattgctgccgtcatcgtcttcttgaattcacatgtcttttgtgatgatcaaggataagtaggatgatgagtgcacctttgggatcatgcaccaatggaggcggtggcgcgatgcgtgtgagccgtcggatcgagaacggacggttcggatcggaccgtggagatattgttattatatatagtttcttttttttttcaaatgcagctttttctttgttgttttttttatggacggtgggtgagatggatatgcaggcgaattataattcttggctatttttcatagattatcgttgtgtttctttttaattcataattgagatatcatcttcagtgggtgactgatgagtggtgccatttgagattcctatctactgaagcaataatgctaagatagaaacttacataatttgttgagaaatgcagttgatttttagatgattaacaattaatgtggcagaagtgagggtgtgaaattaatactctactcactttaaacagaagagtagagtactagtaccattcaactgcactactactacagtactatctttgcacaagctgatgtgtgagaggagggtgtgacctgattttgattgcctattggaatacctggagtacattgccttttgccaaggctgtgacatgcttggcattttgtaggcaggacattgatttcctggcacatggcccaagtatgatgaactagtaccatgaatatgaagtcaccttgggagatgggcatcaacatatgaactgccgaagacttgacaatcgtcctatgctgtgtagcagcacaaccctttcttctgggcaagtgcatggctctgattcaacaagtgtattttctctttttatatatactagcaacatgtccgtacattgcaaccgataaacgactactttggctatgatcgcaagtaaaggatttcaaccttcacttcctagagtttctgaactactaaacagtttttttcttttttttttttgcaaaagttttataagaaagttgttgtagaaaaaactcatattaatctatttttctaaattgtttaactaatactccctccatcctactgtaggtgcagttgctagcttttatgtgtaacgtctgattgtctgtcttatttgaacttttttataattagtatttttattgctattagatgataaaacataaacttatttttttattttttatattttttttaaataagacggatggtcaaatgttggataaaaaacccactactatatgtaaaatgggacggagggagtaatcatgtgttaataagtaatcttgatttccgttcacgaggtccctacctctccttccgatttccgaacacaggcttcgtctcctcattgggaacctcactgtttgtaaggtagggtttataaaatcatacggttatcgtggttaccatgcgtggtaacctttttattttttaaaaccacaaaatgtctcgtggttaccatgccgatcttaccgtggatgtgtggtaactgtgccaaaaacgataagagaaaccatgttgcgaggtcaacacctttttgccgcacgtctttggcaccgtccagttcgtcgtgaacgtaagatagttagctcagagctcatcttgattactactaattaatctcatcagtgtcatcacgttgctttcttgcgtgtgcagaggtgatcacagcaacgacggcgatactgcttggatggcatgaagtggccgaacggtctcgccgagctctacacagagcacaccgggacgtccgccgtcttcgctgccttaccacatcgtcattgatactacctcgtcatttttaataaatgataccattaactttttatcacacatttagccattcgtcttattaaaaaagttatgtaactataatatattttggtgtgagattttttatcactcaagatactttaagcaaaatttatatattacgcatttgcgtaaaattttttaataagataaattgtcaaatatgtgttcaaaagttaacggcattatctctatctctactactttgaaaataagagatgcttccatcattcgtcaaaaaaccggtcaaaaaaaccgggcgaaaaaaccgtaactgtccgataaaaaaggcaaaaaaaaatccgattccgtgaaaaagaagggcgccaaaaaaaccgtcgtaaaaaaccagacgagcgagaaaaaccgtaactgtctgatgcaaaaaaaaaaaattaatccttcgtccgtcaaaacaaaaaaaattagcgaaaaaattaaaaaaaaaagtccgactcctatccgattccctctcagaaacgaaaaaaagtccgactatagatccgattcccccgaaaactaaaaggtgccactccttttgagtccgagataccagccaccactcctcttagatccgaacggaaaaaaaatctgattcctatagaaggcaaaaaaaaagtggtgaaaaatacactagattcgattcctttaaaaacgggaaaaaaaaagtctgattcctataaaggcgaaaaaaactgaaaaaacatcttaaaaaagttcatccgatccctaagaaagtggcgaaaaaaatggttcgtaaaaaataaaaagttggttcatacaaaataaaaaatgtacacgagaaaaaaatggaaacaacgaaacaaagtctgatttctaatcaatagatatctcttctctatctctaatataatctaactatttaaaaagagaaaatacacgagaaaataaaaacgattaaaaaaacgcgtgagaaaaaagtcagaaaaaagcgaaaaaaacacgctaaaaaggttttccatcttccataaaaaaaataaaaaaacacacgagaaaaaatatttccatcgtcggtaatttttttaaaaaaaagacatgcgaggaaaaaaaactggtagaaaaacgctccgtttcttaaaaaatggttttagaaaacggcgcaagaaa

SEQ ID NO: 60288 - DNA, 786 bp, Oryza sativa
cgttgtggggatcagatagatagccagcatcagtatacctaattaaagtcgaatcatggttctttttaaagaaaagtccaagatctcttgtgcctttaagatatcgaaagacattcttaactccagtccaatggcgtttggtaggagcagcgctgtatcttgctaatagatttaccgagaaagcaatatctggcctcgtactatttgcaaggtacataagtgcaccaatagcactaagatatggaaaatcaggtccaagtacatcctcaccatcttcctttggtctgaatggatctttctccacgtctagagatcgaaccaccataggggttttggaaggatatgactcgtccatattaaatttctccaaaattttctaggtatatgcactttggtgcacaaggattccagaaggtaaatgctcaagttgtagacctaagcaaaatttgggttgacccaaatccttcatctcaaattccgtctttaaatgatgacgtgcttcattaatatcttgtgtattgccaatgatgttgagatcatcgacatataccgagacaatacaaaatcctatgggggactttttgataaagacgcacgggcaatcatcatttttagtgtatccctttagtgaaaggaattcacttaatcggttgtaccacatcctgcccgattgttttaagccataaagtgacttttgcaacttaacacaatacatgttacgatttacctttgattcgggatgtcgattctgtcaggaaccttcatgtaaatattacaatcaagtga

SEQ ID NO: 60289 - DNA, 755 bp, Oryza sativa
gggctggaggtggggtgtgggcctttgcttttttcctctttagatcaatctgattgtatattagtgaaaatcaactattagatgttttgcttttttctctaatttgctagagtaacacgtggtaagttaagagcgtttctagaatgccacatggcggcttgagagctgctggccttgggccaacaaatcccacatgacaatgcaacaaatcgccccacgcgcggcgggggagctttttttcgcgtacggataggatgaaagacaccccgatcgaacgatgaggagaaaaacggctgaaaatgcaaaaaaaattcagctgttttccacgtagatgatcccttaatattatggatctaccgatttaaatggacattaatgattaactttttttctaaatttaaattattagctagaaaaaataggaagatgcacggagtaagtgtacgtacgtgcctttgtgcgtgcatgggtgttaggagggattagtcagcgtacgtttgttgtgcacggggtgttcggagggattataatcccagacttgcgaagtaatttgatgaaagaattgatgtgttgtatgtgttgctagatcatatatacattggtaaaaatacaagttcagttgcataatgtggtgataaaagtaatgtttagcaatccatttgacatgtggattgtattatagttttatattttttttgtcttcaaagataattattctgacggtaccaacgtggtttttctgacggttgcccgcc

SEQ ID NO: 60290 - DNA, 914 bp, Oryza sativa
ccatggagtgctgaaaattgccgactttggactggcaatatcttatgatcccaagaatccacaaccgctgacaagccgtgttgtgacattgtggtacacaccaccagaacttttgctcggtgcaacagaatatgggtggctgttgatatgtggagcacagggtgcattgtggcagaactctttgctggaaaaccaatcatgccaggaagaactgaggtatttcttgttttgccttgtggaattccaggaaaaacatttgatttttgaaagatatgatttatgtgtactagtcaaaacctcatgtgcctttttgcaacaatgtcatactaggtggagcaaattcacaagatttttaagctctgtgggtcacccatggatgattattgcaagaaatcaaaagtgccagagacagcaatgttcaagcctcagcatcagtataggcggtgtgttgctgagactttcaaagtttttcctacttcagctgttgttctcatagactccttgctttcattagacccagaagctcgaggaacagctgcctcagctcttcaaagtgatgtgagtttcaggcttcagtgcatatcttctgtttagtgtgggacatagctttgcagagcctacccaaaacctaacatgctgttctcctaaaaaaaaaaaaagcctaacatgctgcaaatgtagttgaaacatgaaactaaaattctcttagcagtttgtgaaatcaacgaatgaccaaatctgtgttccatcttgtgtgaacattatgcatttataatactttgcttgtaggaatgccttcagatttgtagcactaataccatatctcaaaccaatttcagtttttcacaaaagagccatttgcatgcgacccatcaagcctgccaaaacttccaccaagcaaggagtatgatgtt

SEQ ID NO: 60291 - DNA, 1369 bp, Oryza sativa
gcgcgcgggcgtcttggggatgcctgggcggtgctcccaggagaagggcacggcggaggcgccgaccggaaagagaaacggtggtggaaccgcgagggcgccggcgagaagggagcaacgggaaggagaggctgacgacgacgacgacgacgacgacgatgacgacgacgtcgaggtcgaggagaccgaggggttcggggacgtgaggaggcgacggcgccggcggcgagcggcggaaggtggcgccggaggaaggagcggcgacggcgacgaggcggcggcggcggcggcggcgtcggtgggcatggcgacggtgtgggtgggtgggtggagttttggaggcgtaggcgtgagttcgcttgggtttttatggagtagtcgagtagagaggtcgcggtgaccacgtgggatcggggagttgcgtgacgtggatgctgagctggcatgctctgtacacgtcagcagaggagtatgaggatctgtcacttgagatggtaatgtaatccttcgcagcataggtaaacatatgtgaatctttcaagcgtgtataccaatgaagagtcccagttttattaggcatatttttaaagtgggttcgtggtgttttgtagcaaaatttgccgattattagtacgccgttatcatgaggtatcaaattatatactactcgctccgttccatactgattatcatatcatataaccttaatcctttattttgatgtgcaacattatcgtaatctatgcatttagaagtagttaaacacttgtttcctgtgtatatggagaatgtttattgattctttcttaccacatactcatattaaataaaatatacggtagttaagtctttcttgttcctaatgaaaaactttatatgatgattaatactctataagcttatcaaccgctaccaaaaatttaattttatagttgattttaatgtttcttgttgtaatttatttttcatcactagcttttaagtcactaatacatcacatataaaattacctataaattatttcttgttccctaataagtgttacggcctatagtcagctgtaggaaaaaatgatgggactgaattcaaaatatacggaaagaaacaactacagttagaagaggatatctcaatgagctgaggccatatattcaactgaaaatttagttctccttttaacgtaaataccagttgacacgagaaataaacgcatttgtcatatcaaatggaacatatgcatgcataagccaatttcaattccaggaaactttagttaccaacttgatgtactataaaaaaacatttgtcaataaattagatgtggattagacacggggaggtaacgacggaaccaagtaaaacagagttg

SEQ ID NO: 60292 - DNA, 1521 bp, Oryza sativa
taataaatactgcatctcttaatttgagtcaatgatcatgcagtttttcgtcaacttcgaacgaaggttcacaaataagattcaataattgtgagatctttatctagtgttggtgcatattagtttgtgtttgctagtatttgggtgtgcttttatggactttctggtgtgtgctcgttatcgggtaaatttatgtaataattggctgtaactcgttgagtaaaggctgaagttttattccattatctcaaagaaaaaggaaaaacctttcttaattgcaattcattccctttgcagaagctaaaaagaaggaattttcatagaattttttttccgattcctttggtttttccgtggtgcaatgcgcactgatcggttaatctgttaccttcaatggaggaggagatagccgaaagccagcgtaggtatcgcggagacaatcacccggaagccaaagcgaaaggagaggagagtgcggcacgcgcgcacacatgcagtacgacctctggaagaaagaaacgaaagggaaatcccaaggaaaagttcgtgacaaattctcctcttcgaatcattgatctgcaaaagcgaggcaaatttgaaaaaagccatttcgaataaatgtaggagtttcgtggtggagcttcttcgctgaattctaggctaataatattcggctttcagtaactttctgtagattgaatatactcctatctttttttgatagaaaaggcacaataattgtaagagttagtataagtttaattaatgtaccatattgttccatgattccatcttttctagtacatgcatgcacgagtggaaaagagggacaaaccggcacggcgaggagacagagcttctgttgtctgaaaaagaagaagaggaacacagctgcatttcggcgctttacacaagcctagtacagcactacaaccattgcactgatgatgagcagtgccactgcaagaaagtaacaggaattataacagaaattatatttgcttaattgcattgcttattattcggtcagtaatatttcctttattttacctgtatccaattggggaatgatccttttacttggtaatggatgtagacgctcatcctaacaccgattgggataacatatacgctatgggttagttgcgcaaacaggggttttcaaccagcatcataatgagcaagaaattttagtcttcaagaaaagcaagaaattgattaatttgtgggtcgacggaatcaaaacaataatgttgacaaccaacaggaaaaaaggtctgcctgttaatatgtactaccatatatttgattgcatctctcttgtagagtaatgcttggtgaaagtattgaatagatttcataggaaaaaaggttcaattcccgcaataaaacacagaagaaattccctcgttccaaacgcggcgaaaagggaaaccaacaatttcttcgaaaatcattgtaacattcaagttcatctgaggcaaacttcctctaccataatactgggaatcttgccattta

SEQ ID NO: 60293 - DNA, 1162 bp, Oryza sativa
gaaatactacccaatcaagaaatggaaccctagaacatgtgagtatgggtacagccgtacaggaccactattacccataagtaaaactggtaaccaactggttactacccttgttatcaagcccgtacatctagtcacgactagtcatcagctagtcggccagggagcatgactcgatttgttggcggcagcagacacaataaaacaaagaaaacaacaatgaaccacctcggaggtctggtccatcaggcattattactgggtgaaagggagatggaggagagctccaccaggtccatcaagcacagcatgacgcagcagactagcagtaaaagcaactgctatgtaataatagtctgatagactagtcaactcaatgagtagtcttcaactagttgcgactagtcgccaagtcactagatggtaactcaagtagactttacaacttaaaaactatggtcactgctgcaatcttaaaccctaaatgggaccatgacacacaaatgggataacatacaatttcctaaatactcaaaacttctattaccaactagtatcatgtagtaaccaaaccttctatttacccacttgcttccttgtctcttttcgccttctattttttgtacttgtattcttcacagtattgattaaggatgattgaagagattacacattacaggcaaactaaattcaacaggtacatagtagttaatgttttgcaatattctaaacataagtagctaaaggttggcacataagtagtaattttagtcaagaaacttgagtaatacagaaacaagtaatatgttcttatattaccaaactgcaactttattacatatggggggctctgcttaattaaccagcatgtggaagtagtgcagaataacttcatttgagaaattccagataaaaaagaggaatggccctaattagatttaaaattatatcctagaacaatacttcctccgccccagaatgtaaccatttttggggtaggcacgggtattaagaaaatactgtagaaatgattgaagtagtattgtcattggtgaagaagagaaagtaggtgaagagaatagttgtgattgattgagatgaaagggtaggtggagaaatagcttcattttgggacaagttactgtgttagaaatagctacat

SEQ ID NO: 60294 - DNA, 2119 bp, Oryza sativa
gtcgtcgacccgaaggttcccgccgcttcctcctcgtcgccgtcgccgtctgttggtcttccgccgccgtttaggtcaccggtgagttcgccgtgttgtcctctacgtcttggtgccctccgtttgcgtcctcgcgccgccgttcgccggcgagcgtgcgccgttcgagccgtcttctccgccgagccgccgccgctgtcgctgacgtcgtcgctgatgtcatcggggtcgtccgccgtgagccgccgtggacccgatcgatctcggccgtccgttttggatggatcgatctcggccgtccgttcgcgtgaaccgccgcccgtgcgcccggtccacccaaaccctagccgctgacgcaataaatccccttttccttttcaaaaataattcattattgcgtcgtaattcaatttaaaccgatttaagtgttttaatccggtttaatctttaaaaattcataactaattcatcttagctccgatttagtcggttcaagtctctaattttttctaaaattgagatctacacattaaaaatatccacatgtactgttcatgcttgtttatgtgctgttttggtgattttgctcttttctgcttagattctgtcgtttccggagagtccgttttcgcagaagaagagtttgaagaattccaaggccagcaaggcaagtcacacagatcccaaacaaccctttgagcatgttgatcctatttaaagctattgtttcttttcaactattgcatttattttcgatgtcattgggtggaattaacctattgtttgttatagcccttttgttcttgattaccttattccttgataccatgggttattataatttgactagttgagctttatttatattggttcaactagatattagatataattgcttagccctgcttagaaacattagtacacattcgggataactaatgactcactattatttaatgatggcttattgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtgtacacctctggccaaagtaaaactattcgaatagccgtgcccgcggttatgggcgggtctaacaatgtctttcgtgattagtctcacacctctcatcattgtaagagatgcttaaactggtaataatttgtttagctcctggtttggaatggtacattcctggtttggagatagaactgtgcagcggggtggttgttcagaatggttgggcctatacaacagggcatgttgtatagcgttggattaatattgtttaattacttaactgttttatcaaattctcaaaggtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaaccgaccttaacaaggcatgtcctaagga

SEQ ID NO: 60295 - DNA, 791 bp, Oryza sativa
aagtccaggcctcgggacccgaggggagcgctcccagctcccttagattgattgcttggatcactgagatccaggcgtacctcacagataagactctacccgaggaccgcgaagggagtgaacgcgtccagcgcatctccaagcgctacgtgctggtggaagagaccctctatcggcgcgcggctaacggagtcctcctgaagtgcattcctcgggaacaaggtgtcgagcttcttgccgatatccatgaaggcgagtgcagagcccactccgcctcacgcaccttggttggcaaggcctttcgccagggtttctattggccgacggctctcaacgatgcggttgacctggtccggcggtgcagggcgtgccagttccacgcaaagcaaacccatcagccggcccaggccctgcagaccatacctctttcatggccgtttgctgtctgggggctcgatatcctaggtccgtttaggcgggccccgggcgggttcgaatatctgtatgtcgctgtcgacaagttcactaagtggcccgaggcttacccggtcatcaagatcgataagcactccgcgcttaaattcatcaggggcattactgctcggtttagggtgcctaatcatatcattacggataacggcacccagttcactagtgaactcttcggtgactactgcaaagatatgggcatcaagctctgcttcgcctctcccacccaccccagaagcaatggccaagtggagcgcgccaacgcagaaatcctcaagggcctcaaaaccaaaccttcaaca

SEQ ID NO: 60296 - DNA, 1612 bp, Oryza sativa
  unsure (1)..(1612): unsure at all n locations
ccgccgcccttagccactgctgccgctctgtgtccccgcttgccgctgacccgtgagagagagagagaggaagaggagtatgataggtgggtctcatagttttttaatatagaatgctgggagagagggagagagagaggaagaggagtatgataggtgggtctcatgttttttttaatatagaatgctgactggactgccacgcgtacgctatatagaccaaaaccaccgtggattgggtcgagggtggtaattcgtccggtttacatagttgagggtgaagaatatccggttttgtggtttatgggggtaattcggttgaccgcgatagttcgggggggtgtaattcgtaaaaaaattggtaatgccaaaatatatcaaaatttgtctaaattttagtagagttcaaaatagctacaaagtgaaccagccccgagtgctaatgcggaaaagaaatctcaataaaaaagttgttactttttgctaagcgtatgtgtcatacgctcgcactgtcaccctgcagcgactccaattacttaactttggtttaggtattgctaaatgcgcataccgcgcatggttgcgccgggtgtgccttcatacccagcgctgctatacgtacgaattatttcgtacgatggttgtacaatcaaacggatcccctcaggcctcagttgatcctatatccaagcccaagctcttgagtcctggcctgctatctggttggcttgcttggagagccaatgagccaaccaaagcaattttcttttcaatcatatcttaagcaatcctcttcttaatatcttactgtatatagtaattgtacttagcactcaacattgaatttatcatgtggcatggttaagcaaattacgcatacaaatatgttccttgaaaaaaaagaaagagagaataatgtaaaaaaaaagatgattgtgaagctaaagaaaatcaagtaaataagatgccataccttcgtcttcgatgcgtatgctattggattagtttcacacttgcagattagatcagaacatgaaagtcagatttagggtttggagtagtgaacgtaaagttaggtttagaggtgaactgggctttagggctcataagtacgcttagactgcgccgtgcgtgacgttttgctgttgccgtccgtgccgttgcgtcttatcgtaacaagatcgtatgcgtagcattttcaattgctaaatgcgcataccgcgcatggttgcgccgggtgtgccttcatttgggcacgccaccagctcgccctggagatgttattaccccgcgcccgtgcgctaggctccccgaggtgggactaaaaaaacgctagtgaaagtttcgcttccatgggccttgtagccatacatctgcactacacatatatgggcccttcaggtcgacgatgatgagtccgacacggcactgcagatacaccactactgtcatatacggtgatgctattttctcctaaagataaaaataaagagaaaaattaagttttttacgtaaaataaaatggtattaacgtatgatngattgagttttaattattatatacttgaaaaatggattaatatgatattttagagaaactttcatatagaaa

SEQ ID NO: 60297 - DNA, 1113 bp, Oryza sativa
taaattgacggccggttgaaattagaaagagagagagaaaaaaaggccagtcatctcttatttcctcatcccttccagcatgtggccacgcctgagatatgggtgcgtcgccatctttggcggggcggccgatcgatggcaaacgtacgatgcgggtgcgcaccagggttcatgattccaacgaaaaccggtcgaattccgcaaaattttgaggtttcgataaggctcgaaagtaaaagctgtctgagatttcgatgagtttcatccaaattcaaatttaaattgataaataaaagaaaaaaaatcaaataaaatcttataaatagtataatattcataaaatctattggatataaattttcaaaaaaaaaattgatgtattccgtgtatttactgaaatttgaagtaggaaataaaagaataacgaacttaaaaaaagaaaaacaatttcagtttatctctttttctagttaatgattgaaatttcgatgatttcgctcagaatttcgtcaaagccgaccgattttcgcgagcttatcggtaaactcaaggaatctgtattcaaattttggtttatgaaatttgtttggaatctaccggctttttatcggatttcacagaaaccgtcgttctgccagagccctgaaatggaaggccatcttagaaatcgtaaaccctggtgcgcactgctctcccctgcgaagccgcggccatgcatccggcaggcggcagctggaaattcgcgaaagcgaagcgaagggcaagccgcacgatgcacgcagcacgcggtggtgtccgtcaaagacgtacgtggaacccacactggtggtggggattggggggcggaatggccgatgcacgggccgcgcgggcgtacgtacgcgcgtcggccgtttgccttgcgcgcgcgcgcggcctttccgttctcgggaacgcgcggggtgggtgggtggcatggccttcgagttcgagccaagctacggtgtctagctgcgtccgtgtgtgcccggccctgtcacccgcgcgctctctagtctctcccagtggccgacacacgcgcgacgtacgtagcgtaggccgatgcggcgcgcggtgcgaatcgaaaatcgacgt

SEQ ID NO: 60298 - DNA, 941 bp, Oryza sativa
cttttaatattttattatcggtgtctcattttagatcattctttaaccaatattttcatatgaatgatttcgagtatgtcggctcctatttatcactgaactccaataatacatttaaactattgttctgacatatgacaagtggatgcatatacataaaatactttagggtggtccaaaataaaataaaggtaagataacccaatctaaagtaaaaatattagttaaaagacagtacaaaacaaaacaacggtaataaaaagttacgcaaagtgaaattttccgaaaagttgtacttctacgagtacagatattggtgtggccatgatgaattgcagatgaaatccaatttcttgataatttgtactagaatctggacattgtcaatactccctccgtccaaaaaaaaaaggcaaaccctgagtttccgtgttcaattttgattgtccgtcttatattaaatttttttataattcgtatttttattgttgttaaatgataaaacataattaatattttatgcgtgacttgtcttttcaattatttttataattttttcaaataagacggacgatcaaacgttgagtattttatgtgtgacttgtctttttttttttaaaggacggagggagtacgcaataactcttttttttttcttaaaagaaaaggactagcaagtactcctactcatcatcattacttcatcagactggcagagcgtctcccttgagcaaatgactactagtacgactaccaaatgacttgagaggctcactccaatcccttggtcctttcagagaccgtcctgtgccaaccacaacctggaatgtagcgagtttctaaagaacgcatgtatcaaatgttcaaatccttcatggtgcaagccaagaacaccatgactacttccattgctttttaaatgcaggaagccagaacagagc

SEQ ID NO: 60299 - DNA, 724 bp, Oryza sativa
caaattttcgatggctacggccgctatcggggatctctgcgtttcatccagaaggccgtactggagagatcggagtacctccgggacaaccgcttcacgatcaggtgtgacatcacggtcatgaagaatcccgaggcaaaggacactggcggcaggcgggtaaccctgccaccgtcggacctggcccggcacctcggcggcctcctcgccaccggagtgggcgccgacgtgacgttcgaggtcgacggcaagacgttcttggcgcatcggaatgtgctcgcggcccgatccccagtgttccaccaagagcttttctccctaacggagaaggggaatgccgcgactggcggtgccggtgtcatcatacgcgtcgacgacatggaggcgcaggacttcgaggctctgctccacttcatatacaccgactcgttgccggagatgaaaggtggagacgcagtggcgatgctcccaacctggtcgcggcggctaacaggtataagatggagagactaaggttggtctgtgaagataagctatgtgagtatgtaactgtgagaaccgtggcagccatgttggcgtttgctggggaacaccaatgccccgagcttgagaagaagtgcttgcagctactcgaagatccagcaaatttgaggaacatcgtggagactgaaggtcttgagcatctgacgaaaagctacccctttgttttgaaggatctaattgc

SEQ ID NO: 60300 - DNA, 1467 bp, Oryza sativa
aagtatcaaatgtcacttgacagaaacgtgattacatcggatgcagaagctgaagagcaatttggcacgtcattacctgttatcgcagacaaatcaggtgcattgtccgtgcacataatttgacaacttaattatatgagcaattttggactacaaagccatttctgcaatgtaccagatatattattatcatacggcccactacaggtgtacatatggaaattcattatttgcatccgcaaatcatttgatcggcatgtaagtccagaaccctactgctgatccgcaaataaaaatggtactattgatctacagagtaatgaatgtgaatggatgctagtagtagtagcagcacagccaaacctttggcttctcccacgccctaccgctttgatggagctgtttgatgaaccagcaaacacaagcacctcttctttatgagtccacacaaatccaacagagcctactgattgttaaggtgacatgtagaaaatcacagggtcttataaaacaaccatgccatttaaggacaccaaagctaaatatcaaatttatttgacacaataccatgtgatcagaaaagagtaggcataaatggacagtactatttgatcaatttgagcagaggatcaattagtgctccagcatttcttactaaatccctgaccaccatttttttactaaagacctgaaaagcataatcatgcataaaactataaatcccttaagattgcagagaacgccatcatgttgtgtagattaacagagcaaacaatgtaattaaccatgcataaatgcataagtgtgatttagcttgcacacaaacatgtatcttcaatggcacagtacctatcttcagaggcaagaatgaaatgaaaagatgaccgatgcttagctcatactgcaaatcagtaatataccatctaaacatagacagcaaacgctacgagtttaagaatccaaaacctgcaatacaagaaaagatgatatcaaaataaagtaatattccttttgttcaaaaatattgttctgtaaaggtaaaagaaatccaatccaattatgcatggcacccctatagttagttacaggcccttcctgcatcctctatatatgcaagtcatcgagatgacacggcgaggtcgatgacatactattcgtttagcaaacaaggaatgactgatgacaaaaaaaaaacaatatattttgagacgtatcttatatttttacacaaagaggaaaagaggaaggaagattaaaaaaaagggcaaaaataaccccctacacgcatagtagaaaatcattggatttaatcggaatcgattgcagttttacatttgcatactaacatgggtccttgatagccaatcggagattttcctttgggagtgcaaagctagaaagcataaaaacttggaatctacctaatcagatttgtaatttaaatttggtggataatgcatgttggaa

SEQ ID NO: 60301 - DNA, 1652 bp, Oryza sativa
ccggcaccccctccgcgctagggcacaaggccaaaacgtgccacagaattagcccgaaaaatcacccaaaaaacaaaaaaccccagccatcaagggcgcgccgcgactggaccagagactagggaatcacctgagagaccgaccaagctggcgccgccgggaggaggacgcccgcgcggcagccgccgcagcagcagagacgcggcggtggccggcgaggaagacggggagttggggtttggggattttgggggtttctgcggaaatggacgaggccaatattattttggttcgtgagcgggagaggaggggattaaaacttgaaaaaacccccgcttggagggaaaccaatcgcggtttcgggctgatcagggagccggccgtcggatctgcctcgagattcgcgccgggtcttcccaaatcgcaacaagagccccgccctccccctccaacgggtagaaagaacagtggaagtggcaggtcccctttttggttccacgtggcccgtgggccatggcacacttttcattcagaaccaaaagttttgcttcttttgggttttacgtatagttgtcgtagtagtctctttcttttttttcttggtttttcttgtttttctcttttctctcttcatttggtataaatcggtttggttaattatgtgtgtaaataaactctcttctcctttcatctaatattgacgtgcaattctttttcgctttcgcgaaaaaaaaaagttttggagttttgaatcccttcgaaatagcactcgcatcctttgtaacggaaagaatttgactgcttttttttacaggatctgagctgaaatcctgcaaaattcatgcaagagtcatgcaagagaagcattgctcggaccctgtttagatgggactatccctatcacatcggatgtttggaaattaattataaatataaacgtagactattataaaacacatccataattttggactaattcgcgagacgaatctattgagcctaattattccatgattagcctatgtgatactacagtaaacattctctaattatagattaattatgcttaaaaattttgtctcgcaaattagctttaatttatgtaattagttttgtaagtagtttatttttaatactctaaattaatgtctaaatataaagaataaagttaagtccatggaccaaacaccaccttggtctccggtcattcatgtcagttaccagtaggaaatctgagacagattcaggacattcaagaatgttcagcgacaccgagtcaacattgagaagttcaggttctcgtcggcgacagtagatcagagttcacagacggcgcactagtcgctaacggccactagcatccaacaggcctttcatacaaggtactagctgaatttacagtagttttgccaagacgacgacgattttcacaggacgaattgatcttcaaactccgcagctcgtcggcgaggctgtccactgcacaagaaaccggcgagcgatcctcaaacggcctctgctgtccagcatccgcagccgtcaccgccaccgaccgatcgacgaacgcgagattctccttgctaccaccaccaccaccaccaccacccgctgtgattcatctcatttggcaaatgtcatgttcagaattaccg

SEQ ID NO: 60302 - DNA, 1421 bp, Oryza sativa
tgtgtactcagtttaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattacgcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgtggcccggtagtcgagatgtcatggcacagggccagtgtcctgctgctagggggctcaattctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttgtcctgggatggctagggacgagctgggacccagggtcgggttgccaggttcggtctgaat

SEQ ID NO: 60303 - DNA, 3153 bp, Oryza sativa
  unsure (1)..(3153): unsure at all n locations
tccaccatggcctccaccgagcgtcgcccctcttcgacacgcgcccacgccgcgtcgagctccgcccgctctgcctgcaggacctccatctgggcacttaacccgtccaacaccgtggtgttcgcggcggccaaggcctgcagaaggggctccgcgctcagtggggcagcggaaggcgtgggggagagccgcctcggtaaggatgccgcacggctcggcccaccgatcgacgtgccgaactcgggggcgtcccccgaagcgggctcgtcccgaacgtcgcccgaggggtcgggcccgagcggcgcgcccgcggcctcgtcgtgggcggcctcggaagtcgttgtcgcctcgggtggagtcgggtcgggggcttggcaggccgccctgcgtgcgtgtgccgcctccgtctcccggacggactcctcggcccggcggagtctggcctcctcccgagcggcttcctcagcctggcgagcccggacagcctcctgggcagcttcctcggcttcccggaggcagtttgcggcttctcgccggtcagcttcccgcctccgggcctccgcggtcaccgtctcctcggcctcagaccggccggacttggaatggcgggaagggcgcgacgggatctcgctgaggcagaagaaaaaccagaagacgaaaaacaggtgagtgaaaacttgccttgggagatgggagaatgaatacggccgcagtgggcgcggggacgaacctgcgaggaggtcggctaaacgaccaccttgggggggagatgaggtttccccggcatggttcggtcccccccccatcttgcggagccgctttttttttcgctccccctcgggctacgacgtcggcgcagcaccctccgggtgcctgctgctggcacgcaccgccccgccccctcggggaggagatggggagggggtatcctcctgtttcctcttcccccgggcgtcggcagggcggctgccccccgggcccccgtcacggggncccagaagcacgaccnccctcccgaggtagattgggttccacccctgcggctcccgctcgcgccatcgtggcctccaggaccccgctcccctgacgccccgaccgcctgcatgatggtcaggatgttagcgcgatctggatcgctgcagagggggagaacgcctgagggatgagggatgcctccacggagctgagattcagcacccgttggaccactatcctgaagtcctcagggtcccagtcccatttgcgcccctggtgggtcctcatgtagtcctcggacccggtgtactccccggcggaggaggagcttgagagcgagtgagtatggcaaggtagggcgcaggaaacggagtgtcagagcacaagtggcgaaggcaaggggaagagtggcgagaggaaggaaacaaatctcttcctcggcgtctttatacccttgccaacgctatgcccggctcctcgcttcccgctcccactatctcgccccctcgtttctcgcgcccactcctccactaatcccgttcgcccgtttgcggcgcacgaggcggatgtgcggccgtggcagtcaagatgggacatatcgtgcgcgcgttaactacgctcgctgacgatgcaccatcatcacacactaggcgaaacgaaccggttcgtcccgattcgcgcgctactcaagtaatgtagcggtcttgaagaggccgctcattattgtcgatcggtttctcccttgccgatgcgcgcgatttgcgaccgttgggtttctgcccgcctgtggggaccggccccacctgtcacggggcctaaggagtggcatctcgcccgatcgcctccctcgaggggggcggtcgccctggcgtgacgccggggctactgtcggtgacatggggccgggggtatcgtgactagaggcttgggtagccgcgatcactcacgtggcccgaccccccgagggggtcgggcccgacggtgacatggccacccctccctctgtctccccgaggggtcgggccgctcccgtttcggccccgagggctggggcgccccaaccccctgtggtgttggcgccacgtgtgtgggttaggtgagcatagcggccctcacctaaccacatttatagcgggttagacgagcgcgtcacgccgcattcaatgcggcgcagcgcatgcttatccggtttgtgaccagtcgcggcatgtgaccggtcacagaccggtcagatcgcgggttaggtggcaacaggcggcctgtcgcacgcctcgccccgtcccgtcggaatgatgagagcctctaggcactcgtccctagacggagctggcgtgggaactcctggagttagcacgtcggtcccggctagattcataccaggcttcatcgcaaccattccaagcaagtcattttatgaagaagggctaacgcgtggcatgctaaactgacgcgtggtagacaagaatgaccggtttgtgactggtctgacgccggtcacgtcatcagcaaacaaccgtgctcccacgttgcacctgcctccgtcatctggaggttggtatgacccatcccatcggagggtcattcggacagcagccattgcaaatctccgcccataaatgaaggaaggacagggttatcccggtgtgaggcgaaggcatgagccatgttttggtcaaagtagaatgggtccccacccaaaagaaggataggtagaaatggtgtatgtggtatccccttgagatataaaaggaggaccatgcctaccaagagaggagaaagaaaaaaaaggagaaagaggaaaagaaaagggagaagaaaaggagagctcgtaaaaggaagagcggagctcatagaggagagagagagggagagggtctctagagtttgaactctcttgctctccagctctttgtaactccttcatacacagatccaccagaacacaggagtagggtattacgcttctcagcggcccgaacctgtctacatcgcccgtgtcttgtgcatttgctctctcgcgaaacattccacaaatcgagggcttagaacctcacctagcgtccccggccgaaccggcaaaggggggcccgcgcggtctcccagtgaggagccccacgctccgtcagtgtgtataagtaacttaagatttaggatgctgattcgggatgtgcataaaat

SEQ ID NO: 60304 - DNA, 3500 bp, Oryza sativa
tacgctgtggtggtgagatcggtatgtatacagcacaaccgaacttacgcaaatgggaaatacttggaggatctccatgtactaactgcattggggaagtttcatgatatgcagttggtcgtagttggacaaggtcagcagtgtgcagaactgcatgaccccaacacgacgaaggtaatttgcaattcatcaataatggtcaagaaataagcttaattcttttgatcagcgattcagccaaaccattttgtgtgtggacatatggaacaaagtgctgaacctgaattcctaatgccatacaataatcatcgaaagcatgggatgtaaattcggcagcattgtccatacggatcaattgaatcctatgttcagggtaatttgccttcagccttataatttgtgacattaatttggcaaaggcatggtttcgtgtcgctagaagacacacatgagaccatctagtagatgcgttaatcaaaaccataaagtacctaaatggtccagatcttggcacaatagggccacagatatctccttgaatgcgttcaaggaatttaagtggttcggctctagttttgagataagatggtctcaaaatcagtttcccagtagcacatgcagtgcatacgaaattagaagatttgggaaatttgtcagtgatcaaatgatgaccaatagagttgccaataatttttctcatcatcccgataccggggtgcccaagtcgatcatgccaagtgtggaatgcatcaacattttgaaaaattactttgtatgcaacatgtgcaatgggcttaatgtatgtatagtacaatcccgatgtgagagatggaattttctcgcaaatgcgtttgccatatccgttttgtttggttaagagaagaaattcttcttgattatccatatgggtttcaatgtggaacccattttgacggatatctctataacttagtagggtacgggttgaatcaggatacaataaagcatcctcgattgtaacttgtgtacccattgggagtgtaataattgctcgtcctgagccaactatcacagtatcgcaccagcgatagtcaaaactttgccttctctctttttgagagtttgaaagtatttgatctccctaagtatagagtttgtggtactactgtccacaagacataattcctctccaatcggagcgatatccttagacatctataatgaaagaagaattacttgattaagaattctttatccaatatatatacatacatacaataattaaaacatcaaatatatagtatgacgtttacatatgttaaaaatacatactctaatgactagcaagccatacaaccttacaatataagggagtttgtacttatatacttattacaaccaatattgtttggcaaacttataggatatcaatatactgtttcaagcacactgagataagagcagcttcatctccaagtgggacgcaccgagatcattgcaaatctccaagtgggtccgttgagcagtattcgatgaacatatcgtccatcgtagagagtggagcgacatcttttgggagaacattgaggttgctctctgattcaacaggagcctagtgagaacttgcaacctcagggcgctcttcatgtgtaagattgaagtgggcttcaaatcttgggttctcagaagattttttttccttgaggggtttttggtacaagagaacaagatgtttcaggatgcggcaatctttagcgacatgagtgttagatccacacctgttacaatgcttgttgccattgctacgaggttgtggtgccttacccttcccttttcctttctttcgacccttgaatttgtgcctgttattgttgcgtttgcgctttccagtcagattcttaggattattcgaagaatttccctggaatcctttcttattctcagcattattctgtacattgaagtgcacctcaggcagtggagcagagcccggtgggtgctgttgggcattctttaaagaaagctcatggtgtctttctgcctgagtcaatgtatgtataagcagagaatgtttctggaaattgttagcgcgatactgttgagtcagtatcctgtcctccggaagcatagttgatagagttttctctatcttctctgcttccattgactcttgttcataaaactcaacctggagcaaatgttatgaacatcatggttgtattctgccacagttttaaagtcctgtaggcataaatgtacccactcataattagcctcaggccaaatgagttccttttgctgatcataacgctctttaagagctttccaaaggttgagagggctcgtctctaacatgtattcatgtttgagatccttgtaaatgtagagtctcaaaagaaaaaggttgtattgagcttcctgggctcaattgccggatccccatcattgggttcctcaattgtatttaaaatcccccgagaggcaaaattgattttgatatcggaagcccagatgggatagttagtcccatcaagggcgagttcgtcgaactcttttgttgccatgtccctacaatcatggttaacattatcaatttacagaggtaaattaataaaaacatgatattaaggttgtaatctcaatgcgtaatgtaaaacttcatattttgtaatgtttcgaaaaatgcaggtaatagacctggcaattttgagttagaattcgaaattaggtggcacaatgtggataatctccaagtaattaaacagtggagtagatctcttaatagtgggcaagttatacttgctacctaaaacacggtctccaggcaaatacattcttatgaatataccgcagccaatgtttgggactccactaccttgtgttcaaccaaattttaaataatctcatttttcaaaacatattctcgaaaaataacacatgtgggtaatcatcgtgagatgtagacctctgtgagatgggcgaaatgctcgctgcctaggttatgaccagtgcggtcaatttgtaggactccatcgggtaatcatctcagaatgtagaccacttgatgattggcgagatactcgctgcctaagttatggtcgatatgaccaaagtataggactccatcgacatgtgattaatttccaagtcaaagtgtgaagtggaacatgcattaaatcctccattaattatgttgtacataattaagagaatttgctaaatcaaaatacaaaatttatagaattttgtaaattaataaagcgagaaagtagagcgtgtcttgaaataatatgcaaaaggcatgttattaagacaacaaataaatttagtgaaacagggtatttaaataaacacctatgttaataaacacgtaacatcagtggtctataggaccattacataattgtttgtacaactgataaactgcttcgactaaattacataaaacatagggactaaaatgtaattgctgctaaaaataaaattaaaaactaaatttaaatgataaaatgggtggtggg

SEQ ID NO: 60305 - DNA, 10953 bp, Oryza sativa
gggatttccgccgccgctaccatgcatttcgccgccgccctcgccgttccgttgccaccgcagccgtggggcacgccgccgacgccgccgtggggcaccacgccgacgccgccgttgggggcgcggccgacgccgccgaggtgcgccgccgatggggggcatcgccgacggcgccgttgggggcgccgccgactccaccgccgtctccaccttctaccgccgccaccgcctccatttccaccgcagcctcacgcctccaccgccacctcccatccaccaccacctccaccaccgccatccaccatccgccgccgccgccgtgtccccctcatcggccggcggcatgccggccggctttaggccgacgatcccgactcctcatcagagtcagagaccggccggacccgaataccgttcccccccccacgccatttggtatcgtgcggctttgggagccatgggaaacggcgatgaacgtatggcggaggccgggacggcgtgcagcggtggctccagcgtggcgacatgttggagacggtgtaaagaggggcggctcccctttgcgcgccgccatggttccggtacggccgaatcctggtggcgcgggagtggggtagcgttgaaagcttggcgttggctgcgacgttgatggaggtggggaaggagcggttggtggtgacggagtggcgacgaacggggccggcagcgactccatttccagtgggagttcacacggctcgccgggcattgtcaccaccgccgtccatccatggtgggcacagtactgtaccccttgcacaaggatccggcgaggtgcttcggcaaccggaggcggaggaggaggtgcgacagggacgggcgggggggggagggggggtgttgtgagtggcggcggccaccaaccctagccctgcctccgcgggatccccggcgcgtcctcctcatcgatcgacgaagaagatggcgaagccggcgtgcgcgctgatggcgagggaggccgagaacggcatccatgatccaatgaaaggtaggcatcgtaccttctctgatgattcttctgttcgcttttctgttagatcaaaagcaatgtttcttccttatttcactttgcgatctccttcgcgagggcaaaagtgctgataacgtgttgaatgtggatagaattgattgagcgagagagagaattgaacacaaatagagcgaatcgatagatttctcattgatcaacttctgttcgcttttctgttagatcaaaagcaatgtttcttccttctttcactttgcgatctccttcgcgagggcaaaagtgctgataacgtgttgaatgtggatagaattgattgagcgagagagagaattgaacacaaatagagcgaatcgatagatttctcattgatcaacagtacatttatacaatgtgaagcggtgtcaaccgcaggggatacgatgtttgggaacatcatgtcggttgtcgagagggacgctaaagggagagagaggagcgatctcctcttctctaccggttagataggaaccgttgttcctatttccttgggtggatgagatcacccgtagtttcttaacacaaacatggcagctccaggcctccagcgagcggaggcggcaattcaattaaggagggagctggtgtccttttgtttctcctttctagtttatggcaataataaaaatcacattggttgctcagttcaaatcatcaagcggcgtgaaaataattggctgtagattcgttgaagcaaaaggccggatttaataccattatctaaaaaaatcaagcggtggaaatcatgatattgttttgtactcatgttggttgcccagtaataactagcaggataaattggaaactacaacgatctgtctagtctctgtaagcgaaaacaaacagaaatattcaaccagttggtttttatataagacttggaatggacttttaaattcaagtttggtacaaattcagaagtaaattaaaatgtaaatctattgatgccatactgtagcagtaaaattaaatacaaagagccatactgaagcagtaatcttaattatatcaaaattttattacgtttgccaaaatttgggttaaatttaaaacatgggaagaatcagtttgaaacatgaccaaagttcatgcgcaaaattatgtatctcaaaatagaggcaaatgtgaaagtggagtaaaaaaaacataagaaaatatgaagggtatacttgtctttttacctcacatttaacaccattagcaagagttaataggacgctgattcgtctaaaaaatttagggaaaaaaaccgaaaacactaaagcacatgaacaaaattaatacaccaaactagggttgcagacttacagttaccatcaaaagtagtgctagtaaacaacaatctcgctgtttgggccgtttacactattaattgggctctcagagtttgggccgagatgtatgaagtcatcatctttcttcttttttttttgggcaaactacacaatttcggatttcagaacaatcggagctcttattgtttcagaacaattcatgagagctatatctcaattccaattaagttcacgaatttcaaaaaattttgtgtttcaaaactttttgtgaaaaacgcatatgtagttgaaagttaaaactacaagcatgttcattcacccaaaatttacgccggtgtccacactatctgaatattttgtcacctgttggtaactagagcttgattgcaaaataagcccctgttccagcaattgcacccagaggggtagaaaccatgtagacccatatctgggtgtaattccctgcgacaatggctgtaccaagtgttcttgcagggttcattgatgctcctgtcgacggcctgtcacccaaaattgaggacaaaaatcactaaaccaagaaaactctagagacaaatcaaaggtagtttttcacacttctatctagtctaactacatgaacagctagtactagtgaatgatgaataatgacagattaaattggctgtttatccatttttcttagtgttacttaggaggtggaatacgaattatatgaaactgaatttcagcaaatctgtgtacttgtaaatgcacaataggatttcacacgcataccctgcgacaagaacgttgtaaatgcacaataggatttcacacgcataccctgcgacaagaacgttcatcatcgctgtaccaccgactgccactgctatcaactctttaacctgaaaatataatcatcctaattaagatcattaagtaataacacaagataaactcttagataacaagaagaaatatgtagttttgtttaacgaaaatagggtgacgtagtaggaaatctagctactccctccgttacatattttagtcattgtgactttaattcaaatataatatatatatatatagcaacctagcttttcaacacaatacaaatactacctccattccaaaatataagtcacaaccactcttaagggcccctttgatttggagaaaaaacataggaattacagaggatttcaatcctataagaaaatttcctatgaagccctttgaaacaaaggattgaatcctatcaaattctttgaaattcctatgtaatggacaatcctatagagattttggaggaaatttaataagagcttcaacctcctggtaactttcctttgagtctatctctctcatccaattcctgcatttttcctccagttcaatcaaacggtcattcctatgttttttctgcactttccaatcctctgttttacacttacattcctactaaaatcctatgtattttctatttctacgttttttcaatcctgcgattcaaatgggccctaaacccaaagaccaagaaataattattatcttgtagcttgaatcattctgacaaatataacgcatgcatccaataagattagataatatgagagtggaggatttaaaaaagtaataatttaatggagaaaatgtcatagttaattgtatatttgcacgcatgtcttatattatggaacatctaaaaaaagtggttgtgccttatattatggaacagagggagtatatgatcaaaaaaatggaagtggaagagactacagatcgggcgctcgattcggattgggaaaaatcgggcgctgacgtcagtgccacgcatgcatgcaaaaccactttaaactaatttttctcttaaattatttattcaaatcatgatccgattgcaccattaaattcgttgcaattaaatattcaaaacaagaccacacatggatctattccgacgaaatttttgttggcttattattgaattatttttaaatgttgcacgatgttccaccaagtatatcggaattgtttcactaagtatatcgaaaatgtttcaatcgtttaaatcggatgttgtttcaccttattaaaaacaatgtttcagcaaatagcgaaaaaatgtttcagttcactgtaacattagatctatacgtagtgaaacattgtgagtacactaggtgaaatatttttggtggaacaaaaaatgaaaagaattcccttaatatagggtttccaaaatatgtgggtgatttgttgtaaaagaatgtttcattcacttcaacattaaacctatacaaagtgaaacatcatgagtatactaggtgaaacatttttggtggaacaaaaaatgaaacgaattcccttaatagggggttttctaaaatatgtggataatttgttgcaatagagttgtgtgtgtggacacgtcgtaggctagggaggagcgcacgcgccctggcatgcacgcacgcggagggcagggggagcgcccgatttctgctcctttcgccggtcacccgacgataatcattctcgtcaaaaaaaaatgtacaatatcatatttaatgaaactaatttagtgttgtagatatttttttatataaatttgatagataaataatgattaagataatttataatataaaacggaggtagtaattatactgcgttgggatcggcagagacagcggtgatgacgaagaggagaacaaacgtggtgacgaactcgaggaagaacgcctccaccgtccccaccttgggcacgctcaccatccaccctcggctcgccggatggaagatcccgtcgacggcggcggcggcggcgacggcgccgaggacctgcgcggcggcgtagggcaggaggtgcgcgggctggaggcgcccgaacgcggccatggcgacgctgaccgccgggttgatgtgggcgccggagacgtgggcgagcgacatgacgagcaccgccacggcgagcccgatggacgccgccacgccgacgaggccctccacgccgccgcgctgcgcgtcggtcacgatggtggagagcatggcgaagatcaggatgaacgtgcccacgaactcggccgccgccttcttcgcgaggggtggacatggccgccgccgccatgatcgacgacgaggtccatgaccacgagaccgagaggccggtggcggttcttcgggattgacgacgaccagctcgattggcgtgatcttggagctatgacttctgccgtcgtcgaaactggtggactccaaatttgcggcggcggcggcggcggtggccgaggtggacgccggtgatgaaccttcatccattttctttgaagcagaatgggttttggagcccgacatgcacacgcatgtgtaatatccaattccaatgtgaacggtgatagctagctgtattttttttttctcagaattagtgggctttttatttttcatttttttaaaagtttgagtctggttcaagatggaatatgctgtccctacatggtatcttgttgtttagaaaaaaacattctactaattcttttattacatagatgtaaaagcagaatatgattttcagaggttggtggtggagcaattcttctccaagagcaaagaaagccaagaggaggagttgacctttgagagttgacaaaaacgataattaaattaagaatttttgtagatcttcgaaatcgaaatcgtcactggtgttactatctaggtgatgatttcccacactacaagaattactaaatactcatcttcaacatgttttttttttcaacaatggagctaggagtaaaaagaatattagttattaacaatagataaaactggttagccaagcaattggagaaaaataaaatttagtaggctgtgtagaaaattgtagatgaaatattgggttgttggctaatatttgcatcgcaagaatctaaggtaggaaaaaatgataaaaagttaaggtttattaatactaatcctgaatgatgaacaaattaaatgatatcctactcttttatgcggaatatatagatgaatatatatcaagaattataaaaatgataaatatatatattgatatattgtggacataatgtgagggctaaggggtgatggttggatatgcttacttttttttttaagaacatatgcttacgttgtggacatatgtttttaagttgctaagatcatatataaaaattgtacacacaaattactttttgtcgctaataagccgttacgggttataataagttctggataaccgatgaggcccctcattataccgttgattagagcacccgcaatggtaaagtaatgtgctatctataaaacatgtacatctcagcaatagactagattaatagtaaatcacttcaatggtatgtctacatgggtatctatagctctctaattcattgcctcgtttttctctatagactatctctaagttagtagataactttgctctctctcttcatttaatctcttccaagtaggaaaatatgctgacatggatctcttgtagatagcatatagataaccattgagggtgcccttattgatggtacgagtgtatgacgtgttctagcagcccccttcaaattttcaacgaacacagatgaagagacaccaacaacactgctacagcaagggtattaatttgggagctctagccagattgaagtggagtatatctgatgaagaagaacagttgagcagacgggtggatcaatattaacaaatcgttctctagctcactcggtttttggactttcggtagagaacagcagagaattctctgaagattgttgaacttgaacagtaaactgaagaaacatgagagagacagagtttggcgctgcaaagcagaatgcaaaaaagctaattacaagaactataaatatatcttctctcaagattatcagctcataatctgacattgatgcacccgggcttgtcaatgcacacattcttggagtattaatctgacaataatacgctgtgacagtatgcgaaccttttcttggagtaaccgcgaacgatgctcgtgatgtgtgcgatttgctcagcagaaggcttactgcatgtgggcatagccaaagcatcccccgccattaaagccaccgttggatagagaaccgacccgtgaaccttccaccagttgagaatatcaaaacctgatgttggatcatggactagctcatccttcagataacggtcgaggtctgtttgggcttctcctcggcagtgctcatcccatgcttgttgcagtggatcagtgctgctaacggccaccacattcatggcactaccatgatcttcaacatagtcagagtatagcttagtgatattttgtgttaccttagagatataatcggctgcagcctcggtgccgaaggctgtttggaaaataaattttgtgcgtgcgagtttgtaccgaggatcaagtacaagtggtatagaccagaccgggtaggaatcttgtatagccttctctatagcgaccattgcttctccaagaacgtctgcaacatagttgccatctttggcgccaggaaagccattagattcattgtaagaaattgcattctctccacttgcccgtgctttttgatccttaaaaacttccctcagcttaaataattctatgagacagatttgatgaagtgtgacaatcgggggcagaaatcctttgaatggaacggtatatttctctccaaagcatatacgatagttcttcaaacactgaatccgttaatgaagagactttattgcgaagaacttccaacgaacagtattccgagtaccatttttcatcgtatgcccataggtgataatctagaccaagttgtgaaagaagctgatggcgctcttgtctagtcaaatctaaatgcagcaagttagagataatatcatctttgaatccttgatgcacaataagcagtctagcaatcgagtgaatcacactgtccatgtaggtggtacaaattagctctctcctatttggattggtatagttttggtttttctctatttcattcctcagttcatgttcaaggttaatatcgttgtcctttgtttcccataccatcatgaacagattatttaaaacctcatcgtttgaaaaacgaaccataactttcttaattgcaaattcacggatatccggatcgagacaaacttcatcaactcccaacaacgggccatggtagtcaagaaaaggaacaatcacgtaagcatccatgattaccttgtgaagattccattcatcatcgatgaagtggcacgccatatacagcacattcccttggatggttctgaccgtacccaccgcgatactgaccttactagggaagtcgtatagcctggagaagatgtccttccttgtttcgtcgaatatagcatcgcacatctcctcaatggcaaggcgcgagggcacctcgaaattggggttgaggcggcgcaagaagcttctgaagtagtcgtcctcgacgagcgacgggtcgtacccgtgcagcgcgatcatccgagcaaggtctccgctggccgccgcttcagggccagaagaaggcggcggtggtggtgctggatgttgtgctgattcggcggcgccgggggtttctttgcgttgctcgtggcgtttccagtgcgccccagggtgctcgtgccgtgattcttggtgtctgcgcggagcaccacgggacaatacttacaccgcgctttggcttgcccgtctccgtcgatgaaacaggtgaagtgcttccacacgtctgaccgcggggctatcttgctgatctgagcttgcgatcgacgccggtgggtgctactgctcgcctctgccatgtttggtcttttgattaactagaaagtaagcccacgcatctgcgcgggcactttatttatttattgtttgtaacaaataatatgaaaggtactcgtcaaatttatttatttattgttttatttatttatttattgtttttaactcatcaaatttactaaaacgacagtagactatcttataatcttcagaaaaataatctatgtcatgaaataaactatagactttgatatactaaatgataagaatgcctctcagagtgaaaaaaaacatactttttatcgattgtatttaaacttgccaaccaatactatttattatcattgtatctgtaccgtcaactgaactcaatacatctttgaaaaaataaaattcatctccgctttatattgaattgtctttgtctcacttatggccaaatctatgtataaatatttcaaaaattcccttatattggttaatggacatagtcgaccttagctgtcatggctttcttctctaatgtgttgaaacatggatcccgcattaacatatccataccccttaagaccaacgtggtgcatcattttaactcttagttcatttaaaaagaacaacatcggtaagtagcccaattgagctctattgctaatggtggcctctcattggagccacttcaatttaaccatatgtgtgaacgtacgatacttacgatagcatagcaatcttggttttctatgcttggtgcttagagagaagatatagatgatgaaaatggtttttttaattaagttttgagttgatttgtagtataaagtagacacattttgatattaaggtgttaatcggtactattatgtaatatttcttcttcattcaacactattaaaaaaaacactccctctgtccaaaaaaactaaattcttgagtttccgtgtctaacgtttcaccgtctatcttatttgagaaaattatgaaaaaatttaaaaatataaatcatgcatgaaatattattcatattttatcatctgaaaatactaatcataaaaaaatttcatataagagacggacggtcaaatgttggacacggaaacctaagaattgagtctttttgggatggagggagtatttctaaagaaatgtaccactttcatcattattatttactctttgacaacataatagtctagtacctagttcattatcaacacctgctatttattatcaatggtcaagtaagcagggtgtatgacatgccaatcagttaagcctgacatattaatatttaaggggttatattatagcaagataatttgctaaaatatcacatccatatatgtatcatgtatatttcccgctcctaaaataccaaccaaatattttattaacaatttttaatttgagaatttggagaaaaaagtaattttgttggtatgcacgttttttcttctcgcctcctgtcgtttacgtttacgtgtactttcactgtgcacgtatgtacttatattcctaatgaatagtcgtaggatatggaaaaaatcatgttgtctatgtgcattcctttcacctagtattctttctctcatgcctctgtatatatgtacgtttcttctggattttttcccgataaaattaaagaaatccctctatttcaggctataagacgttttgcctctagtaaaagtcaaactgctttaagtttgacaagtttatagaaaaaatagtaatattttaaacccaagacaaatttattatgaatatatatattcaattattgatttgat

SEQ ID NO: 60306 - DNA, 3028 bp, Oryza sativa
atagatgttagtattgtactattggtaagtgagaattacccaagccttattttgttggcctacgaattacttatatatatgacattgttgaagctgcaaatttgattagaactctactgggtttcaagttagtccataggtgcaatgaaataaggttttgccatcctatacaacatgctttaagatattctgacatattgttagtcgtggaactgtttctgtgattgccgcctgtcacaatttgactccatatttatgtaaatggatgaagcaattatattttgattttgattttgatttagttgcttggccattcaagctaatgagctatatgattgtttaaggatttgtgttgcccattttccactataggtgaagtttatctgaaacttaattgctttagtaccatttccaagtaggttgtttgggccatgatctaattctctttccaatttgttgataagccagtaaacaaaaacaatcagaggtctatacgatttggaattttcagccatgttgagttgaaatggtatttttctcataaattgtaacgatgtcttacaacatttaaatgttacaatagaattgtgatatgtgttatatctcattagtttgtttgaataccttaagcttattttgattccttctttatttacacgcagcgtagcgcgtgcctattgctagtagatctaatagatgacgcgcacatatataaccatatatatggttaatttctgccatttgattagatttttcttcaaaaaattgagaaaaggaaggcccacacccacccgtcctgtacgtgtgcacagacataaaaatataaataaattaaaaatataattacatatcacttacaaataattatagctaaattagacttgcattttcaaaaataaaaaacgactctatttgtgagtagcattctcaaaattatggtgcatatcttttgactaacttaattagattagaaaaaaagaaagggagaatgagagggtgtactacgtcggctgggggcactcctatatacgtaacagagtataaggaattagtttctttaaaacaaaatacatctaacctaatggtttaaaatatcaggtccaccgatttaagtgaaatataatctaatggtctaaaatattgggtccaccaatttaagtgaaaatcgacggttggattaaaatattgggtccaccaatttaagtgaaaatcgacggttggattagatagagccatgtggcggcctaatagcgtttataggagtctcacgtggtggcttgagagcgtttgtaggaagtttaatggacttttagtatataatataatataatataatataatataatataatataatataatataatataatataatatatataatataatataatataatataatataatataatataatataagattcctcagggagaactgggtggaaaaatggataacaagatataagttttgcctacgagaagcaaaagaaatactactatcaagatttcacgtcaaataaaaaggtactgtcaaaattaattactccctccgtcccacaatataagggattttgaatttttgtttgcaacgtttgaccactcgtcttattcaaaattttttgaaattattatttattttatttgtgacttactttattatctacaatactttaagcacaacttttcgttttttatatttgcaaaaaaaatttggataagacgagtggttaaatgttgcaagtaaaaaatcaaaatcacttatattgtgggacggagggagtagcaatcagaccacagaccatatgaatgcacagggtaagcatgcatatagctagctagatcgggatctcttcacgccaacacaatttagcccaacaagtgcgtcggcatcaataaaaaaaacaactgggaacaaatccgagctcaaaagattaagatgaactcacaggaggattgcagctgaagaactacggccgaccacgcccaaacaacgcaacgaagccgatgggccgatggaaccgaaagtctcgtggatggatggatgcaatacagtcgtccaacctgcaaagtctagtagtctacccttccacgaattttctactctgaccggatccgttgctgtcaattttcgtatacacctaaaaggatacaattcgagttagttaccatgttagttgcacttaatttcagtccaagcatatagagacgtttggaagctttttcatccaaaattaaacaacttgcgatagattttttagatatgcccttaaaaattcattgattttgaatagaaattttctgactatatttaattcgtttggaatctcctctcaaaaaatgtctatgcacaaaatttatgcattaaaactttgcaaagtttatttattaaaagtttgtatacaaaggaaagttccaatagagatcgtctccatcgataaaggttttctaaaaaaaaataattccgtattttgatactccatggctagggctttgattgcagtggaagccctcgtcgattctcgatggcagaaaaaatgaaaagtttgtagcacaacccgtgtcgttcttgggtcaaagccaacatgacagtccaaaatatctaagcctggtataaagtgtaaaggatggatactcttctttttcgagggtaagagctctgccgatttcattaaggaaatagtatgaattacctcccgaattatcgcggtcgtccgaattatcctctaacaataaaactggacattcttcaccctccaactatacaagccggatgaattaccccccaccccccgacccaatccgcggtggttttagtctacgtggcgcacgcgtggcagcccagtcagcattttcattttttttaaacatagtggggcccacctgtcatatactctctctctctccaatcttcccctctctctctctcactctctctctctccctctctcggcgagcacggcagcccgcggcggatacagcgtcgtcgacataatggtcctgcgcgggggagccatccgatgtcg

SEQ ID NO: 60307 - DNA, 5219 bp, Oryza sativa
tttgaccgtgagagagtgagagatagaagagagagaggaagagtgagagagaggggggaagaggggagagagagtgtgtatatatgacaggtgggctcactatgttttaaaaaatgaaaatgttgactggactgccatgcgaacgccacgcagaccaaaaccaccgcggattgagtcgagggggtaattcgtccgatttgtatagttgggggtgaagaatgtccggttttatggttcagggggtaattcggacgaccgcgatagttcccggggggaggggggtaattcgtactttttcctttcattaaaggaggggagacagaaaagtgttagtgaaaatattgatttacctctagtttattgcggaaatttagctaataaagatggcttaaagtgaaatttactctttattttcccaatttattgttcttgcatcgaaatcgagcgagaggataatttgttaacaatggtatgagagcctaccacgatgatatggagagttggcgactatacgtcttcgacggtggtcactacgctacgctcagtcgggacgtcgtggcgatatggccgcgcaaattaagcatccaccatgctaccgttgttgtctcaagactcaacgcaactacgcaagcgatattagcaacaccagtataaaaagaaatgcacataaatagtttggatttaactgttctcacatgcaaataaaagttcttaaaacgatgactctcaaaacacgaaattatccaacctaacaaaacgtaagtgtttcaccacatcttgttgtctcatcaaccacctctcttccaatgttttcagccatcacaaaagttcactatggcattttgctcagcgtctgagtgaaagaagacggcggtaaaatcaccgagagcttctccatcctctgcatctccggtgtcgcgaacgcggacgaacacccgtacacggaactccccttggcgagctgcaccgacgaggcgcgctgctgcccgtgcgagctcatgccggcgagcacgcacgcgcgccccgtctgcgcgtactcccgctcgtccgccacgcgctcgctcagctcacgcagctccgccaccagcgccgcgcacatggcgtcgtcgtcgtcgtcgacaacacgtactacaatagcaaggatatttggggaaaagataacaaggagctagccagattgaagtatctgatgaagaataacacttgagcatacaggtggatcaattgtgcaaatcgttctctcgttgctcggtttcggactttcggtggaaaacagagaactctgaaaattgttgaacttgaacagtaaaatataatgaagaaacatgacagaggcagacagagtttggcgctgcaaagcttgcatagttcaaaaagttaattacaggaaagtgaaatataaatatcagcactcaagatcatcagctcgatcataatctgacatcgatgcacccggagcttgtcaatgctaaatacgctgtgacattacacgaatccttccttggagtaaccgcgaacgatgctcgtgatgtgtgcgagttgctcagcagaaggcttactgcatgtgggcattgccaaagcgtccctcgccatctgagccacccttggatagagaactgacccgtgaaccttccaccagctgagaatatcaaaaccttgtgctggatcatggactagctcatctttcagataacggtcgaggtctgtttgggcttctgctcggcggtgctcatcccatgcttcttgcagtggatcagtgctgccaactgccaccgcattcatggtactatcatcatcttcaacatagtcagagtatagctcagtgatatttcgtgttacctcagagatgtagtcggctgcagcctcggtgctaaaggctgtttggaaaataaattttgtgcgtgcgagtttgtaccggggatccagtacaagtggtatagaccagaccgggtaggaatcttgtatggccttgtctatagcgaccattgcttctgtaagaacgtctgcaacatctttgtgatcttcggcgccaaaacagccattaaattcattgtaagcaattgcattctctccacttgcctgtgctagttgatgcttaaaaacttccctcagcttaaacaactctatgagacaaagatttgatgaagtgggacaatcgggtgcagaaatcctttgaatggaacggtatatttctccccaaagcatacacaatagttctgcaaatactgtattcgttattgcagagcctttcttgcgaagaacttccatcgaacagtattccgagtaccacttttcatcatatgcccataggtcataatctagaccaagttgtgaaagaagctgatggcgctcttgtctagtcaaatgtaaattctccaagtcagagataatatagtcatctttgaattctggatccatacaagcagtctagcaatcgagtgaatcacgttgtccatgtaggtggtataaaatagctgtctcctgtttggattgattttgaatgggttatcctctatttcattcctcagttcatattcaaggttaatatcgttcccctttgtttcccatatcatcatgaacagattatgtaaaacctcacgcgctttaaaacgaaccataactttgtcaatggaaatatcacgggagagatcccgatcgagacaaacttcatcaactcccaacaatgggccatggtagttaagaaaaggtacatccgcgtaaacatccatgattatcttatgaagattccattgatcatcaatgaagtggcacgctgtatacaacatattccctcggatggttctaactgtacccactgctatactgacctttccaggaacatcgtgtagtttagagaagaggcccttcattgtttcatcaaagatagcatcacacatctcctcgatggcgaggcgcgagggcacctcgtactcggggttgagacggcacaagaagcttctgaaatagtcgtccttgacgactgacgggttgtacccgtgcaacgcgatcatccgagcaaggtctcctctggccgcctcttcagggccagcaggcggcagcggtggtggtgtctgttgtggtgattcttcgcctggtatttcttcgcgttgctcgtggcgattccagtgcgcccaaagggtactcgtgccgctcttggtttctgcgccgagcacctgggggcagtgcttacaccgtgctttggctcgcccatctccgtcggtgaaacgggtgaagtgattccacacgtctgaccgaagggctatcttgctgatctgagcttgcgatcgacgccggtgggtgctactgctcgcctccgccatgtttggtcctgattaattcctcagggagaactgggtgaaaaatggataacaggatataagttttgcctacgagaagcaaaagaaatactactatcagaatttcaccgcaaataaaaaggtactgccaaaattatttagcaatcaagaccagagacaatatgagtgcaaagcgaagtatatactagctaatttggtcatatagctagatcgggatctctttacgccgacacaatttagttaagcaagcctgaatccgtactcaatcaaaaaaccgtcgcgaacaaatccgagctcaaaaggtatcgaagaactcacaggagggttacagttgacagcagcagttgaacaactccggccacgcccaaacaacgcaacgaagcgatggagtcgccggcaacgaaaggctcgtggatagatgcaacgaattattatttatatacacagttgaccaaccctctacacttgctcaagatgtatcgtatgaccagatcagatccattgcgctgtcattttccatataatccgaaaggatacaattattactaaaaacctcatgaagagttttatttacatatgttcaatacacttttatttcatcctaaggctatactctgtcccaggcagacaatgtcgggtttgttagaattaaaatgaccatgtccagattaattctaataaatcccatgtccagattatatcgcattgaaaatcaatgaaaaaaaacctcaacttaaatagtctataatttgagtgcacctattaactgggtgaggtgatggatggattgtcagactcccacgcagggcatgtgacggagacggagcggcgggctgttcgttttctcacatacggatgttaccactatatcatgcggaggccatcaaaaggagtaaacaacacgtaccccttgccgccttctactaccggctgttctcctttcccacaaggtagaaaaacactatgtctctcgtccgaaagaactctctagcacataagctctctcttccatcaagaggagtaaacaacatatacctcttccactaccggtgtctgttctcattccctaaggaggtagaaaaacactgtctcttgtccgaaagaattctcccgcacataagctctatgttccttcgtcttgttctggttctctctggtagatacatcatgttcttatgcttctaagttacttcggtaatccccggtcctaagtacctgcacgcacaggtattcgggacaagcaggcctccggaagtgtatccaccatatatagtacttaggtggacgatcaagtttttgggtacgcattctttgtgcaactgctctctgctttgtcaccgacattaggaacatcaacaccaacaccgctattggatctgaagtattttttaggtatgttctctttatttcaatgttaaacatgttactaaatgatgttattattgttcttagcatattcatatttagcactatcactagaccaccatattatacacaagttatgtttagtatcatattttctggattaaaatatatcaaataatgaccaaatatccaacgggttcccggttatgccacagggaactagggaagtgatggaggagcgtatagaccaattacaacatgccctcctcccatgttgatgaggaccaattacttgaactggttacttctgatttttttcatttttaaatttttttcttttaatatttacagaaataatccatcggcgcaaaaaattacaaaaatagaccctgccgccctccactagggcggcaagctgacatggcaaacgggggaggaacgggcggtgacggcagacgggagagggagggtttttttgcatgaaaacccttgggcccctatgcaaaaaaaccagcccgggcatagtactttttggct

SEQ ID NO: 60308 - DNA, 10375 bp, Oryza sativa
  unsure (1)..(10375): unsure at all n locations
gtggtaatgggtcagatccatggacctttcttttcacaactatctcagccttttaatttttttagtcttgccaaaatcctttttacgcagcccttacatcttgtaggaaaaaaaattaggctcgttaccacgcctaggtttaaccagcaatgtcagaggtggtttaccgtgtttaaatccacggtgaaaaattttagcatgtcacattagatatatggacacacatttaaaatattaaatatagtataataacaaaacaaattacagaatccatctgtaaaccgcgagacaaatttattaagcctaattaatccgtcattagtaaatatttactgtagcatcacattatcaaatcatagcgcaactaggcttaaaagattcatctcacaatttacacgtaatttgtgtaattaattattttttatttatatttaatactctatacatatatccaaacatttaatgtgatagggtataaaattttaccaggatcaaagcagaccccgagtattgcggctatgtgcctatgccacacgatagacatgctgctagccgttcgggtcgatgcggttaaagaacggaggagttcgacgtgcacaggtaaagcataatctgtctaagtggtttagttcctaattttttcttcaaatttctagctttttcatcacattaaaatttttctacacataaatttttaacattttcgtcacatccttccaatttcaatcaaaccttaaattttaacgtgaactaaacacaccctaaatactcagacaccacagattcaacaaaacagctccaaaacacaactgatggatgatgatccatccaccattctaccatttgttctctcaacgcaagcgatattattagtaacaccatggcaccatgctaagtgagctaatgcatattaaatagttcggataaaactattttaaaaaactaagttcgaaaaaaaaaattaaaacaggaaattatccaacttaacgaaaccttgccgctgccctctcatcctatgttttcagcgtttgagtgacagaagacggcggtatttcctcaacgacattatacgaggtacagccgcgtcgaaccttgccttcagtgaaccaccggacttgcttgccgccgccgccgtcggcggcggtggcggcggtggaggcgccgcctgttgctgctgttcacgcaaaatcaccgagagcttctccatcctctgcatctccggtgtcgcgaacacggacgaacacccgtacacggagctcccctagctgcaccgacgaggcgcgctgctgcccgtgcgagctcatgccggcgagcacgcacgcgcgccccgtctgcgcgtactcccgctcgtccgccacgcgctcgctcagctcccgcagctccgccaccagcgccgcgcacatggcgtcgccggacgccgccggcgccgacctgctcagcgcctcccgcctcgcgtcgaggatccttgccgcctcgccgtaggcgccccgctcggccgccgcgcgcgccagcgcgatgtcgtccgccgcctcgaggcggacgcgctcgcgctcaagctcaacctccatggacggcgccacgcccgtcgcgacggcggggcggaggaccacggcgtcttcctcgccggccacgtccaccgactgctccgtcgccgtgtcccggtacgtgcagcgcacgctggcgaggcgcgtggcgacggcggcgtcgccgtcggctcgaggcacgtcaaggaggagcaggaagcggcgctcctcgtcggcgtagagctcgccgacgtccaccgtggcggcgcggccctccgcgtcgatgcggctctcgtagcggccggacttgaccgcccggacgcgcacgccggggtccaggcactcgacggagatgcgcgcattctgcgcggcgacggagaggagcccgccgatgcaccgcgcgaacgtgtcctggatgacggcgaggttctcgatgaaggagaaggtgccacccgtgatctccgagatgctgtgcatggccgccgcgtcgtggtcggtgccgaacccgaacgcgtgcaccggcgcgcaccgctcgccgccgccggcgcgcgtgaaagacggcggcacgaggacgtcgtagctggtcgccgctgccttgaaatccgtcatgtggaagcggccacggtaacccatggtctggttgtcttggccgtcggagaggaggatgacgctggcgacggcgtcggtgtggcggcggccgtcgagcaccttggcgtccacgtcgaggccgtcgcggatgttggtgttcccgttcgcgacgagggcgtccaccgcgcgcttggccgtgccttcccgtcctccgacatgcgcgtcaggcggagccgcggagcacccggcgcgcgtcggcgtggcgaaggcgacgacgctgaggcggtcggcggcgccgaggctgtcgatgacgaaccccatggcgcgcttcaccagcgccagcttgtccccggtcatgctcgtgctgacgtcgagcaccgtgaccaggtccagcggcgcgcgccccgccgcctcggccgccgccgcgggcgccttggcgtgcaccagcacggcgaagccgtcgcgcgcggcgccgcgcgagagcgccgggtactcgcagtgcgtcttgagcaccagcacgccgccgccgccgccgctgctgttgcgcgccgccgtcgccaccggctccaccgggtcgtcgtcgtcgtacgcggcggggatggaggaggtcgtgagcggcgacggggcgtcgcgccatggcgtggcgcagacggggcaggcggcggcgccgccggggacgcagcggaggtggaaggtgtgggagcactcggcggtgaagatggcttggccggcggccatggcggcgaagcagacgggacaccggatgccacccatggccatcgtgccagctgccatggcccatggatcacctccttgagcaagatcgatctccaacacgacatggatcacctcttttttgtttccaaatcatcttgctccgttattcagtaatgatatgatctttttcggcttgcgcgtaaagctaggaatggaagaacaccgcggtcgctcttacagacaagcaggggagcatagacccgagaaagctccgtcgttcacgtgtcttctatgggcctataggcccaaaacaactatgggtcagtttggtttgaggcctaaattaggcttgccaattttttggcaacctcaacaataattgtgtatgtttggattgaggccaaattttggcatgcctatataacataggccatttcaatagccaaattagtttaatttggcttcaatccaaacatatgttggccttacnaaaatttggcatgccnnnnnttgnnnnnatnnnnnnnnnnnnnttttggtaaggccaacattggtcacgaaccaaactgaccctatgagttttttttttcgttttgaaataagtccactataactcccttaaatatacttgtaatccaattcgtatcccttcatcgcaataacagatatgttaaactccgaactattaaaaccattgtaaaataactctcgacggttttgatgattttcgctgacgtgacgcattgacctagtccaaatgtttagtcagtacgtagggatccacgcgtcatactctctccttccccagcggcaccgccccagccgtggccgctcatacacggcccgatcgagctcctgcgtgtaggtaggggtgtaagtgggtcagccgcgaacccacttataggtcaaaataagcgggttcgtggcttattttagcttataagtgggtttcgcgggttagccacttacacgtctacgtgtaggtggtttgggctcagcttcttagtaacatcatgcagtacaagtaataaaattcacacaaaatacaggggaggataagcacctgtggacagcttcctgatcacttgcctcttgaggctcttgttgactactccacgcttcgcatccgcttggccggtacggcttgctccgccaccagcgccgccggatcgtttgctcacgctgccggcagcttgatgtgacatcatgatttaaactgtgtggtctataatagctgtatgcgtatgtttaatatcatctttctagtttatcaagagtaaaatttacttatactggtttgtctctcgaatcatatcatttccggattaacccttttacatcaaccaagtacaaaaatataggtaaaatggcatgtgtaagtgggtccgcccgttgaatgggctaggcttcgtggctctgtatggcaggctgttacaaggatgaacatcgcaaagctcgaagcctcgaagaagacgccacacatcttctcctcagcgagcatgctttccttcgacgcccactagaagcccgtgctaacagtgctaggggtgcaagcggccaccccatgaacccgcttataatagaaataagtgggtaacccgtctaaaaggggttagctggttggcacactcttgtactcttagagtagggtctcttatctcgctcaggtacccgacacccttgcacatgttgacgaacacgttaggacccttagtctccggaccgaaggcccagatcttcttggacagatccttgtcctagtgttaacgccaaaatttggtaagccctgaagtcatcatcgtcttagagtcactatcggcttcacaatcttggaataggccgataggaattatcaagttgccaatagtcggattcttagtagattcgattaaggaaattaatttattaaaagaagtcaccgagttcaatgatgatgcggcataacagcttatctattaattaggaagactttgtttgtttctttttatctttaggaaagtgtgcttagtgtccgataagtactttatgttttccttttatctttaagcaaatttcattcttatccaagaagaactagtatctacccaagagtataaatatgtacacacagagtcattgtaaattatctctcgatcaatacacgcatcggcttcttttacctttctactttttcgatgagttcttgcttcaagttagggcatcgttcgatcttctgacaacaactatgacttgtctcagcggtttgcgttggcagattagggcgtcactttagatgttctaatctatcttctacagccgctggttatcatatatcttagttaatctagtatagtatcttaatttgatcatatcggctgagattcgttttagagtttatactggtaccgactaaattatcttgctagattagattaactaaggtatctaccactctgaaaatcagttaaatgcataattgtctagatattatgtttctttcatacttagtgttgcatcagttaagtttgatctactaggttgtgcaagaaccataatctctagcctatttctaattagggtttcatcgagatttcagccgatgagttatctgcgtgttacatcggcttataaggattacatgcaaattggatttagccgatcgcaacaaagattttactgtttacctaatcgtttggattttatgccatcaatcctctagccaatatatactttaaacttcggatcaacacttgctctatcatatcatattattggtcgattggtttctaattgtttatattactgttttattacaattttttaaggtccatgtggctcgcttgacctaataattattattaaggagctagctaattatttatttctcgatgatcaactcaacttagctaacttgttatatagcacgatcggtctgatctgaaatcagggtccgctctggagcgatggcctagggcctaattataattagggcccctgcccaggtatataccttgtataggtatgtagcccaattatttggcaggaataagttcacttagtgacccttaaaagtgatcaaaatctaatctgtgaccctaaaccacaaaaccggatatctcgacccctaaactcttaaaaccggtacaatttgactcccttagcagttttggaggacggttttgctgacgtggcgcctacgtggcggtattaaccaggtctcctttacacgtggcgttgaggtggcatttaaaatttaaaaatatatgtgggacccatttgtcaatgacacataaaaaaatttgtgggatccacgtgtcacttctctctcccctccctccagttccttctctctccacgccactccctctctcccgcggcaatgcggcggacggcgagggccggagcggcggcgggcggagacggcggcgagcggcggagatgcgggagtggcggcggcggcgcccggccctcgccactccctctctctctctccttctctcccgcagcgagcggtggtgggcggagacggcggcggaggcgcgggcgtgacgcggcggcctgcgactgcgagcggcggagacacgggagtggagtcggcaggcacagaggcactggacgaccggtggcagcgacacctgggctgagcttcaccgcctcctcgccgacgacgaccaggcgtttgagcaggaggacggcggtgggaggcacacgcggcctccctatatatacggcctaccgtccagattcgttaacggttcacgcctcggccgcatccctcctcgcgcactctccctcgtgacacctacggggctcgccgacaacatgaacaagaacgccgcaccggaagacggcgagagcggcgagcacgagcggaaaggtgcgtacgtgttcgtccttgctggttcttgatttcttctccccggtttttttggggggttttctttgactggttacggcatgcatgccgcatgggtcatcggctatttgttttcttgggacaccttgcgagttgggttgagattgagaattgtttggttcgtttgagctggtggtgattccggttaactgggtcttttttgcaggcacggtatgggcggcgacggcacacattgttacggcggtgatcggctccggcgtgctggcactggcgtggagcgtggcgcagctgggttgggtggctgggccgctcgccctcgccggcgaaggcaccggcaccgacttggaccgcgtcgacatgagccgatgagcggcggcggtgacggtggaggacgtcgtcgtcatcgaccccgccgcgtgtgccttccgccgccgtcctcctgctcgaacgactggtcaccgtcggcgaggaggcgatgaagctcaggccgggcgccgccgccgccactcccgcatctccgccattcgcagtcgcaggccgccgcgccacgctcgcgcctccgccgctcgccgccgtctccgcccgccgccgctccggccctcgccgttcgctgcattgctgcaggagagagcgtgcgcgcgaggagggagaaggaactggagggaggggaaagagaagggacacgtgggtcccacaatttttttttatgtgtcactgacaaatgggtcccacatatatttttaaattctaaatgccacctcaacgccacgtgtaaaggagacccggtcaataccgccacgtcagcaaaaccgccctccaagtgtcaaattgtaccggttttaagagtttggggttgagatatccggtttcgtgttttagggtcacggattagatttcgtttacttttgagggtcactaagtgaacttattccttatttggcactcctcggtttcctggtggcccagcctagcgctaacgacgtgcaaaaacgtaagtaataagttcacttctggtcccttaatttgtcgccgagtttgaaattcatccctaaatcgaaatagcagatatagcatgtccgtcaactctcaaaactactacaaataaggtcctaaggcggtttgggtggcggtttcagctgacgtgctatacaaaccatctacgtaggcgccacgtcagctataaccatcctccaaaccacatggagaccttatttgtgacggttttgaaagttgagggatgtgttgtatctcgtattttggtttagaaatgaattttagactcggcgataaattaagagacttgtagtgaacttattccaaaacataattgcacccaacccgatgcttcgcgcttcttgtgacactctgccttccgctcctgtcgcatggaaatcgcggaggcgccgtgatgccatggagacaacagaactggaggccggaagcggaaacaaattaaccatcaaaagtgaagctagatcaggtgatgatccaatccatcgatccttctcactgattagaattgatttgttctgctaatcctatttgttttcccccttctattgcctaggttaggaatctgggttcaactgttaaagggatcaatatcttcaacaacattttgcttcaagaaatacccgaataagttctttttttataaaagtcattgggtatttgtggtcttctatcgagctatttatactactttgtttctacatgtttttggttgtcaattatactgtcaatattattaatcgaaaataaaatactactccctccatattttaatgtatgacgccgttgactttttgacaaacgtttgacattttgtcttattcaaaaaatttatgtaattataatttattttattgtgacttgatttatcatcaaatgttctttaagcatgacataagtatttttatatttgcataaaatttttgaataagacgagtggtcaaacgttggttaaaaagtcaaggcgtctgacggagagtggggctcctcaccgggagaccgcgcaggcccccctttgccggttcggccggggaccctaggtgagactccaagctcccaatctgtatgtggaaggttcgcgagacaggaagcacagaagacgccggcgatgtatacaggttcgggccgcttagaagcgtaataccctactcctgtgttttggtggattcgtgtgtgaaggagctacaaagtatgagcctgcctctcccttgttctgggtttctaatctggaaaagtccagtccaatcaaaaaacccccctctctccgtgggcaaggtcctccttttatatcttaaggggataccacatgcaccatcccccctctctgtggggacttaccctaccttttcataaatggacggagatttgcatggttgccgttcgagtcaccttctgatgggacggcccgcacctacctccactttcgccgggagcaggcgcgacgcggaatcatggctgtctgctgacgacatgaccagtgtcagactggtcacaaatcggtcattcttgtccaccacgcgtcatcttagcaatctgcacgttggcccttcttcacacaacattttgcctgtaatggttaggatgaagcctggcatatatctgaccaggactaacgtgtcatctctgggaggtaacacgctgatccagctggggacgagtgcctagaagcccttgtcctgacgggatggggcgaggcgtgcgtcagatcgcctgtcgccacctaacccgcgatctgaccggtctgtgactggtcacagaccggataaatgagtgcactgcaccgcgttacatgcggcgtgacacgctcagccaaaccgcaataaatgtggttaggtgagccccactgtgcccacctaacccatacacgcggagcgaaaacccacgaggggtcggggcgcctcggccctcggggccgaggcgggtgcggctcgaccccctcggggggactaagaggagggcgaacacatcttgggcccgacgtcccccgagggtgccaggccacgtgggcgattgtgtctgcctcaaacctctagtcatgatactcccgatcccatgtcaccgacagcgtcatacattaaaatatggagggagtatattgtaatttacaactacttgatttattatttatcatgttagaaatgtttatttatgtcactttcataggatatgtgttttaaagtataaattataagtaaaaaactttaagaacctatagtgtcgagttcgtatatgtcatgttgtagatcacgactacggtatttgcattgtatagggatcgttagtaccagggtatacgcgagatgaggaattttttatacacgttcgcctctctttatctataaggtgcactatgacgaaatccatctttagtggcggctattttgggttttcgctggcggaatttggacccgccacaaagcagaggccagtgacaatcaagattttcgctagcggttatcgaccgctagcgaaaaaacattttcgctggcggtcatgttaagccagcggtcagcaaaaatccattttcgctggtggctggtttaagacggccgccagcgaaaatatttttttttgctggccgttacactataccagccgccagagaaaataatgaccaaattttaaaaaaaagacggacggagcgttcgctccgtccgtcaacgctccatccaccaagcat

SEQ ID NO: 60309 - DNA, 933 bp, Oryza sativa
taaacttagtatgttgtaattttatagaaaatacagatatgtagcatcaacctatctaaaaacacattaagcaagctgacttataaatgacatgtgaaaattgaagacatgcatgtttctcttgagagacgaaaatccacctcctcgatataagaagtgctatccactactccctctcccccttatatataagtgattttggtaggatatgtcacatccctccaaaatcacttatattataggacagagggagtagaagctagctaaggaattcagccgtcagaaagcaaacgtcagcaaccgcactagtatacttataaccccagctagcaggattatagtataactatacataaattaactactattgggggagtggctccggattgacggagttcatctccgtcaagtagcttctatcccggagctacccccatcctgggaaaacgaccgaagacagcctggagctcccatggccatcatgcctccgaaggctggccaagggcaccagagcctatcagcccagagcccatcaaacccccggatccaaccaagggctccagagcccattaagcctccagactctagaggctatcaggcccgcttgatgcacctggccttcggagccaaccaaggtcttcggagttggccaagattacggagcgctgaggaagccccaggccggaggcgaaggcggaccccgagagcgcagtgggccgtaataaatacgcactacgcacccgccaaccatatctggcgtcattacagggacgggccagcacaggccactacccggaaagcacggctttgcccgggtaatagccagcaccctcgggaggcgttatcgccttcttaatgggcgcagccatccctgtcattggggattttactaaaagctcgagggcgggcccaccggccagccactctagattg

SEQ ID NO: 60310 - DNA, 8881 bp, Oryza sativa
ttgaggacattgaatacagaatacagcttgagtacattagttggatttgttacaaaaactactacgtttgttttttaatacataatatagttgacttttaattgttcgtcttattaaaaatttagtgtaaatatataaaatataagttaagattagagttcgtttatgataaaattaacaactcacggatacaacaaacgagatgtatataattttttaataagataaatagttaattgtcacgataaaagttaataacgttgtacattaaagttttttaatgtagtattaactaattacgtaagaggattggtacatcataaacaggtatacatatagtaaaaaaacgaatggagtattaattaccactgcatgccacttattcaaaacatatagtacttgccttagataagagatcgggagtacaaccaagcacacacatgaacacatgtggcgtgcggtagctatatgttatacatgcatgattgattgatatctatcagaactggtagacgacgcccttgttcttctcctcctggtcccgatccttggtctcctccttgccgatcaacctcaccaccttgtccgccgccttctccccggttgccgcctcgtacttcttttcctgcatgcatatgcacaatactaagttagagcaagaacagtagacagtttaagccgatggtaatgcatgcgtgcaagaagaagtgatgagctagaagaggaataagtggagagagtatatgcgtcggtgattaatttgccgccggctccaaacacatccctaggtgagacggacaacaccagccagtatagaaacatggttgtgaggtccatgtgagagcatatgtgtgtgaaagctaaattagaaaaatatagatcaatctattggagttcatgccaatagccaactgctatatatacggtctcttgatcacctccaatctgatgtggcgcttttaatcgtcggcaggttgtatacactattaaacctgctcttattataatacttcatttgttttataatatatatagtaatcatttgttctataatatatatagtaatctatagcggggataagacactacatatgtaacgaatctggcaccaccaattccatccaaattcgatgcactatatatgtatatttcaatcttagactgttatattataaaacggagagattactatacaattactttcctactaagtagcactaaatatttctctctctcttttcataggcttccaacagggatgggggcaggcctagggcagggcctaagccctagcgctgccttcaaaaacatacttaaattttattaattcaccgtgtaaatttttttagaaaattaatacttcattagttgagccctatcttggagctagtttttacctccgccactagcttccaagtcgtcatcaaataaataactaagaaccgttagactcgtattgatctaaaacacacaaccgttcgatttcatacactcctagctccaccggcccaccggctcaattcaccgaccttttatttatggaaacgaattgattatatatagttcccaaacagggcagctcacatgtatgatttgttctgtgattaatataatttgatttaaagatttagtacaaatgttatatgtgtgaggcgtccatcagttcaggattggtcatcatatttgttcaatctaggtgcataacacaaaaccgcatatcactgaaattacgcaatactaaaatttatccacacccaccttgttattattcagcactgtaatttcaattgacaatgattttgtatcatctctgtagagcttaattagtttgctagctgttagctttctgcttgatgaatcccgttgtctttccataatccatagcaataacgtggggtatggtatcatctactagcagctagttgaattaagtgaaacattagactctgatcgcatatttaattagctggagtagtaatttactccctctatcccaaaataagtgcagttttgcactgtttatatttaacgtttgaccgttcattttatttgaaatttttttatgattagtatttttattgttattactccatccgtttcacaatgtaagtcattctagcatttcccacatgtatactgatgttaatgaattaattaacatcagtatgaatgtagaaaatgttataataatttacattgcgaaacggaggaagtagatgataaaacatgagtagtactttatatgtgactaattatttttagttttttcataaatttttcaaataagacggatggtcaaacattaaacatggatattcatgactgtatttattttgggacggaggtagcagctgatagtagtagtagtagtagagtggtacgtacgaaataggccgttccagcctgagcgacggcgccaaagttgacgtactccaccaagtcgtcgtctatgcggatgtggccgtgctgcttcgccgcctctttcccgttcgtcttgccggtgtccaccgccgccgcctgctcctcgtcgaccttcttctgctggggcaggtactcgtccatggctagctcgatcgatctaattattatcaggatgctatagcaaagttttggaagaagaagaagctagctgctaccttattatataggctcggtgattgggacggagagagtatttaaaaacatgtgtaatcataccccatcaactgcgtgccctactccatcacatcatacgtcccatctaaatctggtttaggtcccaactttttcttcaaatttttaatttttctatcacatcaaaacttttctacacacacaaactttcaacttttccgttacatcgttttaatctcaatcaaacttccaatttttgtgcaaactaaactcgccttagccctgtttatattccaacttttttttcttcaaacttttaacttttctgttatatcgaactttcctacacacacaaactttcaatttttccgtcacattattctaatttcttcaaacttccaattttgacgtggaactaaacacagccttaatttggtttgtacgagtaaagtaatattacctttgtttcataaaaaactaatctatattgacacatcctaatactacgaatgtaacgagattcatagtattaagatgtgtcaacatctactactagattgatttttttacggagtagtactcccttcgttaaagtgtgtgtttttcactcttttaccgtactaatacaaacaaaaatattcttactttatcagattttaatataattatttcttcttttatttattttaagtgtatttatctttacttttataaacttgggtacaatgatgatggttaaaaataaatttattttagaagagaccgaacgaggaaaaaaaatggagtaacatatattgggtgatggcgacgttgcaccagctccgggcggtcactacgtggccatcgacgaaccacagaaacgcaatcaagaccgatcatcgataaattcatataccatggattaaataagagtgttgttgtttcgacatacaaatcctcatcgataagaataatttacaaataacactcaaaagcaactactctaaagctagctattttcagagggagttgttacttttatattttttcttaaaagaaacttcaaacgatagcagatttgctggatatgttaggaggaataaaaacataaagtcttacagagatcttttgagaaaggaacacatctaaacaatcaaagtgattagacttagatcaaatcaggtcagtggatcgactatctgtcggcaatcttccccaagtcgagccgactacaaggttgaagcgaaactgccctttcctctcccacggccgaaactttcctctccccatatctagatccgccctgccatcgccagagctgaccggcggtctacgcggcggataggatggcagcggcggggagacagacagcggagaagttgcggtggcggtcggacggccagactcgtgcctggccgcgtgggttggcggcggcaacggaggtggccgggcgggtagcggtgaagcggcggtgttcctccgggcggtggtgggaaggcgggcggcggaggcgctgcggtggcagtcggaggtggccggactcgtgcttggctgcgagtgttgacggtggcaacggatgtgcccgggcgggtagcggcgaggcggcggcgtccctgcgggaagcggaggtgttgtggtggcggtcggaggcggtcgaactcattagccgcacaagctagcgatgacagtaaaggtggtcgggcacgtagcggcgagacgaaggcagcgacatctcttcggacggtggcagcctgagcgttgacggcatgtcctcaggaaggagatggtggttccagtgaaggtagccctagggatggcggtagcctgggattcagggtgaaaaggacttcctcaactatggcagtggtagccctataggggcagcagcagcccgggacggcgggggcctgagcgccggtgcaaggttctctgcaaggcggaggtggatcttggcggcggcggcgaccctagggacgatggaggcttgggagtctaggcggatgaagatatcctcgacgacggaggtctaagttttcagcaaatggacactgacagaggcgtccaagggcggtggtgggctaggaatccgggaggcgaaaaaggatcccaacgatggcgacagcccgacgaaggcctagaaatcatacgaagtggaagcagatccctcggcctacatctggtcagctagttctgacttggacgaggatggatgatggtgggctaatcggtggcgtgtggcgttaactcacctgaagcgaatgaagatggcatcagcagaggttctcagcgacgacgcactaggggtggtggtgacttgaagactttcactaacggaatctggccgtttcagcagggtgtggtgaggtgtaggttttctttttctggttctatgttctcatcgttgaggtgtgagtctaagtgctcttgtatctttttggctgtgtatatctttcatggatacaaaggctggataaatgaaaatccattatcacaaaaaaaaaagatttacaccaaatcaaacagaccgtagaaaggattgatcacgcttagccaataattcttttattgatctattaagctaatatttttcttaatttggaagacgacttttctttcattttttgatgtttgttggaagattcttctgctgcattccaaccagacgttcctgttaggatacgcataggctacggtagcataaattaaattttttctaccgcgtaaaccaggacccatacatgtattagatcatagatcattatcattcgacgcgctgcgcagcggaagaaagcgataagaaggcgaaggaaccctcaggatgtagcgcgcgtcgatgtagaggaagtagttgaccgcaccagctcgaccttctccttctcgtgcgttctcctcgccgtactcccacgctgatcaacaccgcaaagcagcggctcctctaccggtattcacatgtatagggacggaacgccacgcgcagatgtgctagcacatgcgcgcggctagggttttgctcgaggaggggagtggcggctagggtttctcacgtgatggaatacctccgccggtcacacccctcacaaatatatagaatccatgactcgggcctccaaggcccgtaggactcctattcggatccctatccgaattaagctcatattggatctccatctaatccccttattccggcccattaagcgtgcgaccctgtagatttatgtacactcggctgcaacccgaaaactccttttcggtctacgtgtcaacagcggcccctagcagaatgtattgatcgaccgggcatgcacaaagatcatctcggttaaacctctagtatatacttgtatgaacccctttgccttacgatatcgattaagctcaaggctagatatgtgccatcctcttcgcatggattgaaggctcgctttatcaccttatttgcatatgctttctcctataatattaggtatatgctatttccatataatatgaaccatgtatagcatatagtatatcttactcgtaacaccaacactatcatggagcaggtgatcgacaagaacatggaagaaattaaaatggaatcttggagcataggaggagcgaggagtaacggtgatcttgttttctcccctttttttagcaacatttttttatattttccttgttgagaggaatggtgatcctctgtttgctgtcaaattctcaattagaacagaaataaccgcttaggcaatattcttttctcgtcaatatacatattttatcttaatttccgttagcatgttttttcaaaccacgaaatataccatttatgaaaattttatatacaagtcattttaaaaatttagataaatttatttttaagtttatactccatccgtttgataatgtaaaactttctagcattgcccatattcacacacacacacatatatatagatatatgtatatacctagattcattaatatttatatgagtgtgggtagaaaatcttaccttataaaacgcggaggaagtaataattaaaaatcaattaaccatattttacgtatccgtacttaagctccattttcagcaaatcacagcccatccctaaaaaaaaaaaagcaaatcacagccacaaaggcccatccgcccatgtggctatgtccacgaggcccataacacgctcgctctccctctctctctccaccaccgccggcgctcgcgatggccacggggctcgccgcggcggcggcccgccgccgcctcctccaccttcctcgccaccgctgggcccacctctcctcctccgctgctcccgcgggagggctggacggcggggacgggagcggtggcggcggccgcgtcaagatcttcgaccgcgacctgaagcggcggcaccgggaccgggcggcgtgggccatgggggagaccgacgcgctcgccgacgccgtcgccgacaacctcctcgaccgcctcgaggactgcaggaaggcgttcccctccgcgctctgcctcggcggctccgccggcgccgtccgccgctcgctccgcggccgcggtgagtgagctcctcaaatctatctcctcttgttgttcttgcgtgacaacccctctacatatgcaccagtagaatcgctgaatttttccagcttttaacttgatagggagtatgttgtaatgtggtgatgggaggaattggggttttcttgtgtaacaggtggaattgagaagctgatcatgatggacatgtcggccgacatggtgagaaagtggcgagagatggataatgctaccgatgacgtcctcgagacgcagtttgtcgtcggagatgaagaataccttccaatcaaagaaaggtaaagatcaatgggagcaatggttagtcttcagtatgttagttggttccatgtaaatattattgagggcattattatgttcttgatttgttgattctggcaatcaaccattcggtagtaatgttatccacctttagttgaaaatatgacattcgtaaattggatacgcaaaccagctctttatctttccacatttctacttaataaaggtaatatcatgcagttctcacaattatttagtttaagtcaaacaatgtttcccgatcttcctatctgcatattgctcatgtcattattaatgtggttatggtctctgaagctcgcaggatacgataataagttgtcttgggcttcattggacaaatgatctacctggagcaatgatacaggtgaatttttttttagtttgattcttgctagcatagtttgcaatatacaactattctcagttgaatgaactggttatacttgatggcagtgtaggttgtcgttgaagcctgatggcctttttcttgcagcaattctcggtggagagactcttaagtgataacctagcaagctttaaaatattttgacatttaccatggcatcagcatatcctaattatcctttgacttgcccttttccggatgctataatcagggaactaagaatagcttgtacaattgctcaaatggagcgtgagggtggcatcagtccccgaatgtcacctttagcacaagtaagattcctgtgcgatctgaagtttgaccccaacaggatattattttgtgcttcgtacacctttttatggcatcagtttctcagaagcacattcctggcctttcgcttatgagataggacttgcaaccacttaacagctagattgcatcacattattgctttatcttgacatattggtgtttattcagtctgatggtgatattgggttgcacttttcaaggtccgtgatgcaggaaaccttttgacaagagcaggcttcacccttccaggagttgacgttgaccgttacactgtgaaatacaatagtggtttgtaaacaaaacttaccttttctaatcagtggtatattttcaaggaaaaatcaggtacatgccacttcagagcatttctaaatcatattcagagtggcacgtacctaacttttcctattagaattaatgattgggtatacttctttttcctggaataatgattggtagtactatatctgaaaagttcttttatattgatgaaaattctgtcattgtgttgaacatttaaacatctccatgtgttgcttatctctcttgaatcctgaattcctgatattactgcttctatcgactagctttggaacttgttgaacatcttagagcgatgggggaaacaaatgctctctttcaaagaaatcctgtgagtatattatagtacttgtcaaataaataggtcaaattctaattcatag

SEQ ID NO: 60311 - DNA, 1640 bp, Oryza sativa
cttcatctttagtctaaccttctgccagtgtgtctcaaagcactacttacctgtgacgttatagggcacaactttctgttgtcaacggctcaatgatgttgatcatagcaagtttagagaataaattctgtaagtttgtcgttcagtttccagaggtatgctggtttgatgtaactctcgcaatcagaattcatgatcgaatgataatatttctagcaccatttgcctgcttcatttatcaaatgtcggattcttctatgttttccctgttttctgggaacaatttgaaacaaagccattccagcattattatagatcacttggtgccaactgggttttgttctgtacctgctcaggcaaatggatggccatcggcaagggttcactcgcaagatgtaccatagccttctgaatcattccgttttccatcgacttgatgcagaaccacacaagcaccaccaaagcaactcttctttttctcctttggatccagctcagtttctcatgctccaggagagcagggctccaaattaaataaggaaaaaatcacaatccaactgttgaaaacctcacaaaaactcttaatttcaggtactgctatgaggggaaaatttctataaatccagtcatgttcttcaatcttacatggtgattatatcctacctgataacacattgttacaagctaaaactctacgtatgggcttttgcagcagcctgaaattgcaggagaagataggaggttgcaacctctgaactctggtccatcttctcagaattccaaggcaccttccaactacttaagctacctgcctggcttgctgacacgcgccttgcgaacggcttcttggatctgcctctcgtgctccttgagcatgtcctcaacgttccctcctggcggcatcaatggccctgagtggtggatccttctgtacttcctcccatggttctgatcacaacggcaaatgcacaagaaatgtgagataaaacaaaatcatggtatacaatctttttatcctcgtgcagaattgcaggatttcatcagtatttgctctagcagcagcaaagctatgcttaccatgccgtccttgacttctgggttcttgttctcatcatgcctgtctggtgagtcgttatgatcagtagcttcaacagtgctcctcaaatcggtcgcaccaaactgtggtatgagcgagtgtgatgaccccttcttccttatgccacaaggattcgcgacgcgcactgagcagcaagcgcggccaggtactgttggctggtcattgtcgccctccatgttgttccatgtggaactgtacccagggagctgcaccgcagttggacgttcccgtggttccaccctaaaccctggaacactgtcctcttggttgaacacctcgctgttgctctttgagctggtgtgtgtttgttgctgcatgtcaggcagagttggtgagatgaacttttgaaaaatataaatgttttgaaatttgttaaagaaaactgaagcattgagtttgcaaaaagatgtttagaaccatagaacaaacatggcgcggtgaaaaataccataaagcaaccaaatgttctgatatttatgtttaaaatgatcgagtaaattgaaacttgggcagtaatttggat

SEQ ID NO: 60312 - DNA, 8634 bp, Oryza sativa
ccataagcacataagatgccttcttgaatgagtggatcaaattgagaccaattttgacagatcactttccagatatctgcccttgacaagaaaacatcattgagtacgcttgataaacctctgatgacctgatcatactcttacaaaacaacacatttttccatgtggctgttcatttttcaggtaatttggaaacaattcacatgttcaccaaattttaggacaaaaaaatacaatcgtatcaaatagaaaactcaagtaagatttatggagaagtgaatcatagaaataattaaaatgaacataaggcaacaaggttggtgcacaattaatttctttcttcccatcaaactaacccaaaaaaactgtaaaaatgagaaaagtaactaaagaacactatttggttaaaagactcaccttggggaggaggcatgagtacgcaaatttcagcttggtgtgaaggcacattccaaaagcaagaacaaagaatctagtattaatctgtttttccctttcgagaaaacattatgggttccacccatttcaggtaggaacaagtgtgacaaatagtaagaaaaactgaacttggatttacaacagagagatttcacattgagagtttgattaagttacttctctccctctttctctctcgttcctaacaaaacacataaaaaatggaaaaattctcaaaagcaaaacagcataccattagaggtaactaataatagagtatgaaatgaatgcatgaagtgaatgaatggatgggagaacttgaagaggaatggctcgaataatttaccgacaactaaatatagttaacactttggttttcttaaaatagtacatgactatgcctttatactcttttgtagatagaataacttgtaaccttatgtttacatcaattaacgagtttgtaaattaaaatagatgaatgttgctacagatagagagatgcataaggaactctctacatttctagcataagaaagacgataacaaagatgaattgataacacaatgataatcatatcaacttcaataattactaaaataaagctcatagtttattattaattttgctaaagcaaattgatggtgagagaataatccaacagtatcatttactgttcaaaatttacatacaatagcaaagattaatacttagttatcagcctagtgactaatgacaggttagacgaaagcaaagtaacaaatttcttgttaaaaatatggatgacaactcgaatgcaactaacagtaaatgttagacccttcttacattaataattaattaagcaaatgggaattcttgaagtcagagtggcagatcgtaactaactttagcatgccattgatatttaatcttttcttgaaaaacgaataccaagcttaccttttcagacaatagaaaaggagtatcagtcatttcaacaaatcaaatgtggcgttatatacagatttactgctgttagcaattcaaagagggagttgataaattaaacagagtagctttcagatcagcaaaccgatgtgcttcagaagtcctgtctgcagcagtgagaagccgtataatgcagtcaaaattatgttcagacgcttccagattgtattcttgcaccatggagttgaaaatctgaagagcttcatcatgcaaccctgccgcttcacagattctcagcaacacatcaaaggtgccattatttggaacaaacctgtttgacagcatccaagcaaagagttccagtgcctccttgtgtctctggttgattgcgtaagcttctattatggcagtgcaagtaagggatcccttggactcaatccggttgaaaacccgttgcgctgccttgaggtctccacatgtgccatacatgctaactagccctgctgcaactagggggagaggttccatccgcaactttaacgcttgaccatgcaattccttgccaagttttgatgccccaatgtcacggcaggcactcaacatcctgctgattgcaacagcatcaggccggcggtttgagagcagcattgatctgaacacatcaacagcagttgaaggatcaccattctttaggtacgcatcgaccaatgctgtccaagcttgtacagtcttcttgtccatgacatggaacacccgttgagagtaatccgagtgactgcacgtaccatacatagtgatcagtgaagtgcacaaggaaatatttggcaggaaccacctccgcaaggcatatgcgtgaagctctttcccttccctcaatgctttcaacttcgtacatactgggagcacagtccccacggctataaaatccggtctgattccttcttgttgcatccaaagtatgcacctcagcgcctggtcaggccttccattggatgcatagccagacatcagtgccgtccatgagacaacattcctcttcttagcgctatagaacacccgtctcccagagaccatatcgccacacttgcagtacatatctaccaaccctgcctgaatgtttccaacatccttacgatgttggaacttcttcaacacaaaaccatggatctccctacccaagttccaggcacgcaactcgccgatgacaggcacaactgacgtaagcaccacagagttcaccttgatcccatcctccaccatccaccggaaatgctccagcgcctccctcttcatccccttatgcgcaaacccggcaatcactgcaccccacgcaaccacatccctctctggcatttcctcgaacaccataaccgcaggcttcaccttcccgcacttgaagtacacgtccatgagccccgtcatgagcatcctgggagcgcccgcgtaggcgttcttgatcagcatcgcgtgcgtggcggtggccatggccatggacggcgcggcgctcccggagatggacttgaggacgcagccatacgtgtactcgttggcgtcggcgcccgcggcgcgcatctctgcgaacccatccacgacggcggcgcccgcctggccgcgtccccggcgcacgtgcccgtggaggagcgcgttccacgagaaggagctcgcccggggcaacccgtcgagcaccttgcgcgcgtcctcccgggcgccgagcgcgaggtagagctcgacgagcctggcgagcaggaactcgttggagtcgaggccgtggacgcggaggtgcgcgtggacctggcgcgcgtgggcgagcgaccgggcacgcggtgagcagcgcggcgaaggccgaggccgtggcggggacaccgcggtgggagaggtggtcgaggagggcgagcgcggaggggagcctcccgacgcgcgccagcctccggagctccgcggacagcgcgggcgcgttcttggagtccggccggagctccgcctgcgacgacgaagcgccccgcgcggccgcggcggcgccggcgtggagcgcgcgggagaggggcgtcgcgcgggtgaggggcttggggcaggagagcggcttggaggggaggagggggtggtttgcggcggcgagggaggaggacgccatcgccatggatggtggggcggaggttttcgggagggaaggagaaggggttaacggttgggaaggatggtggttgttgacgacagactaaagagatttttattagtttactttttcaatttctttgcattttctagagagtttgtttttgaatttcttgtgcatttttacgaataacattttaaattatgacaaagaaaaactccctagctataaagtcagctaatgctcccttagtagcatccattttgatgaaagaaaaatgtgttctctgcccaaacaacctaaaccgtaagaggccacgtgtctatccttacctatgagtatattgtatacactaattttgtattgagtcattgggatgagagattggggctgaacttggatggatgatagcattgaggttgcgaggataacggagaacgatagtaggtagagagtaactgtcagggttatggataccacatacctaatagtagttgactaaatctcggcaggacccactacataccatgtcttatacggaaacaaccttcggatataggaggagttccgcataaggaaggatgaatagagttctacatggaaacgacaaggactactcggattgtatcaatattggttttcctagttctacttggacaaggggatacctatgggtataaatacaatagatcaagacacaagatcaatatacaagccaacatgcgctaagacaagacgccggatatcgacttcagagataagcatggctagtcccctatggtgtctacggatactgtcaggagagacatagcgctgtctttgatcttgccggatgcggattcgaggaggaaggctaccatgttgtcgactacgagtcaacacttcagaccgccaagtcgacaacagttagattggctaccccaaatattgtactggtgtgattatggtgaataagagcaatgaccggcttcggccaacaggagtagggttattacctaacaattcaggggcccgaacctgtataaaaatcctcgtccccatatcttttattacaatctcgcatatatcctagtaccaacgatccccatactgtataaataccgtagtcgtgacatcaaacgtagtcgatgattgggaggaagttcacgcactggctagccaaaaagcgtgcggcaaacacacgaacgtgtccatcgcggctccttaagccatggcttcgcttgctaggttcgagggctggctaaagcactcacaccttacaaaagacacacatgtcttgctcaagccacccatacaaactgagttaaaaacatagctcctatgtgatgtggtgttgtgacttgtgaatggtcttattttacaatcaatttttgtcttatgatctttttttttgtcttatgatttttttttgctgcctataccatacaagactaagtgagaggatagttaggaatagggtaagttttggtaaaaattaaataggataatcatgtgggaaaatagtattaaaaacccaaatatttatgaaaaaaaaataaaattgggatggaggtagttgaagcttactccaaaacacttgtgctctctattgcaatgggtagatcaaagggaactatgattaattttgcaccaaggttttgggcaggtcagaataaaatttggaatacgtgtgttcgatccctgcatctgtcctcccctttgcgtcaatctcagccgtccaagatactagtttcgatcgaacggctttccgcgcttcttcctcctccgccgccgcaccttctcccaccaccgtcctccgccgcgaagccacccccccacctcacgcggctacggcgagccgagacccgaagaggcccgagtaggcggcgccgcctcgaccgggaggtggtggatcgaggtttgcgctcgccgacgacccccacccgatcgccccgccgcgatgcccgccctgcgaaggtaagtagagaaatgcagtaggatgcaacgcaaatgcggctcgcttgttctcaggctctcagctttgcttatctcttagacagtgcacacttttatcttctgagctttgctagagcaggcatggtttggtttgcttgttcttgctgaatgtcacggttggaccgaaggagtgcatgaaacttcgatttggatgtcgccagtgatacatataggttggtttcttaccgatgtagactttatattatacatctcatgtagcggtatggttggaacatagggaaaaaaatagcccctcatagtagaatctgttgaggaaaaaaaaaagtacccctcatattacaatctcaaggaattttactgtacttgaaaaagtaccttaaggtacctaaattttacattaaaatttttggtacctagagatattaaattttacactagaaaatatgatactttctcaagcatgataaaattaccctacaatcttatacagacaatgcactaagatttggttgtgtagtgcgcgggtctgtaaatactgacatgtaatgttggaaatgccggttttataagctaatactagcatttttgtaattgcttacatggcggaggcagaaccagatattttggtgagggaacacttcagaatgaggaattctgaacctattaattctttggatgtttctcatctaaatactagttaacttcctagatctcatcacagaaatgtgatggcttagacaggacggtatagaaaattaacaatatcgaccaacaattttcttgtaatatattttgagaaaaaaaatctaacgatatttatgctacgaaaaatctttcccaacacttatacatacatatttcatatggattgtccaaaagttcattaaaatcagaataattttgttgctagctagcatgccactttttcaccagagggattgatctgcaatctgcaccataaaaatacaggaggtagtacaagtgggctttctattttcttacaagattataggaaagcgggaagtcagacaagtagggagcacttccctttgagtggaaaaattgagccacatatatacaaatttgcagtcagaagacttagcaacaaagtactgcaagtaggcgtagttaaatcaaatgagtgctgtgctgtccacatccatagtctggacataactaatggcattgactggttcccaactatgaaatttcttcagagatactccatctagtccagtcaccctcaagacaattaacaaagctgcagactgaagatgccattgttacaggtactagaactgtgcctcctatttagatgcacaagatttgggatcctgatgcatatgagcctgtgatatagttacattgacatgtgcatggagaggatttttttcctttgtgtgcttctacagtagccatcttcatcttgaatctctctttgtgttgcttcttctcttgcaaatttttacgtgcatctccatatgctgtaatatactaatctctccatagagatctttctctatagcttctgttatggcactagtgtttgctggaaaggcagtggcaactgcagccatctccttctggatcaacaaggctttcacctacctgaaagagtacaaggttgaaggcatcgaagatattaagaacaggctactgcagtcgatgccgaagatccaggtcgttctcgatattgtcaatcccaggtatgtaaaggaacagagcagtgcactagatgcatggttatggcagctcaggcacgcagttgaggaggctgaggacgtgatcgatgtgctcgagtactacaaactcaaagaaatggcaaaggaccacaaggttagtgtctggggttcctctttctctaaggtgaagcacaaagttattaagtctgttaaacatgtcagtattttggacaagaatttgaaacaatttactcaccggggcactctcaagaggttgagggaagctgtggagggtttagacaaggttgcttcagatattatgagcattctcacagtcacagaacatctcaaagaggttgcttcgtgtagtcagcagcaggagtattcaacgaacgatgatcgtgcgacaggtttgacattaactccacctaaatttgttggacgagaaaaggagaaagaaaagatagttagatggctgacaaaggcatcaactgacgcttctggaaatttgatgagcactaaccatattcctattctgtcgttaattggtcacggtggcatggggaagactacgttggctcaacgtgtttgtgaagaaatggttaggaagaatttcaaggttatatgggtgtgtgtatctgatcgctttgatgtaacatctgtgacaagtaaaatactagaatctgctacgggggcaaaacctaatgctaattgtttggagacactacagcaaagcctaatacacaaactgaagtattctactgattttttgcttgttttagatgatgtgtgggaagataagaaaatagataaatgggaaaagttgtttgctcctctaaggacagggaagagtgggagcaaaattttgttaacaacacggatgcagtcagtagctgttttggccacagaagccatgggaattgaaacagagttcttgtcaatagaaggactagaagaaggtgaaaatcttgagctcttcagtcattctgtattttctggtcagaatccacaagattttccaaatttgaaatcagtcggcaaacaaattgtgaagaaactaggaggatgtcccctggtaacaaaggttgtcggtggccatttgcggagcaatatgagttttcaacactggaacaatttcttgcaagaaggtttgcaacattttaaaggaagtgaagatgatattatggaagtcctcagactaagctactactgtctaccaaccgaccttcagatttgctttcgatactgtagtatattcccgcaagattatgcatttaaaatgaaagacctagtgctgatgtggataggttcaggactgatctcagaagctggaaataaaccaccaaaaaggcttgaggacattggagaacagatcttggctcaattagctgggaaatcattctttgaaaccaatatcaaagtagatccgtatagtcaaaggaaagaaaattattacataatgcatgacttaatgcatgaattggcaaggtatgtat

SEQ ID NO: 60313 - DNA, 709 bp, Oryza sativa
tcctgcagcccactcactcttcctccgtagggtttaacttgctgtcagtattctatttacttacccaatagagtgtggaccacgataaattcttattccaaattttgaattcaaaattttgacctccacgcggtaatgcacggtaagccgtttcgttcaattagatagtatctataagaccaaagcatgcatgtattgttttatttatcaaatgttttgtgttcaatatttgcataccttgttgtttgtatgatatattcagatatgacaattaatattgggagcttcctgtgtaattgaactttgcattctggcatgcaaaggcattgatttagggtatttcagtcaattttatttcagacattactagtattgtattaatcagaattattagaactatttagattggctgtataaaaccatatgtatgattcagatgaaacatggatggcgtctttgggggattttgtccagcgtctgaactttgaagggagttgtattggtgcattgttactttgttacgccagtttatcccttttttgggggaatgcaagaactctgtcagaaattcagaatactgtttagcctagtttagttcaggttagcagaattggctttgaaaatggtttattaattcaaagtttggaatccggttttttttattaattccccaatttatattggttgggtatattcactttctaatatt

SEQ ID NO: 60314 - DNA, 902 bp, Oryza sativa
cttaatacaaaacttacatcgaccttcgatacttgttgacctgcatgttcagtttttcctaactggacaccaaaaaccaatctattctggaactttcatgtctagggacagttttcaagctgcacattttagagaatctaacaaagcgaatgctaaatctggtgtgcatgacaacacaaactattgcagaatagtggtcatgtattaacatttgagaccttatatttctcatttgttgaccatgacaaagaaattcaagcagaagatatcattcagatttcagaagtactagagtaagatgtaaagaaacaaaaaaggtcggggcaagacaaatagcttggtactatgcatttgcattaaagaccatacatatataccgcatagacatgctgcatcaggcaaattaaaggaggcttaactgacagtttgacatggtcaatgataaatggagttagttaaccaccagtaaagactaagaaatatacattgtgttaacattgagtgaactacaaccagagcaatcaatcagcagcaagaaaataacagcattaagggggaagggggaagaaaaatagatgggaacagtaaattttccgactgcactgtgatttgtgaagggaaagaactgtagcggtggaactgtagaagtggcacccggccagccgcccagccgtcgatgcgacgatgcgcacatcagctagtgtttacagatgtgcttagcaatatgtaactgcttttgtttgcttcatagatagcgtgcttatttttagcatcagtgcttagtatagcgcttaaccacatgtaagcaccgtgtctgtctaacagtaacccaccagtattaacaagggcactttatatttcatcacacacacacaaactacatatatatagtatactttctt

SEQ ID NO: 60315 - DNA, 1797 bp, Oryza sativa
atcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaagatatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgatgcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggttagggtcgtccatcagaaatttcactcagtggaatgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcaatacaagaaaattggtccgtccatggccgatgacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgt

SEQ ID NO: 60316 - DNA, 6491 bp, Oryza sativa
  unsure (1)..(6491): unsure at all n locations
ttcctgcagcccagatccatctaaggtaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattctatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaattcgcttagttcaacatttattacttatgttgaactaattatttatatgtttctgatcaacctatttgatgcaggtatggcgtacgacacaccggcgctgttgaaccgtgggattgacaggaaccaccgctcgttcctgtcggcagtcgagggtgcacagctcggcaccttccgtccacgcacgtcgcgcgagtggttgcgtgtcgacccccgtcacgttccttggtacgcgtatgttcacatttcaactcaactttgatttgtgttgtacttatgtttgaagtttgctctatacaggttgcgtgcggcaggccttctaccactttgtaggcttgttgaggcggcggcggacgaccgtgacccagcgaagcggtgggatgcagatcggtcactccttgccgctcttgtagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggtcgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggatttaggcaggtgtttccgggcaacgtgcagccgaccgtcctccctgccgaccactcgtgagttcggattgttcatttctaaatttttatgataattacttcatcgagccatataatttacctctcttaacaggttgactcgacggggacagctagcaggcgcactttgggctccacgtgtacagcagtacgttgacgactgggtgttagctacagaggaggtgatcaacgagctcttcccacacacggaggagaactaccgtgactacctttgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgtgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgtcataacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagctgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttaagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaaatatagagcacagtacaaaatcgcccttgcggagggcggcaagggggccgcctgcaaatatcgttgacggccgtcgcccgagagcgaacggccgtctgccacgtcattttcgccgccctctgggagggcgatttttaaaaatcgccttcccagagggcggtaggcgactacttccgtcaatttttaaaatggaaaattatttttgtaaaacttttaataaaaaaattaaaaataaaaaaaattccgggattcacttcccctcctcctcgccgatcacatcatcggatcatcatcatatcagcccacctcttctcgcctccataaatcgaggacacccacgctgccgctgccactgcacacgcacgcagcgagtcgcgacacgagaccgtaccgtggaaagaagagagcgaggcgaggacaccactccgctccgctccaccgccgggtcgccgcgccgcgcgcggcccgagctcgccgatcgagagccatgagcctcatcctttcccggcggcgcctcgccgccgccgtccggcggtcaggccccgccgcgctcgcctccaggtgatctgtctgaaaccccctcccctgatctgctcgcgtggagggttgtcgggaatgggcgtgcgtgcgtgcgtgcgtgcgtggatcgtgctgcggcggtttgggcgccgttggcgtttgggtgatctgatgcgagtttccggtcgagccgctcgttgcggcgctcgctttttccaccgttttttttgggagcgatccggcatcgtggttttggttgcgggcnnnnnnnnnnnnnnnnnnnnnnnntgggtgattgattggcaggtggatgcacacgccgccattcgcgacggtgtctcctcaggaaatttcaggttcgagcccggcggaagtgcagaattttggtaagagagctcccatttggggttctgcttattgtttttgtacacattgaatctggagggatattattagttagtgcttgtgatgttgcaaaaccaattcataggaatgctgtggcagtgcacaaactagttcatatggttatggtgggaagtaattttacttgagaagagtttgacattgtgtcttatttgaacgataaaatgccatgcctattatattttgaagaggaaatacgtgtttggtaattctcatactttccacaggttatgttatgactgcttatgcagttttgccgcacattactgttgatttttcaaagcaatgacatgtgcttgatctctttgcttcataaacattcagttctaacttctactgagctaataagagttaaggtgtagtttatttccgaatggttgttccagtcaaacatgtcactgtcatgtagcctttcacctatatggaagaaagaagttattttggcatggacgtagagatgcttgataaataaagttctgatcagactgctgatagggttaagttcagtgcagggcagttggacaacatctggtaactggaattggctagttgatcctttaaatggtgaaaaatttatcaaagttgctgaggttcaggaagcagaaataaaggtacgttagttactttcagatgtttcttttattatttccgtgttgcggtgatattaattgttattaaccttcctcagcttactccactaaaaaaacccacagattgatccgttaaagaaacaaactctcttacattaaaatgactgactacggttatatttagacttagttgatattactgtgaatctgttatctgctctgaagcgtatcctcaggcaacgtgcattttttttttccggtgcagccatttgtagagagtttatctaattgcccaaagcatggacttcacaacccacttaaagctccagagaggtcagtgtagttttcttgtactactaatgcattgcatggttttccaatgtttgacttttttcttttggctgtctgttgtgtttgaaccccaactttggatgcattacaaaaggcatctaacacaacagagtttattttacctgatagctaatccacttactggctcttctttctcattgataaatttttgcagctttatcaaactcctggtcactgaagtatttgtgctatgctacatgaatagttagctacagtatccttgttcttgcacagttgactccaactcccccgaaaagccaagctatacacataggggatttggtatcaaatggatgatttacccccctgtgtgtctatcacatgtgatcctagggt

SEQ ID NO: 60317 - DNA, 702 bp, Oryza sativa
tggatccgcccctgttaatgccgcgtctgctgctactggcacctttgcagaattgcaggcgtagtctggtcgtcgtggcggtgaggtgagggggtgacggcgatggccaacagcgagtacgagtacgtgaagagggagttcgagctcgacagcctcctcccgccctctaattggatcgttgtgcgcatcgacggctgccacttccaccggtacagttgctctcaccttccatccggtggctgtatcagttcattctctggtggtagtgcagtgtgcgatagtttatgcagacatggcaatttcagtttaaatctcctgctttttgcttgatgcaacatgtctgtttggtcttagactcttagggataaaaaaaaagaagctaaacctgctattatgcacaacgccttctgcttggttttctttgtgatgatcggtttatatgagaagcaggccacagtgtgtgtggatactagacaggggaaatcactgttgcttacaatttggaatagttgatctgtgtttgtcctgtccactaatttcagcattctctttgttagattctccaagatacatacctttgagaaaccaaatgatgagcgtgctttaagattgatgaacgcctgtgccacttctatgctcgaaaagttcccagacatagtcttcgcatatggcgtcagtgatgagtacagatacaacatcttc

SEQ ID NO: 60318 - DNA, 771 bp, Oryza sativa
cactctacttctaacaatcaagactaaggatgcttgcatcacgtaaagccaagactcctagcaatgctgctaaaattaaatacgacattttcttctaactaattgggcagatacaagcagataacaagccacactggaacatatgcttgattttttgggtgatcaatgaaattcagttgaataggaagaaatgacatatatagcaattgacaatcatgttatagatgttaccctctgttagtgtcgccaatcgtaatttgtgcaccgtatggaaacaatttgcggactgtcccttgcaaaagagttccttccctaaggtatgtcattgcctaatacaagtgataaacaaagataagcattgctgtactcatataagtataatttaatgcacagcagaaattgaattgaccaagaaccactactttaaataattagacagttctgataaatgatatgtcagtgaaaatataaaacaaaggggagcactagatgtcaatgcagtcaacttacccatgcttctttttcactaattatcaattcgttagctttttcatcaatccttgtgatgcagacatggatctgttgaccaacctgtgtagaagaaatattattattattattcatgaaagacaaccacttccttaaacagatagctgctaaaacagtcagtcatgctgctatgccataacaggaaagcagcataatgcagattccaagtgcctagggatgtaaagtgatattacatgtcatgctgtacttacagtattcttt

SEQ ID NO: 60319 - DNA, 6162 bp, Oryza sativa
ctgcagccctaaacagtcatataagagcattcagaagaagaaaaggacagccatcactctaaaaaacatttacgcgaaactttctcattcaagtgtgttagagatgcaaattccgtaagacaacaccatatccattgggtcactcaaataagatatcaagaaagaaaaattttcattgtacatattcatcacacaagcttcctctagattgctcagtattcatgtaacaccttgaatttctgaagtacatgagctctacagtgtaataacttacagccggtgcatagagattgtgccaactcgtagtgcagataggagccataagctcataatcatacgattccatactaataactcctatttaacacacgtgatttcagacacttacgatctggacatcctaggtgcttgttaatctaatagcaagatgaatcactacgctttaacatttcgagctttaagagcaagcagttactttaagggtctagttgctacaaacaaggtggtcatgactcatgagctccagacctaaccgtatcggcctcatcttttcgcttatgcttatgcttatcagctaaaatttgaattttcaaccttaaatttgaagctgattttagggttttttcatcaaagtttatttttcagcctttgcttttaggtcgctaagaacacgtatataaaaattttattcacaaattacttctcgtttgcaaatatgccgaataagccaaacaatggggccgatagaattacttagtactataactgttggtttgaagtatctgggactgggactgggactgggatagcatcatgtcaagactctgtctatagattagtaatgcatcaactatgaaaaagagattgaactaccgaattatcgctaagtgatcagttcatcaaattccaactaatgtagaaaggagagacatagagaacctgcctcactctgtgccacgcgacgcgccggaacagccggcgcgcggacagcagcggccgcccgccaagtgttcgaccgaggacctcggtgaacaccaccgtgccgacgcccaaagccggcgaacctctccctctcccctttccgttcctcccgcccgtcgcctctccttgcccctccccgccgctgaccacgactcccaccttcccttccgcggcgaactgggctgcatccttcgacgccacgtcgcatgccaggtactcaaactcctccccggtcataggcaccgcctccttggccagcatcagcgccggctcgccaccggcgccgacgtcgatgtcgagcgtcctcccgtcgccgccgaccacgacgccgaccgcgaggtccccgggcttggggtcgtaatacacgaccccacgcccacccgcaccagctccggcactcccctcccccttgtcctcctcgtcttcctccacatagcctccgccgccgcagccgccggctcccgccggcgcgtcgtcctcgtcgggctcggtgctcttcccctggaagaacttgaggaacggcgcgagcgcctcctccgtggacagtgccggagcggcctcggtcgactcagactcatcctcatcggcgggggatggggaagggaacggcttctcgaggaggtgcagttcatcacctcctccgccttcgccgccaccggaggaggaggaggaggaggcgtggagcggcgacgcagctcgtgctccgcggacggggaggcggctcgcggtggggggtctccgccgcgccgctcggcggcttcgcggggagacggaggcggcggggaggagggagaggagggacgggggcggcatggcgtgcgagcgggtgggggagtggagtggagtggagtgggtgggtaggaaagccgttatctcctcgcggcgcggccaccgtgaacaggagggatatttcctattttgggtcttctcgcggaagcaggcctggatttttatgcgggaaatcgggccagagtaaagctgcagcgacggttcggcccgatactttcagcccgttttaatactttcatccgtccttataagtccagatataacatatcatattacaatgaatctagataggctctctacgcagattcattatactaagatgtgtaacatccaaccaaaaatttagagacaaatggagtactattttatttaatgttactatactggtcttagggatgatgtatatggaaaagagttgaggcataccaagagaaatattcaaggctaatatatgaatatgaatcttattaacaataaaaaccgtgttttttaaagaaaatagatagatatgaactttgatgtggagttttcaacttggtagaagtttgatttttttttctttaaaaaaatccatttgtgtatcacatcaggctagtaaattgcagtttgaaaccataaatacaatgaagtattatatttaagataacattaaatcgcactctatgcctaatcgttttacccttttcaccaaactactatgcaaataattttgcccgtgttttacccctttttttattgcatggaacaaatttcagtagggattatctgcagtactgcacatgcagtagctggctaactgccgctgacatataggatcgggtccacctgtcaaccactacgggcctgttcggcttaactcatgcggctgcggacctgcggtgcagccggccgaaacagtgatttgtgtaagcagctgcagcagcaacactgtgttataacgactactactgtgtaagtacagtactgcaaagtatccttgttaaacaaattttgagttttacttatagcaaaaccactgacatatgggcccgatgcagtcaggcaggacgagccagtcgagcccgagcagcccaagcccaagcccaaggcgccgtcgcggccagcacaacaccaaacaacggggcacgcacgcctttggcagcagggagcggcggcagaggaaggggggaagggagcaagcaaggcaagggattccgcctcgcgagaacgatggggttcatgctgcgggtgaggctggcctccttcttcgccggcgccgccgccgccggggccgccggcggcttcttcctctacaaggactacaagctcgcccacgactccatggccctccaggtctgtgcgccccctcctccctaaaacccaagatcttggatccttgatcgtcggtggtttatctggcagttcaatcgcgtcccccgcacgtcgcctgtggagagggagatttagggatacccgcttttcaagcttgcaactccggatatacgctatgcgtgtctagatcgttacctagatttttatttttatgtgtttaccaatttaatcttcgtgtctatatcatatgattgtgctgcattctcttcagtttgaccgaaaggggatttgacgctgttgttctgtcctgaaattgggctgccaataacatgcatggattaaaaaccaagcctgaacttttcctctgcccaattattttctgataatgtggagtgtctgtggtgataccgtgatagaggctactgttccatggtcctgccactttcaatttaactatcacttgtgttcaattgtataatttaactagcaacgcagttccaaagtttggcttggttgacagttccagtaccacttcatgtggaatctgagcttgccaaattgaaggttcgtgtggcagtttaattatttttagcttgtggtcatcttggtgggctctcgcgtacaatgtacattgtccacagaagcaactagcttttcaaaacgcctaaggatgagaagccacaacctgatattctgaaatactgttgcttgaatatgtttttctagacaatgccataacaccattctttatgagatttctattcactttgaatctgaaaacaatgtgtttgccattccttgcgtgcacagaaaatgctttgtgttcaagaatgtggaaaaagagagtgaattttaggatgccatttaatattaatattatggcgtggttggagttgaattgaacccagtatcctacatattatattatcatagacataggcattcattagtgcaacgtctgtgcatttaagttgcacaggaacgtcatcttgcaacataaaatttgcagctataaatggcttttcttcagagtattttaacttgaaactggtgcattcctgtcatcagcaagaaccttggtgctgttaccaataacttgtttccaatttgaaattttgttggaacttcagtgagaaatgactcttttgtgagaaaggtgaaatgatatgtatatgccaacagtgctatggaagaactttaggatagtccatatgcctgattaacctagagtcctagattagtatgcaatggtgggataacctcatgtaaaagtagaatcacgtcacgtggatgaaagctggaagctgttttgtaagatgcaatatatgtgactctgtagtttgtcagaagaggttccttaaaatgggtggatggtctacttgtgttacctccaatcaatataaccatccaggtccagctatggcatagctaaggaggctattcatatgagaagttaacttttcatatttttcttgggtccttcaaacaggccacttgtttgagctgtaagattgaggtttctatgattctctatatgtggttctaatcctgctccctttgcacaaaatttatgtgcatgttcaattccactgtgcatgatactggttgggtttcaatgtaaaagcatctgacctttcaaatgcatactcaggtcaaaggcctacaagaccatgtggatgcccgttacaaagctcttgacaaacgacttgctacattggaagaccagaaaaccagcgagactgctccagacgtgggcgtgccatctgattagtctgttcattggctggcttgagtatggatgatttacgactgtttactttaacctgtgttatcgtctcttggaggcaaaagccgatgactgactgcaaaataatttagtgaagagttttttttttgtgtgtggcaatgaagcttctgtagtgttatagatgcccatggggatacccaaccttgcaaaaccatttcacttttgatggcactgaaccttggcagtcaagctcgatcattaccaatgtacctgtgtgaaagtttctttaccctgtttgctgccaggaacttggatgttttaagatgcctgctgttattctttttcaaaactttccgtgatgcatgtgcattttatggccaggcaaaatggtagatcttggaatgaatctgatactgacaaattggccatctattgtggaaaacaatcacttaaatacataaatggataaagtatcacagatgaacattgcaaagagacttgccgtccttgttctggcaggaaagtatcaccgatgctagcttctttgcggccatggagaaccatgctgcacaatggctagctgatgactcatcgtcgtcaccagttcgtcatcactggcatagtggcatgggaattcaggattgttgcgtgtgctactgtattctctatatatgctcgtcctacttctactgaattatactgatttctgaacaattaactgtccctttctgtctactaacttcttttgagttctgggttgagacgctaattggtgctgctagagctggttgttttcttgacagatgattcgtgcaaggaatccccttcaagcagattcttccttgcccagtactgagaattaatggtagatgaaaattcttctagtgatccggtgaacttcagggtactgtactagtactgtaacttcatcatattcataggtgccaacaaatctccagcattttcaatctgttctgttcttgcaaatctgccaaacaacagacggaaactaattacggcatcaaagctccaaccatttcagtatccccaaccgtgttctttccgataatgcggttctcatattcaacctgttaagctgcaagtgcatgcacgattacctgaaaaatgcccatagagttatcagaatgagacggtggtaatgcgactgcttcaaaacaattggcaatgaaataatgattgggggaatatgctgcttgcaactgcttgcgagtctgatcagatatgatggatttggtaggtgtgaggagagaaatgagcatatagttcagatttgtgatcaacacaataaacaaagttgtttacaggaaagctgg

SEQ ID NO: 60320 - DNA, 3470 bp, Oryza sativa
aaattgtaagaagcaaactctttcatggtgtccactgaccactatggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagatatccaaagatagatagaacttgagagattaattttaatgcctctgagatccatgacactggagaaaacaatccatgtgctctcctttgatgcaaatgatggacgttacgcagacaccagcaaacaacaccactgaccatatgcatgctaatgtgcaagcaaattccacaaacagtaagacacaatattagcactcgtcaataattgaaccggaaaaggataaaaataaaccagaactaattaagctcactttgacttcagcaaaaggatcggagccatcagaaaaatttctttgcctgcagtctacaaaacctttctaacattgcaggatcagatgaatacaaatgcatcttcagatccctgggtaacaatttactagtacggttttgtgcatgttagatgcaacccatcattaaacagtattaatacgatcaaataagtgagctatcacccaaacaatttctatggcaatgaaaaggacagtacagtaacacaatccaaattgtacctttctgctaatccactaggcaacaaacattgtttgtactcaacattttccaggaccatattaacctcgctgaagtaacaggtgaaggatccaagtccacataaatatgagcccaaatattcagacgctgacaggaacaggaacactcacaaaacataaaactttgatctcgctgcaaggagatgatatgccaactacacattataataaaagacactgaagtgactgtctgattcattgattccactgaataatacggagtacacgataagtatttacaggaatgatacgaggtagcgtatcaatgcacattaatcccgatcaattggtctcatctgctgtggttttcttgtccagcgatgctcatctcggagcagctagcgaaaatgctccattgtttggatcgtttagaaatccttccaaagcagacatcgatcaaggagacccaaacagcagtacggcacctttcagcagggcatccggcaggacatctctgggagcgacagatgatgacgacgagtcgacgatgcgcttgcaagccaaacagaaaatatggtcacatatttgattggcaattgcaaaggaactcccatagatcataaaagaatacatatcttaggcacgttcttttgaaggaatgaagaattgattaatacaacacgcttctcaagttgctaaatgatatgattataaaataaatcttaaatgactatttaaatcgattctttcaattttataataattaatctattcatttctactctcgaacagtgattacaatatcattctactatttgggaaaaaaatgcatgtgcgcaatcaaagtacttcatctatttcaggtgataaagtgatttaattttagttaaagttaaactactttaagtttgactaattctgtagaaaaaagtagagtagtaacaaatcatatgaatacattatactagacactttattgtttaaaatatatgttttaggtatatgaaaataatatagtcaagtctatcttaatgaacattacataatagtacaattgtaaagtcttttgacatttataaaagagaatttgttggtgttatgttgacttttttttgggaacattactcccgcaaaataatatttagaaaaatgtacttcgtgcagtttttaggggacttagtaattaattaaaatatttagtactaataaccttcaattatatagcacattgcatttaggcggcggcccagtcagttgcccacccgctcaagaagccagcgaaaatggcgtcctcttcctcctccgcctcgtcgccgctcctacctcgccgaggccaccagctccaggagccagccatggccgcgtcccagatgcggtgcgggggcaggagggagaaccaggtaccagttcttggccggggtggagttgggttcccttgcatttttgctcgcgttcttggatcaaatcggttattattgctgttcttgttgttgctgctgtctgattctgaaaattctctcgtctgctccgggtggtggtggagaaggggcttgtgcagaggtgcgccgagacgatgatgctgtgctgcggcgtggattgctggtgcggcgcgctgcggctgtggcgcagggtggtgcttcgcaagtggctcaacgtcggctccgggtcgggcgactccgacttcagcgccgacgagtgcgacgccagcgacggcgagctcgacggcgaaggttaacctgcctcaccgagtcaccgtcccctctcctcttccttcctagctgctctgatttgatccagtttactcaagctttgctcttgtctggaggaaaaatggggggagaatttggtgtgcgaatttgtgttgttttgattgctaggcaatgaggggaatgctgaccagcatactgcaatggaagctctttcttgtacgcctttgtgatttgactctccttttttttttcagaagattaaaaaataatcccattcaaagaattggttagtttttttttctttagaactaggagatgtcatgtttaattttgtgtgtaagttgatgatcttgcaattgcaagtgccggcaatttggtatggtcattaatatctctgagaaagacttccattgtgatgtgtagctaggctagtactctctgcataccagcggctttcttttggtatattcaacctttttaaggaaaggaatgttgtgtcagggagttcaaggatttggcgaaagcatgataccttttcaattcttttctaagcttgcttgagcaaaatgggtagcaaaaagtgaggataaagcaggcaacttttgcttaactcatagcctcgtttttttcttattgcttcaatgaatggtaatgtgaccatcttatctagttgactttactatctaatgacagctgctccctttgataaaagtcctgtaggtgttgtttttagttaacaacatgtccttatcaattgctcttcttgcacttaacttgcatatgttattgaatcatgcatattctgattgttctctttattatgccatttgtgcagacagggataatgaatcatatggtgaagggacgagtttagatggacttggtgcaggaacaattggtaatttcattattagctcctcatttttttttggagaggtctgctgaagatctgcacattcggttttttgataagtctatttctttctaca

SEQ ID NO: 60321 - DNA, 828 bp, Oryza sativa
gcgctcagtatattgacatcagagaactcaggtatagccgtatagaattttctccatctttgcatttttttttcctggtcctagttatgttcttccagttacagtgagtattgttcctatcatcttatgtcactatgtaattaattaatgtgatgtcagccactcatttcaccgtattcctatcacacaaatcatttcaggttaatgctacaattgaacccacttgttaccggctgaaataaataaaatatgatacttttgtatatgtttcaaactgttttctatatgcaggatttgtgtagggacatggaatcttgcaggcaagtttccacccagtgatctggacattcaagactggttggataaggaggagcaggctgatatttatgttcttgggtaaatcactattcacaatttttttccccctattttgtaaggtaaaagatttgtgccgcagattcgcatgaagcactccacttcttatctttgaaaactaaaaaaatgtttctggatcatgatttgaaattattttggcatcacagtttcttcaaaagagacagacattattttattatttagctatggtatggtggtggttctatttgtattcgtgtatgtcatgatgttggttggttgttctgttgtcagcactacaactgaagtatataaaaaatccattgtcataaatttatgtttatctttcagatttcaagaaattgttccattaaatgctggaaacatatttggttctgaggataacagtccaattgcagtatgggagcatattattcgtgaaactttgaataagatttgtccagataagccgca

SEQ ID NO: 60322 - DNA, 1999 bp, Oryza sativa
taggttcaaatatcaaagtgtctagaagaactgactggaactgatccttgcaaaacatatatagagaaaatggacatggagccattcaacactcatttttgcttgttaatttgttcatgtggttgcataactagatgaccatcattatggtttctccatgaagttaaatatatttttcctatgccgtccaggttacaacatcaagcatgatagagcacatgaaaaaccttctcaaaataccaggatcaaaggtcctgtttggtggtgaacctctggagaaccattctatcccagaaatatatggtgccttcaaaccaactgctgtatttgttcctctatcggaaatccttaaaagtggcaattttgagcttgtgacaagggagatctttggtcctttccaggtaagagatttttgatgcattgtcttgccacgattagatacaattttttatttaacggtaacctggcatagctatgacatgaattttgttaacctactgcatggttaaagaataggagtacttttctttaatatggtatggtctacttgtagttaatcagtgattttgtgcatatgcatgctagctttcaatagaattgataacaacctacaagtttcaattgtcattgtgatatagtactaacctattccaagttcatatgcgcaggtggttacagagtattctgatgatgagcttgaattagtattagaagcctgtgaaaggatgaacgctcatctgacggctgcagttgtttcaaacgaccctttattcctgcaggtaagttggttttcatctctgttgtgtgttgcacccatgcccattcacttggttgaataattctaccacggtaccaccaagctagttaggctaacatttgtcaagccatcttgtagcaatactcacgcagcttttgccaccaacaattgaacacttgaatccaatcggctcagtgacttatccaacacacactcatcggttttcaggaagtacttgggcgatcagttaacgggacaacatatgccggcatccgagcaaggacaactggtgctccacagaaccactggtgagctaagactagaaactggaacctgccatcttccttttttaaccaaaataggttaacatgtcattttattatttgtaattcaggtttgggcctgctggtgatccaagaggtgcagggatcggaactccagaagccattaaactcgtttggtcttgccacagggagatcatatatgacattggccccttgcctaagaaccgggcactaccttccgctacataaatactatgtcaaggctagattagcttgtagcatgttattctgaataatttgccccgtctgggcaatcatgtgtttcattaaccccgagagcataataaaaaggcaggaaatggttgtgaaatgtgttctgaataatggttgcctgtttgctagtgtccaaactttgctcgcgcttttttttgtccatccactaggcagtacttcgttaacatcaatgacttgtttggaacgtggagattatacatgaaatcagttgcatttgaacaaaaaaaatttaatcgagttcagactagctcgtaaacatctgagatcagatgaatgtgacgaacccagttgtcacaggagcattccctcatcactcaatatttggggtgagagaggctcgaactctcgacctcaggattactcacgtttagctatgagacctacgcgctagccaactgcgccaccaccccgtttttgttgcacgttctttattttcatatatttccggtgcttcttccgccttctgggcgaacactgtagctagtagaaattttaaggcaaattttgctcccagacactctaatttggtagcgatccaaacttcaatggctctaattggatcggcattcctgtccatgacacgaactctggtgagcccagacataatgagaactctgtccatggcgcgctcagactgcagatgagaccgtgagctgcaaaagac

SEQ ID NO: 60323 - DNA, 2400 bp, Oryza sativa
caagctggcccatactagaaacacagttgtgaatcataatatatgaggttcatttgatatatttcaggtaatggactatgaaaaggagttgaagataatggagaatcttactaaggaagagtatcttgcatctctaaggaggtaccatcaaagtctttagcatgttcaatctcctattctttttttacttttttttagagagaggttcagtctcctattctgttatcacctattcaactttgacaagcatctaaactgatgccaggaagagcagtggcttctcaagaggtgtgtccaagtacagaggggttgcgaggtatatttggacagaaaaatgtattgtactctatcaacagttctgaagataggtttgtcactgaatgtctactgcatactttcaggcatcatcaaaatggaagatgggaagcaagaattgggcgtgttttcggaaacaagtacctctacctaggaacctacagtgagtacaagaacagtgcttatactctattctacattgtgaattggtattccaatgcatccaaaacttcacatcttaacatcggcccatctgccattcttcctaaatctttttctccaggcactcaagaagaggctgcccgtgcatacgacatcgccgcgatcgagtacaaaggcgtaaacgccgtcacgaacttcgacctcagatcatacatcacatggctgaagccaacccctgctcatgttgccatgaaccctgcagaagctcttgcaatgcagatccctgtagatcacttcctcccaatggaaacccagatgatgatgctccctcagagcaatcctttcacctcatatcacaatgcacaatcactgggtggtggtgacggtggcagtagcagtactaataatcaagaagcctccatgataatctctcccagtggctcatctagaaagagatcatcatccactgctcttagccttcttctgaaatcgtcgatgttcaggcagctggttgagaagaattcagatgcaggtgaagaaaatggaggtgagatgagagagccgggtgcccatccaggagaaggatatgaataccacaacttcttccagggagatgctgctccggacatggacatgtgtgatctgctttcatcaggaaatgtgcatgctgcaagtggtagtgctggatttgaagaggacatcgcatgttatagtggttttggaagcatgcagtcgctgcagcaatagcatgttggtggctcaggatttgtatcttgtgtaaattgctaacactttgtgttcagctacaaatcaaccttccctttttcactgattacttttccatttgacatgtttacagacttgtgccgaacaacaaagcagaaagcttattttgctcactaacactttccaggcattgcattgaacaaaaaggagatagtgattatagtgatataatgataaacaaataacagaatagtgattatagtgatataatgataaacaaataacagaatggcatgtcgtgtgcttcaatgattactacgggctcagacctgtctaataacgaattagccaaataaatgcatcctgtgcacttataagcagcagatatatgccatcttatgatgaacaagatgaattcaaagtagcctagttagagaagaaatatggttttgaatcaaacagaagtatctgcagctggattcagagggtgaactttgaagtacgtgaccaatttcacccaagagttttgacactcagattccgggacatgttttcccatcaatatgcccgcaaatgaccaaaaagaaaccgagacagattgactggtaacagaaaccctcatgtagtctagaacaggctagaggcaaccaaagttaagccgattacaagttttgttcaatgagctgctgatatcaaaagctagcatcctaaaccaaaccagaaaaagcaggcgaccttcaaggcttgaggaccagggacagcccaaccttggagctcttgtcgatggccttggtatcaacctcagtggagatggtgacgagcgacttgggcctgaactcgtgctggatgagcgcactggccatgccaaagttgttgaagcgcgccttcacagtagtgagttcatccagggcatgctgtgtcccgaaggtgagagtgttctcgttgctcgagaagctgtgagccagctctgctccaacagcacttgttttgctcaccttgtggtagtaggaagcagcaaggctgtctcccttgttgttcctgaaatttgcaaatcactctgttactaccaaaatcaaagcatgctagaataacacatctattgcagtaacttgttgcaccaattccaaactagcatatagatgacacatgcaaagcaaactgcccaagaagtccccagaaactgctgccaaaatctaa

SEQ ID NO: 60324 - DNA, 13491 bp, Oryza sativa
  unsure (1)..(13491): unsure at all n locations
acctagacacataaatcatgagttatttgtgaagaaaaaacaattataaaccctaaatcacgactgattacatttacaccagtaacaaatcacacatagctgcagactctgtaacaaagaacacacccccaacctacctgaatccttactagtaggaaactaaaccaagcgggaaccacaaaccatcgcaatcacaaacctacacagatttgcttcagaaaataaatcaagccgtaattccaccgcaacttgctcccaactcctaaagcctaacccacacccacacccactgcccaccaaagtgctcctaccaacaaacacctactcgcagcaaaccaaaaaccaaaccaaaccagatactagtaaaagaacagaacaagataacttcacaagaacaccacccaaaaaaatgaaaggcgtcgtggggaggaactcacagctccgttcgcggcgtaggtggtgagcgtgaacttctggtccgtgtggtaatccctatacaggagatctgcaaatcccaccagaaaaaaaaaacaaccagcgtcagcaaacacccaagaaaccaagaaacaaccccaagcaaaagggcaacaaaatcacaaaaccccaaccacaaaaacaccccacaaaaagaaccagcaacgacgcagcatccccgaacctctagccttcttgccgatgtcggagtagagcccggggcccgcggggggagcagcggcggccatggcgagaggaggaggaggcggcggcggctgcggcgagaagcgaggagaggaaaaatgggagaaggggatttgatttgggggtgaagcggagtggaggagagagctggtatttatcggcgggcggacggcccagatctgcgctcgcggggctctcggctcgcctgcgccgtcggatgggcttatcctggccctttttcttggggaggaagaagatgccaaaaatgatttaatttgcttaatttaattgttgcgcagggtgaacttttgggactgttcactttgatgtaaaaaaaaccttaccaaattttagcaatatagttgtcaaattttgataacttgctaaaattttagtaggatttctataagtattaaaatatggtaacaaactaaatgcagccatttttttataactttattaaaatttggtaaggttgaaaatggtatcaaaattgatgtgagatgtgaggtgagggcgccgtgttcttggagagaagggttttgcgtgattggtgaatagcgacaggatttttgccttctttcttgagtaaaaagatggtgccatgttttatttttaccgccgtgaaattatttttaccgaggtttgaggccttgagcgggacaagatcagtactaatttatctgggcactagtaatcgtgcacgtgcaatacacgtttttcataaaatatatcatagggatacattgaaagtttggaaactatatctaccaaaaataatttattcaaccaacatttataaaatatatatcctgtgtaattgtaaaaaagatataaccaacataatcggtacttgtaattatgggtatgatctgtctgttttgtacgaattttgataggagggaacaaaatagaactgaagccagaggctatacaaagttacaaactaacaaaaaaacagctctctcttcgagagaactataccagccttttttctctgtagctggtccactgcttgatctcataaaaaagaatttgtcgacaattcgctgaattgaccatccctctttctcgaagtttctattgtttcgttccgtccaaattccccagcagaccagcaagaagagggtcctgagcccttttcttgcatcttttctgatgaagtcttgtgacaccaccattccaatacnnnnnnnnnnnnnnnnnnnnnnnnnnngaaacttcagttaagcacaggcttattcctgtccggatggcttgaaactaatctactcttcatgaacaaatgatgagatgtctcaaggtttgatgcatagaggacaaaactaattgtttggccagccttaagttataaacagcaacagtccataggcgattctaagctaggagacaagcaaaagattaatttgcacctcaaagtcaaaggggcctgacttccaaacaggttgcatcaaatctgatctgatcaataccttagaatcaaattgccatgtatgctggctttgccatgtagaattgtagatgcctaattctgaccatcgccatgagttcctttggtgagtgtcaccccttctagcaagcagcgtcaaatcccaaaatattccgttaagaaccccattgataggtcatgccaaacatcatctatccaatgttgtttcaaaaatgcatgaataatgattgccctgttgtttttaaactgcacgaaaagtgtagcattatatgcagttgtaacaatgttgagtgtttctaaaaacatggtttaccagtgattcggaattggcaaagtcctgacatgtaaacaaaatacaaaggacacgaaattaccagtgatttcacccattattaaattccttatgttaaatatactatctttttataagcaaatatgcatgttgaaatcactaaaatgcagatccagaccccaaattatactataatgttgacaggcaacaccacagcgaaataataaagcttcaattagaaatcaacaaatcaagaaaaaagagtcaatatggatcaaagatatagtaggagcagtacagtaccttgtcctggcacatgcatatggagcgttagatccccctatgccaatgatgtgtgtaaactacgggaaatggaatagatggcatagcatactacgcaccagatgacattcaccataatgatggcaatggtaagtttccttttataaggcactgctcaggccaacttaagcagttgtacctggatcatcattgtcttcagcaatgttattacaactaaaaaagaaagggtgtcagaaatcgaagtcattttatagataacccaggatgctaattaatgtagtctaatacagggttcaatatttctttttcggggtttatattggagggtgccgatataccgacattttggaaactttgaacaagatattaccaaattcacaaaaaaatgaaaataaattaaaatttcggccgaaataatatcatagggggggtccgataggaccaaaacttctgaaattttggaaatttcgttcccgaattttgaaccctggtctaatattggttatcttaacaaagttacttcagcattgcagaaagttaacacacatatatatatatcaataatgaagtaatcattccaagaccgaatcatcggtgccattgttcaaatatagagatggcgtacatagagtttatacagtacaaagtgattgccagatgatcaaaatccataaaacctggttgaaaatttatattagtatgtaggtgagtactcttggcagattgtttttttatcaaacatctattgatctaattaatcaaaaatatgaaatcccaagaacacttatccttcaatgccacgtataacctatagacataaaaaaaaattctcaaggcaccagtcaccactgctaataacataaaagcaatgtaatggaatgttcttaccagcaaatcattacattatagatgcatggcctgcagaaatgagcattaataacattgttacgggaaaaagaaatagcagcacaatcttgtataatcagtaacataccaaagtaatgagagagagaaaagaaaaaatatcgacataaaggagagacttacctgatttttctatattattgacgacaagatctgtagacaaatggtaactttagtttgtatgcttgtggaaatcagatactaaactgcaaaaagaagatttttttttggtagacaaacttaccttgcctgtattcatcagtgcattctagcgcttgcatcgtccgcaattgctggtgcagaggggttcggctgaccagggcggcatagtgggagatcccgacgatggcagggagagccggctgtgggctcggaggggatcgacaaccggcggctgggctgcggagggcatgagagcaggcagaggggatgcggcggatgcatcaactgcgggtggcggcggcggcacccatgccctccactgcatcggggtatcaccaagtgagtcccctcgcgatgcggcggcagcggctaccgtggaagtgaatggcgacctgcagcaaagccgacgatggctgggggatgcgcgcagtggttggaggatgcgtcatcgggaggaataggcggcagtgttgttatcgcgagaggatggcgcggcgccggggactgcgtgatgcagcgattgggtggcgccactgtggggtcagcgcgttcgctggtggggattcagcgattcatagctagccctgggcgttctgagccgttggatgagatggacgggtgagatgatatggggtgatttggcctgtagcattggaggggggcaactcctcctttctatattagtatagatatatacaagcaaaagatgcaggtttgtccaatacatgctgtaattacgaaattatgcagtgcaagaaaaatgaaactgtgcatgttatagttctaaacttctagagcatcgaattgggaaatgaaattgtaggccacaatattaggtgaatattcagttatgatctacaggttgggtactaaaagttttactgaggtttagttatggattgacaaaatagcccacaagatttagttatggaattcatgctctttcttctttttgaccactgctcatcgattcacaattaactaatatctccaagatgagtagataaatgctagcaagggtactacaaacctctaaccgaagctaccctttcaaagtattgaccgtctgcaattatgcctgtgagaaggaaatctgccattctctacaacgaattcagataggaaaatatatgcataacaatattggttacctccaattcttccatgtccatctgttccttacctcacatatttggaaaagctaatacaacaatttgttagtcatatacacaaaaatacccctatataggaaaatgttgtgtaatcaaaagttgttttgtgattcgagatgacgaacctttgattggccaagagcatttcgtgactgagcactcgcatcttgtatcccaaaactgaaaggattatgctgttgatgcgcctacttcttccagcttgcagcgccaaacccaaatctgttgggctttgcctgctgttgttgctgttcttggtgagggctccgtaattgcaactgcacggtaaattagaaacaggcatagcaaataaaaaactaacagcgaattcctctgtagcaatcggaattaaaaactggtggccaaacgatggcaaaccaaagctttgaatgaatttcatcataaatagtcattaaaacacatctatgtatttgaagtgaatacattttcagcaataaaagttgatttgtagagaaatacaaatttacagcaagaatcaatgctgtcaggcatggaagagaattgagttagatcacagtatcttattgacggaactaaattgaaggcaattttctgtcaaccactaatcacctgcgcaactgagttatttatatattacaatacaaaattatcaagtgccaacctgcagaaagacacgttaatgcgtcacacacctatgtctaactgcatatccatgaaaatcaaggaagtccagtagaaagctacttttacacactcacagagtgtgagtaaaaccaaaggcaaaggttattagtagaatacctcaagaaccactgatctgctcattttgaaagaaccactgatctgctcattttgaaagaaccacagactattaacttgaagcacatgaatcacagtaaggaagaactattgaccgagaggtcagttgcgttcacaggggaaaaaaatatgaaatcaacctataggagcataacctcatatatgtcacctggaaaaatggaatgttcaagccaatcaatcaagctagatccagaaaatgaaataactgaaaatatgcaccaggagcttaggagccttctttgctatttggttcctcctaattactgaagcctacatatgtcactgcattcacattggcatctgctaagatacgctacattctttgagtgtaagaaggatggctggcgatggcggcgcgcggcttggacgaccggccgtgatgacagctgggcagcgaagggcaggggtcggcggcggctacccgaccgaggaggtgcaggcagctagtggaaggccggtgggagagaagatcacgtggctgtggtgggagcggaggcgagatccagaggcatttgcggcggggcgacagcgagtctcgatctgtggcggcgcgacggcgaccgcacgaccccgccgaaactcctgctcccggacggcacggaggcgggggcccaggcggcggtagagggaggcactgactgcgtcggcgaagacgggagcggcggaagcagcgacaggagccgatgcggtagcagcggagggaggcacaacgcgaagtgggaatgaggcggcgatgatggtggcggcggcggcggatggggcctccctcggcgctggccgcggcagatggtaggatccgcggcggcagaaggggacctcggctccggcgaggatgcggcggcgcggcggcagtaatccggagcgagcgagcgagcgaggaggaggagcgccggccgcgacggatggtaggatccggcagcggcggaaggggacctcggctccggcggcggacggagaagaaggcggcttcggcgaggatgcagcggcgtggcggcagtacagaggagcgagcgaggacgccgaggaggaggaggagcgaagtctccgcgcgtgaatggagagtagtcttcgcggcagtactcaatcgtgcggtggagacctcttgcgcgcggatggacggtacagattaatccggatgattttacctataagattagagaggagcaactcctcctttttatattagtatagattagtattagtattagtatagatattaggaataagcaaggtaataattgatcacataatctggcatatttggttaattgatcgcaaactagtcatactaccaaaaaactttatacatgatgatcaataatggtatcagcacattttatatttcccttttattttatgttctgggaatcaaattaaggtcatcatgcactatggcgagacacacgacacgagagcatccatacaaaaactataaaaacaacgagagtcaacgtctgaacagcgacgatttttattcccaacttaccgtgcaagttgaaaagtttggttttaaaaatttctacaaacttttcgtaatcgagcggggccgcaaccaggccgtcattgagaaatgaggaattttgcttgcgtgacgagcccatggcatgccatccttgggcttgcgatagcgcggcccagccgccgccgtgacctgacgatggcttacctcgccgtcgaatcgcccatcagacggcgagcggccacacgccggtgtcgcgggacctggggacggacggtggtgaccgacatgtcttatgcgggactcgatttcgccttgaatccttggcctccttttgaacacaatgccggaattttctagagattttgtagaattttactcctatctcaaaatgtagtaacaatctaaaatcgaattaaagttatacaaatctgaacaaatatcccatgcaattcttgtgcaaattcatgaaactaagatgtgtctaatccaattctagattgttactatattttggcccttttgaacacaaggccggaattttgccgagatttcttagaattctacttcctccatcttaaaaatatagcaatctaaaattgaattaaacatttcatatagttatactaatctgaacaaaattcttgtacagattcatagtactagaatatgtctaatctgatcctagattgttatattttgagacgaaggtagtacataattttcacaggattcaggaacatgacatccatctcacattcacagtgcaggcaaaacaactggagcgctcgacatgaaaaggaggccaagaaaagcagtaaacaaacagggtgtcatggaatggcacaactcgctagtcagttataagaagaaaacgcagaagagatgtccaaatgggataagattgttcaatccaacaagttctctctaacatcagcagctctcttgctcaacaaaagcagggtgtctcggggaggcagggaaatcaaaagcaaaccggaaacgcttcagctatacatgaacatggcagaggaaaggacgcaaaaaccctatagaaataagtcaaatcgcaccagatacaaaccacaacaaagcagctggttcactgtcacggatggggagaacatcttttttacatcggaagcaaaacaattggatcaaactgcagacgccatcatcgtcgtcatccacccgaatgttgcgcaacccaacaggaggatttggtgctcgatcgatgaactcttcagcgtttccattcagctttggcaggtctttctgtagttttttaaaaaataagtggcctgagaaattgtgacaatggctatgcaatgctactacttggtatgtgaaaagaacatctcaaacatacatcgcataaatgtgataaacaaaacaggcaggttttcttgagcccacaagtatgaaatttaaaaatgtttaagaacatgggaaacatcaagctttccaatcagcaaaacaaactaagaattgaggtcactaaattcaacaggaatattgttaagtcacaaggacagctattattgtgaagtcatatatctgttcctttacattctaaacatttggatctcaggtgacattgactgaaggctcactatatctacagatttcggtgaatattttaggactgatatgctcttaacaatcaagctaagctcatgtacatcacaacaaatctagataacaaaagggatagatggtgtcccagcgcccacctatgtgaaataatgaagaaatggatgtttcattttcattatgtaaagcaaaatgagggtgataggaagatattatgcataaaacaggaaatttggtttattctatcaactttcttctagattattcaaattcctcttaatatccaaatgcattctgcgtatactggaaggtaaagttaaatgcataataatgttaggcacaatacagatactaatgcaaacaatgaatattcagatatattgtttacaacttaccacttgcgtctcttgatgatagcatagacttgtcagccttcactccctctttgccaccagcatgggttggcctttgtgtacgcggcgagtgcgagttcaacttaccattagaggatgggagggaatggcgcctggtgaagccatttttctccgcagagtcagaactaagtctgggtgaattctgtccccgcagtttcgccttcgcagattgtgttgcagccatgtagctgggaacagcaggcgaattctttgaaccattttctggatactctgtcttggttgagaatgaagacctcctcttgctgcttttaaggctctcagtagaaagaggttcttctttggatctctgttccatatcatttactaaagcattttcttcattgtggatatcttgcagcggcatagtttctaccgtagggtcagcaacagtcagttcagcaactttttcttcagtttcaacttgataagaaggaacctccggttcaggttgaagatcaggtaccaggatatccgtcttagcattttccaacagattaccattctgaggttcttggtctcaggataatttggaactcttctgcagttcgctgtggtttctcacattggacctcttggcgttcagggatctcagttgcaggagtagatacctttgaagcctcagccatagaattagttaccttcctaaggttacgtttgaccttctcaagttcagttaactgactttcgggcactgaatcagcagtagagctagtgaatttccttgggtttcgccttgatttttcagtttccatggctatgttcgtctgagaggactcaactggtgcagcagaacttctccgagaattgcgcttcaacttccctgactctgtttccattgcataactggccttccttgtgtgtggcttggcatcagtaacagcagctctctttggatgtgaaatgggcctccagacacgacctatggtccatctctccaaccagttgaaggctgaatttggatccctctcatcatattgaaaatggagagcctctaccagaattggtgaagctaaaagctacagcatttatagaaaaaaacaattagcacaaaagaagaaaacatatacatacaggaaacaaaagagtgatatatgcctgtgagtaatgagtataacaggctaatgcatagattcaagattctcatatttgtatcaagccattagaagactaaatttagtataccttacgagcaaatgcatttgaagacaatttctccttccatgcatcccgcttaccactctgcaaaaggggaaagaatcatataactagcatatcttgctaggcgaatctgtcagttttaacaaagcttcccaaacaaactaaaagcgatgaatgcaagcatgcaaaaatatgtgtagcaatgttctatttagcatgattgtagtgctattacttgcttatgttgaaccaggagcattttgatgatagacttgcaatgttttaaaaagtggtaagcggtttcgtgcggtgaccccaccttgtagctcttatacagcataattggctgcttatgtggcttaagtgctaaaaggttggggcacatgttccttgtatgcggccttgtaggcctttttttatataacagtgaaacagattaaaaggaaaggggcatcattatgatgaatacatcaggtactgaatgaaacaggatcagcaagaaatttacccccgactggtggtgaacaagcttccagttgacttgaatggtattagtagaaagtctgacattcctaccacggactagagcttgaaacttcacaatcaaccatgttgcacgaagaggtgcaacggcttgcctccttacgagatgcccacgaatcagggcttggagtcttatgattcctttcaacgcacggaatgcccgacgtgcctggaccaataccatgctaaatttaggatgcataattctaaagaagaactttacaaggtattgtcgggttctttagtggattgcagaactacacgacgcaaggaaattttataaaaggcatgcaggatcaaacaggaatcagaaaaaagaaacattaccagatagcctcggaaggcagcttgtgccttgacggccgcttgttcctctctcaacctctcggggtcgttggacgcatcggaaacgacagtattctgcttctccaggtcttgactgacatcgcgcaccaccacttcaccttgtaagctggaattctcacccctcccaacctcctggacagcctcattgttatgaggtgtaacgagcaccggctccgatatcaccggggagctctcaaacccagcatccttcccagcagcagcataccctttgttgttcgagcccttctgcgtatggaaagtaataaatttggttacaacaacagatcccttctatctaactacaattccataactggactccataatcatcaagaaatcggttgcaacaacagtatttgccgcgcaaacaaagaggtgtaaaacataccgataaatctttcgccttggtagagccggacctcgatgacttcttcccgaagagcacggatttgatccacttcgccggagacttccccattggagcctacactgccgcacgcccaagggttcggagcctgcaataccaccgcacatcagctcacagatctacacccaatacccatttttcaaaaattctatctacgaaaaggcccacaagaaacgcaagaagaagcgaaggccagtgttttttttcccagcggaatcaagcctcgtagcaaagcaatcaaaccccgcaagaacaaaactgacggttaaatatctcgcacagaaaactaactccccccgaaatgcagctccaacaaactcaaatccacgcaaccccagctcaaatccgcgcaagaaaaacccaagaaccacgcctacaccgcccagcagacgcagatctagacggcggcggcagactcaccggatctgagaacgagagagtgcagactcaccggagggacgacgaactcaaggaggcagcggcggcccaaaaaccctagctccctctctccctctctctctccctccctcctcccaacactacgcctccattgcagcgagagagaacgcgaagagagtggtagtgtagtgcagtagtagagctcagcgagaagaagaaaaagaaaacagcagcgagagcgctgaagcggataaaacaaattgggccaaaaaaaaaaaagcgagaaaaagggagaggaaaaaaaaaaggcgagtagtgtgacgaactgatgactgagccagcgtgcgggccccaccgcccaacggaaccaccaccacctcgcgtccgtcccagtacgggtaccccgcctgaccaggtgaggctgacccaccttcactgacatgtgggtcccactccccgctcctgagagtgtgacgtgtggggccttgtttgttttttttaatgagtgggtgcggctcgtcngtggggggcgaggtgaacgtggcttgggaaaaaaaatgatggggggaggagtggggccgaaacgaggtggggtccacttgtcagtgggccatgtcgaactttttgtacagctggtgtggtactggagcctttttttttttactgagaaaagcgggaagcctcgtcttttttaaccggctagctgtcaacccgagtccccacccacagtatttgcagggtgggaccacatgtcagcgggcgccgtgcatgcgcctccaatgtcaccgagagattaaagggtatgtgtggtgattaacggcttgaaccgccttttatggcctgattaggaaacggtttgacgctctgctcgttttgaaatggagtcttgtctatgcgattagggtggactgagctcgttgcaagatttatagggttttctgtcaacatatagacagctcctaattaaaaagtcggatcagcttcgtcttgttaattttacaagcaaaatgtttaatttgactcgactcatcactcgtgtactggctcataaataagttccgtcttattcctatcattttattatacataaacgtaataatggtaaagcactaaacctatagctaaaaaattaagcactactctctatcccaaaataagtttatttttcactcatcccacacatacaaatacatagccaaaattactagaatacatctatttttataattccaatgtaattagtatccactttatctattcccaatataattattctttattttaacaaacc

SEQ ID NO: 60325 - DNA, 1516 bp, Oryza sativa
ttcctgcagccccggatgtttctttgatgctcctgtgtgaaaattgtgcaaatctgttattttctttgaaaaaaataaattcttccgaatatcatatggaatccacttatatttcaagttggaattaatgtttcagcaacgcaaaatgcaccaatctgctttaatttctaagcaagttactccaaactccgggcgacacaaggaccgactacagaactaccggcccatcgctctgcaatctgcatgcatgcatgcagctggccttgactttgccgccctgttagttgcagtagtaatctccgagtccgatactaattgtctagttgatctgaccaccagcgaagcaattatcaatcgcgagaggtaacgtggtgctgaggcgaccgatcttcgttgacagaacggttcttcgttgtatggtgccgtgtgtttttcttgatttgatagagattatatgacttattagccctagcttaaacaaatacattttttttctagcctaccacaaaggcggagctacactataaaaggagatgcccagtaaccaggtattttttttcttttcagttatagttcatttattttcactacatgcatctctcaatgcaaacttacacgtattagcttcaactcgattcaaagtaaaataaaacgaatgagtggtactacctccgttttaggttataagactttctagcattgtccgcattctataagaagtctcttgtaacttgaaacggaggaaatactttttttttttttaagctccgcccctaaccttccaaccgagaaggttcaggtgtgcatgcttgcctccaactccccgccgatcgcgcaacggtggcggccgcgctttaacgccgccgcgcgccgcggtttctcgtacgagagagccgcaagcgcggagttacggtcgaacggcggtggagggggcaaccggcgcgcgcggcacgaccgcacgagcgacgtataaaaatcgcattcactttcaccaccgtcccctgcagcgaaaaacacgcactccattgagcagtgtggttctgtgttgtgcagtcgtagtagtactggactactggtccaccgaacgcaccgccatcaaacgcctcatgtgcttgtttttacatggacagaatggcagccgctagcaacaaaccgaccactactactggcagctaatgggaggtgaattttcttccatgcatggaggaaacattctctcgtttttcatacgttaactacttttaatttacagaaatcgaatttggtatggtatgtttctggtgtaatatgttttatactaatttatcttgtattttttattttttttaatattaaatagatggtatgcaagaaatgagaagatatccattcaggaatgaaaacacttctttacggcaaatggcgatcccatggtagatcaggtagtactttaccagtgtggattgtctgcagtactactgatacagtagcagacattgacgtgtggctccggacccacacgtcaatcaccgctact

SEQ ID NO: 60326 - DNA, 1948 bp, Oryza sativa
taatatactactactactactatccctttgtttctttaaactttattaatgcgatgtagtatgactttgggtggttgcactggcagattcatccgagcaaaggagctgtcgatcacactatcataaacgataaaaatatgacaagaccggcaagattgatgaggaagacggattgagaagaggacgaatcgaagggatatatggcagggagaaagatgagcagcgaacagcagtgtttgcttttgacaaaggaattaatggatgaagtggacgacgaattgacgatgccgtcgtcctgaatcctgatcccttttcactccccaagttttctgagcttcgtcgtcgtcgccggctgttcatcgatctcagtcggatgaagccttgaacatgatggaatcaacgtgcgatgcatgcgtcgcgtccatctcgatcgtccagaaacagaaacgtgagggcggcaggattggtgtttacgtattcttgtgatggaggcggtttttgttagaaaaaggcgtcggcaacagctaccggttaaccaacggcgaggccacacgaacacatatatgcgtgacagggtggagtaaaaaacaaatgcgtggtgatccgatcgaatccattcgtgaaagcatatctcgacggccatggaaacaatggaatggcataattaaaggccggtaacaatcacatttcttccaataaatcacgcacatttgcagttaactatggacttgagaaacaaaagaaattgaggttccctctgtattacaaattacaaacccgattcagcacgagggttaaagtttgttttgtcagatttgctgaatcttaaccacttccagttcgcataagacactgcctcgtcgtcaaagggagcaacctcgtcgaacgaggagtctaactcagctggttgatgcttctctgaaatttggtcccggtatctttgcgccatctcttcagcctcggagaacaccttctgcaaccatacaaaaatgaaaaaatgtgacaagcctgaacattggcaagcctacattgttgacatcggtatactctccgtcccactgaataagacacacatattttaagattcaatgtttgaccaataattatttttattataaatttaattttatttgatgaaaataatatcattagattaatatttaaaatttactttcatatgattatgtttttgttgctataaacactatagaatatgagaaatttaaagtcaaaaaaatagttttgaagaccgtgctaagtttaattgcgccttatttagtgggacatatggagtagtatgtttacgatggtccagaatggagaaagaaatttagagttttctgacctccttgttagagagaaacagtccaggttcgctctcaaggtccttggtactgcagaatgaaacatcaacagtttcaaaggacaatcatagacgctgtgaacagcagatggcctatcaaacaacaaaagcaattatccggttacatgtttgggcagtgtacctgagagcaattctgcccggggctgttgatttaatcacgatagctttcacttcctcacccacttttagcacatcaccaacggatgttagctgcccccgtgttatatttgagacatgtagcaatccactgcaaaacgcaaagcattatgagttacgttgcatttggcgtgtggatttatccacttgcagacctttacaagcgtgccattagaatatggactagatatgcattctactggactgggcatgagataatgcagaccagttcacaatccaggaaaaaaagcagttcatcaaagggaagtactttttttttttaccaaaacaaagagaagtactatgaatgcacgaatttatatgagtcacgtgtaaaatgtagtagtcatctactgcattatcagtgcaaccaccctgatctaaagcatagcaagttgggctgcagga

SEQ ID NO: 60327 - DNA, 744 bp, Oryza sativa
ttcctgcagccctcccacttgagaggccatctagctcaaccttacctctaacaaaagattggaaggatatggatgtgttgtgtagcataagaaattgttcacgagcaacatgagtgcgaaatctactctgaacagctctagctgctctattctgcacttcagttcttctagcatccaattcagccatctgaccggctctcagaaacaccttagttcttccaatctgtcaaagacagcaattatttgcaatatttttgagaagtttcacgattaaacagtctatatatttgcatgaagctcatcaaagaaaataatcataaaaagcaagttgtggagtaaaactatttagtgtatcttgttaattccaccgtgacttttgttttccagggagaatatctagtgaaagtaaaagaaatcaacttttttgaacagttgaaaacttcagttgcatcaccaaatcaacaagaaaaatcctcaagaacttactttctaccttacaagctgtaactattcaagaacatttcttttagataatggttcagtaacacatacatatctttttacttggtagccttatgggatgagaaaaagaggaaaatggttgtacaatacatataaagtaggatttattctgttaaagaatgactcacctgataaccctggagtcccattttgtccaaaatcttttggcagattactttttcatcatttctgtcaaatatcataacagtaaatgcaggacag

SEQ ID NO: 60328 - DNA, 3176 bp, Oryza sativa
acatgtgtgagcaaatattattaatgcaaaaaaaaagaagaacaaaatggatttttggttccacaggtttttttttctccgtgagagagggggggggggggacgtaggataagcagctttgtttcttgcttaggaatagtaatatgctgtacttaataaattgtgaattaattatcttccaagattccaactgagagtgtaaaacaaacaccttgaattattgttccgaacagtctttgcattgccaaaagcttcaaggactggattagactacatcaaagcacaattaagtatgaaggattagtccaggcaaaagtaacacatcacttttaaaagccttcacttccatttggaaggacagatatattgttcttaacaatgtgaaggactgaaaaatattaatgatccctaacttacttctaaaacttgttgttcaactgtcctccctcctgttctagaccgtccacccaaaaatgcaagatatctcataagcatctttgtggtttcagtcttgccagcaccactttcaccactcaccaatatggagttgctctttctctcattcatcatttgcctgtttccttattcaaaagaatgccagaaaagatgccatcattattggtacctccacctgttattttaaagaaatatacatcgatagcattctagggaattacctgtaagaaatgtcagcaattgcaaatacatgagggtctagctcaccgaaatttgcacctttgtacttctccatagtatggggttcagcaagatgaggcaacctttggaatggattgattgcaatcaatatattaccagtataggtctggaattcaaaaaaaaaaaagtagaatcagaaaagaaaggagagggttgcacaaagccacaaacttgtttttctttggctacttatgatgatatgtttgagtatgcaaatactcacgtaaattatattttttgcatatcgaacagatagattgtttaaaacaccaggctcatgcaagtatgatagtcttatcatatcatcaattccatcagaatgcacttctgtgtcctttggatgaatgtctgatatgctcgcaacaacctggtttcacagaattgaagtaacaaagcaagtttcatgacatgaaatatatcaatatagatcatgcgatatatgtgaataacagtagtacggatcatattattaaactatatataaacaggaacggctttgcatccttgatgcagttcaaagttcaaaccaaaagaaagaaaaaacttgaaagcgtgttcagtctgttctgataattgttatttctcaaacgattagattttattcgatgttgaaaatggatagtttataggtgtttttatggctaattagttacactcttaattgaaatagtttccagtgatttcagcactaaaatataaaggctgttactttatggatttattgacaactgtgccaattttaatttgcaataagagcataaccatgcacacactactttttcatcaatgatgatggtaataataattaatgatgaagaagttaaggtgcaaaagaaaacaaatagtatctgatatcagctacaaataccatatttccgttggtagtgcggatatgggccttttgaccctcaattcggaagacctcaccatcaatccaagctaaatctttatcttccagccatatatgggagccaagaacaatttttaatgtggcagcctgcacaagccacaagtcacaaaaatccaacatgccagggaaaaaatcaaggttaataggtaaatggatgcatagatttatatctaaagtttgtgttccaaaagatgccaaaaggaattgtaaaaacactactagaagtatactataaataactagcctcaccttgcacacttacatacaatggtatgtttgtatttgccatagaactcatgtgcttgttgatgaaatgcattgtatttcttatctacgttgttatatttaggacccactaaaatgaatattatgctggtgtaggatccttttctttttttcatcaaattaattccataatttataactactgttttaaacttttaatgatacaatagatatataacatggagtacaaagcagaatgaggcatggatcactgttgaaatggacatgcatagtttaataaatctaagaatgccgtgtcaaaccatgaaaggatacatgatcataccgacccaaaaagcatagaatcagaaaacaaattcatgagacatatgctttaaggcgtaaattctagagcaaagatattagataaactaaattcttagcaccagtgctgtactaccatgaattgaaataagagcacctagttcatcacatatttggtcacgattatacagaatctgatttcaagacaaatgtaggaagttatggactcatcaccaaactagatatgagtgaaaactaattgcagcatacacttctctaatctctattccaatatggtggcacatagaagaaagagtgtgtcctgacaaagtgggctagtgaagcaatacttatattgagcaaattcagagaacacttgaacttaaaaaaaaaaaaggcttattctcatattcatatctaaaatgagtagacggaactggcttttttaaaatttttaaaaaaatcctttccggcgtacagctttgcttcctggtcgccacaaatcaaacgcttcagctatcctacacacacgagattaaaaatggaaaacatgtccgttcatcgggagcaatgaacaactcacactaatcgagtcacccgtcgtccatcggttcctctagagccaaagtggtcattcacaaaaaattccccccaactacgcgaacacagaaacctcacatttctctccaaacccaatgctaacagagaaactaacaaaccagcatggcaaccccaatgcccgcgcaacacaccgcggccgcacggcgcgtagcgacatcggaccgaacgaaaaaacaatgaaacattagcatcacccctcatctcatcatctagcagccagacagccagtagccccagcacagacaactcaccatgggtgtcgcgcgcgatcaccgcgggaggggggaagcaacgatcgccgaccagtgcaggggtggggggtagaatccggccgccggcgcctccgtcgtcggtatcggcggccgtgggggggggggga

SEQ ID NO: 60329 - DNA, 5581 bp, Oryza sativa
gtaacttgtaacttgtgtcctggctcctggtcccctggacggggggactacgggtgcgtctgcgagcgtggctgctgtcctgtgtggtgtggactgtagaggacgccacggcccacggccacacacgagacaagggaaacgcagggagattatgggcatgtttggtgaagctttgtagcggtagcttctcctaaaattttcagaagctaacttccaaacagtttatattttcatctatattctgaaaagttacagttatagaatccagaaaatgaattagaagccaaaagttgggtttgtcagcttttctaaattctcaactagcttcttacccgctgcttctcaaaattttacactcaaacaagacctatatactcccttcggccagaaaattaatttaacgtttaaaactttataatcactaatgctaaattaattaaaaaaggtatatgtatcactaaagcctctcatgtagtgtattcttctagcattaagttagattattgcaatcttgtttagcaacagtattagacttttgatgtttactatagctaactaaatgaaaccccgcgcgttacagcaggaattatgtataatagtattaaaaaaatataagacaacatataaataactttatatgttttatataattttcatctttaatcgatcatcaaaaagttgtaaacgattaagatgaattggtttataacaacttaagtcatatataggtttatcattcaaaagtaaactaagatgatgtgtctcaatgatagaaggaaaacaagggagataattaatatagattaatcatccaaagacaaatctaaggtagtatgactttataggggaagaaatgaatggagataatttgaaccatggatcaatcatccaagtgctaggaacaattgaggtgatgtgatttaatgagatataagagaaatattattaactacacttagcgtggatgagctttatagatatataggattactctttttatctaagttgtattagtttataatattactgaatgaaaaaatatggaacaatggtgaacggcgtagccatagacgacacaatgtttgcataactttaattaaaatggtttgtgatatataatacaatgtttatgtattatattcattctaaaaaggtataaatcaccacattaatctgattaaacaaagttatgcagcgttttgatttgtggttgtatttgtctagatagaatggtgcaaattgatagatataatttgtatataaaatataagtgtgagtatataggaacataaagcaagagttgtatattaaatccaattatacttttaaaatatagcttcatgtaaaattgtacgtgaaaacggtcgggaaccatttaactatttagtgtcaacaagcaatacgatgctaaaatatttcttttaagaaaaacatattttatattggctaagataaaaaacggtatcacttaattgtatggaaataacgttcaatcagtcgggaatttccaataacgttttcatccctgccactagttgatttatgttacctaaaattatttttcttttaatatattgacgtgcaatccttctgcgtgttcgcaaaaaactagttgatttatgtttggacataaagagaaataacattagagaaaatcttgagaagaaagacagatagaaatccaggtgtaggtaaatgtttcagatggtggttattgagggaatcaattaaacatgcaatgcaacaacaaattcaagtctgagtagaatatttaaaagtccttcataacatacaaccaaaatttcaagctctgtacatttttattgcacggttaaacagtatatatatgttacatttcccatggctatattacctaggctcaagggggatagttgggaggatcctcaagagcacagaaacacagcagcacagcatttgatcactatcgctgcaaaccagccaggccggcccggccttccaatgatcgaaacaggcaaaaaggacgggacagagatcgagagaagaaaaggggaaaaaaagatccagctacatccaaaatgacccatctgggcatctcaatcaagaggctgctatctcgatcaagaatccggcccagaacacctacactattagctagctagcattggaaaagtcccatggctgacccgatcgatcaaattaaccgtacgcgcgcggttaattgagagaacctggcggctgcgtgccggcgacgaagaagcggccggaggcggcgtcctggctggcgtagtacaccgtgctggggctcacgtggttgtgcgtcccctcgtacgtcgtcaccacgtagctcgggtcgtccttgtcccgctccaccctcttcttcacgttgcacccttccgtcgagcaccggtagtagttcctgcaacgcacaatcgatcgatcgctgttagttagcgatgtccattcattcattgccaggaaagagacttgcacttgcacatatagtatatgacgatggaattcgcgtgattaattgcatcatcggtgtatttgatgatcgaagtgatggcgacgacgacgacgacgggatgatttatgatgatgatatgatcatcttgaattttgtgaaggggatatgattttggtttagttggttagttagtaccttgggttggggctgttcttgacggacttcttgccgtacttgcgccacttgtagccgtcgtcaagaatctcgatctctgacttcgtccggaacgcgatccgctccgtccgcggcctctccacggccgccggcgccggcgccggcaccgcctccgccgcgctcctgaattttcccgatcaaatgcccccaattcagaccaaatgaacaggtgattgcacacttgagagtagtactctacttgacaagtgacacacgccactagccactcaccttgttgcgtttgcggcggcgccatccggcagcgcggcggtgggcgcgccattgaacacggcggccggaggcgcgtcgtcgaagaagaactcggagatgtcgaactgcgaccccgacgggtcgggaagcggcggcgtcgttgcggcggcgagggcggcggagaagctggacgcggagctggaggtcgagcttcccccgtgggagaagtacgatgacatcgagtaggcggcgtcgcccgccggcgccgagaggcccgagaccgggtggtggtagaccgctgcgtgcgcgccgactgccgccatggccgagtacgaggccggcgcgaaagctccgtatttataaggattggcgctaaatctgcatggatatgaggggatgatgtagtggtggcggggtggatttgtactggtagtagtaggcgatcgagagggatgagatcgatcgtgatcgatcgcacgcggggcgcgggggagctggttgtgttgtgtttgtgtctctctctccgggaggattttgccggcttcgcggtgagcttcgtgaggagggagaaggttcggagcgggtgcgggagttgccgcgcgcgcgccgccgctcgaacgcacgcacgcgcgcacggcgtgcccacttattttagcagcatggcggaaatgtctccgggggaaagacttcgacggggtgcggtcttcgcctcttcgccacgtagttgccgtgggggccttctcacacacccacggtccatccggttcaagccgctttctttgtttgggttccctgcgagttggttggtgtggctaaaccaagaaattttgggagggggtgaagctaggagataggatagtcaagaaccggttaagaaaattttttagatatagtttatttattttcattaaatatgcactcacttaatttaaactcagacgcttatatcagtttaaattcgatctaaaataaaacaaattaaatgagtggcatctctctttattttattttagctccgtctactttggactgagcagcgatagcgattttacccacggatactgtgttcgataggcacgggcatgtgttcgacatgtctgacatgatgctcccaaatcatatgtgctgattcataatctctgtttagttatctagccatgcatatattatcgatgtttttaaatacgcacccgacaccgacgtgggcgttgatttttgcctgctaatactatcgtgctccgattgtccaagaggtatcgggtcttggatcaggtgtgttcctgctttgcccgagtctaatcaaacctattgacaggaaagttagagatattgtagctaccacagttaaatctggtgtatttatcctttttcgcttcagccattattagtcatgtattttatgcctgtaagatcctttttatcccttagcaaaatttcacaccctatcacattaaatgtttaacacatgcatggagtattaaatatagacgaaaaaataactaattacatagattgcatgtaaattacgagacgaatcttttaaacctaattgcgctatgatttgacaatgtggtgctacagtaaacatttgctaatgatggattaattaggcttaataaattcatctcgcggtttacaggtggatcctgtaatttattttgttattagactatatttaatacttcaaatatgtattcgtatatccgatgtgacacgtcaaaactttacatctggatttaacacaacctaagttgtttatgaaagttcaccggtcggaacatggctcattgaataattagctcaaaactcatgaatttcgtcaaattccacataatctcacatatatatatatatatatatatatatatatatatatatataacttcgctagaatttcatctaaagaatttttctcatgagacactacccacttaggtagtgttcgtttctacttaagatggagatgaagttatggaaaaaaacaacaatgtcattagctcatagttaattacattttaattattactactatagataaactttaaaaatattttatataatacattaaagcagctattatatactcactccgtcgaaaaaaaacttaacctaagaggggaatctcgacaaaggaggttgtccaaattctttatccaggatggtcccatcctcttcaaggttaagtttattttagacggaggaagtagaaagttttagtgcaaatgcaccattcaacaatttaaaaaatatgataacgaaaatttcatgcctatgcggctatgcctaccaaaactgtttcatttgatactaacaatcactgtcaataatcaatatttacttctattcgcccatgttcggccagcaggcgggcacggccaggccacggtcacgctcttaccgccgatcgccatcacccccaccgccccacagtacaaaccatccaaccccagccgccatccgatggcgtcatcagcaatacgccgagacggaagttcaagttcaatcattcgagcttttcgttgggggctcggctggtacggtcccaaaaatgacggtattctccggaaaaacatataacaggttcgtagcactacaaacgtacactatcgagcactgtggtcactttattagtattttcgctttgctgtcgctttcgtactcccgaaaaatttagagcgggctgcagga

SEQ ID NO: 60330 - DNA, 2157 bp, Oryza sativa
  unsure (1)..(2157): unsure at all n locations
tagtacgaagtactactccctacttcctctgtccaaaaataaaaagacaaacctgatttccgtgctcaacgtttgaccgttcgtcttatttaaaaaaatataaaaaaaataaaaagncaagttatgcataaaatattaatcatgttttatcatttaacaataataaaaatacgaattataaaaaaatttcatataagacggacagttaaagttggacacggaaactcagtgtttgccttttttttagacgtagggagtacgtatcacgcatccaatccggtgtccgatgggcgacgctgatggctcgcgcgatggtgggtggcggcgaacacatgcgtattatcggggtgcgcgtggcggggaatggatgcgtatgtgcgtgcttgtgagcgtgtccacgtcgcgcgcgggcgctggttggaatcggatagggcgtcgttgtgtcacttttttgcgtcgtccatccgtcatttttttgggggggaagggtgagccggcggacgcaaccgatcgacgggtgcgagacggtgtagtgtgtaaccgtgcgatgggagaaagtcagaaagagatagcacgtgacctcatgaagagtagcaatcggattggttttctaacgcacggagcaatcgaacgatatatgcaaacatgattcgtccgaggagaaaagaaaaaaaaaggaaaatgatgcaagcatgattgaaaatgggatattggtacaatattttcagcttctttttgtttctttgaacgagaaggcaaagagccctgccgatcaattaagaaggaaaaaaaagacaacccatttgtggaaccttaaaatgaactactcttgtttctaaatatttgacaccgttaactttttagcacatgtttgatcattcgtcttatttaaaaacttttgtaaaatatataaaactatatatatacatataagtatatttaacaatgaatcaaataataggaaaataaataattatttaattttttaataagacgaacagtcaaacatatttagaaaagtcaacggcgtcaaatatttagaaatggatggagtaattaactgtcaactattttaatgatctaatctacatgagttgatttgcgttttaaatattgttcttttattatattgttttatttaaagttagaacaatagctccgtgaatcaatcaagggaataataagggctggttaatcaaacctattaaaaatatcaaaccacgaaggctacagtaacattgagagagtagtagtagtacattatatactgcactcattagaaatgctcttctcctctcatccttgttgagagtatattatatttaccttcttaattataaatttgtcattatgtctcccatcccagtagcgcctcaacgagttagataatgatattgatgttattttaatattatttatgtatagttttcttcctgattctagttttttattaccacttttccttcttcgctagttaattaacgacgctagcgaacctagaaagaaaatgactgaaatctttcatgctcatctagctcgtgcaacgtcttttctcgggtggctagtgtaatttggtcggggtgtcccacatagatacatactcgcaccatctcataatataaatgatcttagagggatataacacttgtctagattcgtagccttaaaaagtgtcacatatctatttaaaatctcttatattatgagacggagcgagtatattataactgtaaaaaggtttaacgatatttaaggatctatgttaggccttaattagtaggtacgccctggcagcgacagcccctttttcctaatttagtttcttgtggttttcttgcgaatgtgtacggttgctacgacaccaaggcacgcctaaggttaagagatcaacgggaccactgtctggacaattgtgattgatgagatcgattatgagaaccaaaagctagcgaccaggcatgttataggaatcagcactgcaatacgtccgactcccatcttacccaacctcacctgccaatcgtttcgctccacgcagaccagcttctctccatgtggaccagggcaattagcagctaagagctggtcggataagagtcgtatgtcacagtcgtgtgtatagcattttcgtataggaatcattttttttcttttcga

SEQ ID NO: 60331 - DNA, 10351 bp, Oryza sativa
  unsure (1)..(10351): unsure at all n locations
caaatccaagctaatagtgcagggtgcctctcttttgtcttagtctagagcctgtctgtttttgtctcgttgtatggggaattttttagtttttagtttttttttaatatttacagaaataatctatcgacaaaaaaaattgcagaaatagctcctgccgcccaaatggtgggcggcaagctgacgtggcagacggtgggtcgaccgcaccgtctgccgccgtcggccaaaattgcgattaggcccttgccgcccaggggctaattgcaattttggccgcccataaagagcttgcggccgtactttttcatctgggtcccttgccgccccagggacccagatgaaaaaagtacggccaaaagatttttctatgttatgttaataataaataaagaagtatttattggtaaaacttgttaatattgttataaaaatgtattgaagtgggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgctaagttgtccgataatagctaacccctacgtgaggatccctctcctctttcaaaccgcgctttagtaaccctgtattgctctagtagttcaagctgcacaacacggctaggtggagttagaacccttctggtatctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaacctttgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctatgtaagtattgctcaatactttcggatgcgaaataccagcgaccttgtaaacggtggttaggtcgagaacgggattttctgtatcgacccactcgatgtatgcgcaagccgtagtgcgggtctaccgaatagagtagtgttacgaagaataaagcgattgcccatacggaatgaataagcatgtgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgaggcctcactcattaaggcgacttatataggcgcaaaaaatcgagtgatacccctgacatgtgaacatggtggggtatggtgggtacgcctgattggcgccgaaagatacatgcatgatcggcgccgaatgttacattggtcgtatgcgccaaatggcgggcaaatactcgtatcacacgcgaataaaggaggctgcatcggtgcggcagaaagtagtcgtgcatgcgccgaaaggtatcgtgcacatataacaacaacgtagtcattacacaagcatacagtactggaaagtgaagcaagtaaacaaagagaagactgctcaactggccctgccccgcgccgcgaccacgcttggtcctccgggcctgtgctcgcacatggtcctgggagtaggtgaaacgatccggtggcacagtacgggtagacgagtgtcccgcggaggagtggcctgcgcctggtcctgcgtctgcaccggcggtgcgcctcccagctgtgaggggccgatgacgtcctctgtcgagcctgaagcgaagtcgaagtcagtgatgtcgaagagcacggtggaagacaggaagcggtccgacgaggtcccagcatggtccaatggtggaccctgactcgacgtgccggctgcctgtgatgctgaccctgcagcctgggagaagtgggcggcctgcgtcatagcgaactgggcgaaacctacacatcgacaacgggacccttgtaagctaagacataaaatgtatgtaaattgattgtggaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtatagaaatagtaataaaaatacttacctccgtgcggagggggagtcggcctaggaacgtgcgcagctggacgggaaccagacggtacgggtggccgctgtacagctgcgtctgcccgagcaacgtcgtctgcacgacaggtgagcactccggagaatcgagcgcatcgactccaccatccgcgtgtacgtcgtcaggtgctcctctacgggtaccagaatccccgcgcctaaacgttggatcgtcattgaaccgtcaacgacgacccggttgatgtcgtcgacctgcatggttaatatgttcgtaaatattcgtaaaatttgacgaagagaaagacatgaaaacctataggaatggtgcgatgcagggtactcacaacacgagcgaagtcctggtcgtggtgcctggcgtagaggtctctagtgctcgcaacgtggggctgctgctccaagggagcgaaggtgaccctagtacgggtgcgtggctggtaccagcgtaggtaggcctgtacgactcctcacgtgggctctccctcgtggtccacgacctcctcggttgcgagcaaccagtcctgaacaaaagtcgccaacttggcgggccagtcgccagctgactgctgacccttgcgcgagtacctgcgaattaatgtgtaatattagtgtgaaacgacagatgttacaaattattgtgaacaagcagattttaatgcaacaacggaaagcgtagtgcaagatcttactggtgaacagcagctgggacggtggtcggaaacggtactggaaagagctgacggaagccgaactgccgcatcacgcggaaagaggcgtgaggctcaacgcagatgtcgaagaccatcggaaccgtagtcatctagtacgcctggtccctggtgcagagtgtggacagacccaacggcgcacgagcctgggtagccgcggcactgtagggctcccacacgacgtcagtcatcagaaggcggtcgaactccatagcaaactcaggatacgaccgcctaacctggacgtgagcccatcggcgctgcaatatgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctactgcagcatcggcgatgctcctggcgtagtgcacgagtcccttgtcgatggcgtgcccgtgaccgccacagaacatcacccagccaaaaagccagagcaagtacgcctccaaacatcggctgtacgagtactcgtcggccttcgcctgtagctgctcaacctgcaagcagtcgataaaatgttagacaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcgcgctgtactagtgcgaaacgtgccgtcagatcgtcctcccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggccgggtccgcgtcgccggctgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtacgtgcccggaacgtcccaagctgagccccctgcaccgcagtaaggtgagaccggtgtcagtgatctatcgccgggtccaacaactgaggtgtatcctgacgtgccatctttgaaaaatatagtgtttcgtgttagaacaattcaaaaatagtaatgtaaaacaaaagataacttgcaaaattatgaaatagtaataaaatcatgagattaattatgtacaacaagttgctatttaaatatagcaaacattactaatggtacataacgatgacgtgcaatttaacatatatgtagagttcaataatataacataacattaccaggtagaaaacatgtatgcttggtaacgactaacactgtccaataatccttccatttccccttatacgcgtgcactctcagggacaaccatctttttccttaacacaccgaacttcatattgcgaccggttcgacttggcaaccctaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctagttgaatgcccactggagctactacgtccccgtcctctcgtgcgttgacctcctccacagaagtctcgtttactttagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttgtgtaagccaatgcaacggtaatgtattgattccaaactagcaaatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcaaggcttcgccccttcttctcttctcctcccctctcttctttttttttcactggaattgaggagagaagaatgagggctaggggctgggcagcaggccttttataggcagtgaggcctgccgcccggccagagggcggcaaggggccgcctgcaaaatagccggccccgactgacttttttttgcattcgggccacttgccgccccaccagagggcggcaagggttttcctgcaaaaaaaccctccctccgtcaccgcccgttcctcccccgtttgccacgtcagcttgccgccccagaggtgggcggcagggtctatttttgtaatttttttggccgatagattatttctataaatattaaaaaaaaaatctaaaaccgaaaaaaattcgttgtttgggtaatcaagcacgtggggattaagaagggcccaggaagctctttttagcgtaagatattgcgattgacgtccactttgttcggcccattcggataacgaaaccggacatgcatgcatgtatctaagtgcagaatatctgccggctgaaagcctgaaactaatttaaaatatattaataccatttttttcctccaaaatccttgtggataatccggatatggtgtacgtggtcgggatggatctatcgtggggaccctcgctattttttttttttgctttacatacgtgtgagaagagctctaactttagctagtttgtttaatccctttactatttctttctggattcaccacttggtgtggtaaggtctaatcttactattctttcaacaactaccatctggtgctcgttagtgtaataggtagatgttcacggtggcttagacataagaagaatacgttttggtccaccatcagaaatatccaaaatatttatacatataagtaaatatacgtagaaaagtttaatatagaaacactatatataaaaacatttgaatccaaatcagaattcaaatacaaataggaagtagacatataaatattcggcctataaatttattagaaaaggaaaccataccaaaattgaaagaaaaaaaaacataggtgttcgtgtgagttcgcggtgcacaccgttccatcaaccgataggtttgacaaaaattcaacggacacatataaaatgccaaccaattgtccacgaggccacgggaatgttaatgaagagtttgttcataggcacagtcgcgtgtttttggactctgttttagttaaaacactctacgaattaaccccttttcgcatgtcgcattcattagtggattctaacaattctaaacaacgaagctatgttcaactctgtgtgctgctatcactagtatccaactatccattattcaatcagcaacacacagtcacaaattgaacacgagaattggacctcatctcatgtacacacatacacatggcatgctgcataaactagtactccctttattcctaaatataagaatttttggttggatatgatacattacagtacaacgaatttagacagtaaacttgtctagatttgctgtgctaggatgtcacatcaatctcttgtattcaaggacgaaaggagtactagctactactctacttttattagtatgaagtatgaacccacgcgatcgttcagtgagctagctgaagaatcacaccagagatactagctctgagagaagcttttatttcctttttccggaaactgaaaagcaggtggaaggagagcgacggctgagagtcgcattcaacgagtcctctgaccttgatctcctcctgccatttttttctgaagcttctcgcctgcaacccggcaggatccgagaaggaggtcagcaaggtcccggaaccggggtcaaggttgtccggccgtcgtcgccttggtggcctatccagcccgacgacctgggggtagcgtcgttgcatggacggacggacagcaacgtctcggctcgatcggccaccaccggcagcgtacgctcgctacctgtatgtcctcatcggcgcggacagagtgacagatccctccctgcttctgctgctgcatggtttcccaacacgccgtcgtcaagtttcaggatcgccatcagggcagggtcgaaatctgaatctctgaatcagccttgtgcaatcgttagaaaagtactagtactacaacttttgaagagcctgaagtctgaacatttcggtcagcgtcactgggcacccccatctctgaacagtgtgagccatcaaatgaactatatagcacatgcgatcgcactgtttggggagaaagatgaattcataactactactgtaaactggaaagcaactgtatgttttgttacagctgacaatgaagaggtcaactgctatacaagtacttctacacagaataccgacaccgacagaacagtcagaactgctattccagttagtcttttcctacctgggctgctgggcagatgcaagcagaagctgcttattactagtatagtanttctactagtagaggctgtgtttagttcagcgtaaagtttaattttggttgaaattggagataatgtgactgaaaagttgtggatgtatgacaggttgatgtgatggaaaaggactgaagtttggatccaaactttggatctaaacacagcctaggttaaaaaaatggatacacaagcgagtaacagtttcttatgcgagcttattgtacactgtgagtccataacaacttataattgtataatttcattctcagccaatgaacaaaagcatccaaagtgctagcaagcacatccgctggtatgttcagtatcaggggctggttgtgcaacagtcttgaagtagctggggatagagaagaaacaggtgtaagatgactagtaaacagctaatgctagatttgtttaggcttgaagcacttcagatgcaaacaagaaactgaaggtgtttcacttacatgtcctgatcatgctcatgctccagagcaagcttggcaatgcacagaaaagcactgtcaacattgtagtcgtctttcgcagaggtttcgaaatacggaatgttgcctttggagacgcaccactcttttgctttcttctcagggatctgtggccgggaagacagtacagaaatgtcaaattgtcaatgtctgtgcactggatttcgttcagaaaaagaaaaaaaaaggaagtgtactggactgttgtacagaagtttgaatgttcaagtaacttacggcacgtctgtttccggcatctatgtcaatcttgttgccgagtaatatgaagggaaaatgtttgggatctgatgggctagcctaaaaaaggagccgaaatttttcagttgcagtcttccagtactgttaaaataggacaaaaatgctgtactacttttctttttcctctgaaatgtaaaatggacttgtcaggttcttcataactagttcaaattgattgatattaaccaagcaacattaaattttcagcctgcagcagccattttggcattttgctgtatgccttcagtttgcatatgactaacagatgatgcagacattgcttctctgaactagtacaggcatcaggcatggccacaatggaagaggtaattgcagatgctaaaaacttttaaggaaaatatcctgataaaaatgacttacttgggtgaggaactcatcatgccaggtgttgagtgcattgaaagatcttttagcattgacatcgtagactagcatacagcaatctgcacctctgtagaacgccacaccgagactctgaaacctctcctgtcctgccgtgtcccagatctacatccaagaaaactcaatactgatgacagccagatggcaactttcatgtgaaagcatccaaatttttttgagaatagaaagcatccaaattgaatgggtgtatgaggctgacctgcaaggtgacaagcctgtcttcaatgagaacctccttggtgacgaaatcggcgccgatcgtcgccttgtactgctggctaaacttcttgttcacgtatctaatcaagagttcaagaaaatccaagcaccgatatttgtggtgtgctgaagattgtttctagttaaaaatatctcttctttttttctgaatgtaattccggttaaatgaatgaaaggtagtagtagaaaatattgagatttatcttctgaggatttcactataatctacagctaactgagcaaaattgat

SEQ ID NO: 60332 - DNA, 4469 bp, Oryza sativa
gcttatctcactcaagagccaccgccaccatgtcgacctccacaactgtcgttggcgtggctgctgtacccggcgtcgctcctagtgcaccatcgagctgaccagccaatgccatcaccgagctggccacctgacaccaccgttaccaccaccatcactgccagcgcctcctaagacccttggtgccgttgccgccactataggacaaatacaaataggaatacataggattgaacataggaatagaaaaacataaaattttaatagaaatataagtgaaaaatagaggattgtaatacatggatgatcatttagaaacaaacacataattttgataggggaatgcaatacaagaaaagatggtttgattggaccgcatgaaaaacacatgaatcagatgggagatagatttgtaaaggaaattttgaagaggttggagctcttgctaactttcatctaaaatctccataggattgttcattccataaaaaattgagagataagattaaatcttttatttcacatgtcttcatagaaaattttcttataggtttggaatcttccaaaagtgccatgtaattcctacaaatcaaacggagaattgggtaaatatgtgaaagttttttccccttgattttaactaatacctctgtcccaaaataattttatttctatcattcaaatcttataaaaaaggattgttttataataaagtgggctcatccaattctaccctcccatcttaccatcgccatatgattcaaccttccttttattccatacatgatgtttattgaatatactatgaaatagcaaatcatccacattaaatttgtgcatgaagtgatggattaagagtgaatttctatcattacaaacaacattaaatagggttatttgagtgtactgctaatatctttgaaattttctataaatacaaatacgattattcctctataactaatttcatccaaataatattggtactctaaaattgcacgtggtttttgagtggtgcgattggcattatcgtttttcctacgcatcatctagtttacgtagtgcgtactcgttccggcatcatcttttttgtcatgtctacacaccatctatccatgcgcttactcgtttaaacaaatgacgtgaaacaagatcaagttcatatgcgttttattttatttttttttcttctttgccatagagacaacctactactagatccggttataaatatttaacacttgcagtaaattttagtccaacttttaaaattctgaccataaattttgtattcaaatatgtttgtaaaatcttattaactttataatattatgttagtattttcatgccgaatttacctatacattttaaatttaaactattaaatgatcaaacttttcaaattttagccaaatcttgttctaagcataaaatatgtatgaccgaggattaagagtatcacctcggataattttgccaacaaccaatatatgtatgcatcgataacatgccgttggtctcgacaatcaagaaggacttctatatatatatggtatcgaaattgagtggccaagaaaacttatgtataagcaaggttccgatatcggttgctaatcagcacttaagcccaaaaaacagacttgcgaatttcttggttctggcgtcaaaggcaacaaagtacaccagaacctttagttctacatgtatactggatcgagtctgtttaaggaaggtactgatcactgtcgtcactcaaggtaggtagtcactgtcatcgctatcatcattgtcacttgaaacgttgatagagccggtctcttcatcacctggagagccttcagcattgtagaagtcagcagactttgccggctcctgttgaactggctgatcatggtcggtggcgaaccagcctgcactggtacatctggaagaggtagtggagcaggcagctcctgaactgcttgggctgcttgggccattggaggtggtgcaccagcgggtggtactagaagcagaggcgcaactacatgtagctgaagagggacatgttcttcaagtggcacaggcacccttggcgtgcgacggagctttgggtgaggcgtaagcagtgacttgagatcctgtgctggtacttggcctgaaaaagaaatttcagtttacgagtaaattatatctagaactaccgatcaagagcccgatcaaacattgaagtatgaatgctaaatttttcattcctttctattcaaataaacagagaagttatataaaagcgatgtgcttaaaagacacatctcaacttaaaactaccggatattcaatcccctcaattattaaaaccatttttactttacccattcaaacaaaactggagtggttttcgcttaacgcttactacttgacaatacaagttaacaaaaacaaatcgtaggagactcatatatcagctctgtgtgcatcttccctaaactcaagactgtttctgatcaagagataatttgaacggtttaagagtgaggggtttaatacaacaatacgcaattagatgttgatgaatcataccttcagccttttgtttttgcataccttcagcttcacttgaactaggtttagcatcagcatttaatattgtgaggagatggtcctgtaaacatacagagaatggatattactgtaaaaaaaatgattaaacaaaaatattgtagtttaaagaggaaatataccccgtcataagaaaatggagagtcatatttttcctcccaagtttgcaccatttctaccaggatatttttgatacctaatagccaaaacatacagagttttattaaacatacatatattttgcttgaaaataaacttagattctagttttaccttcagtcctctttgctagtaactcacacctcatcagctccattttgtttgtatttttgctacctttttgtagggcctcaagttgatcaactgattttctccatatttcagccctgataacaatatccgatctcctctctacttcaacttttaacatctccttttgcatctttaattcttccagaactgagagcgcattaagaggaaagcagaattagtgagtagatcacagtaagggtattaaaggggtaaaactcctcattttatggagaaaaggtagataggtggatggaaatgaacttattattggacatatgttaggctagaaataaacttattttttcgccgggccggcttgaaaaggcagccgaagtttattaagattgtaagagaagaaagtgtcggatgtacaacagccccgaaaaacagacttgctacagtatttgcaacaaataaaaaaataaatttattttaggagggagtatgtttcaagaacaagtttctggactgaaattagtccagatgttgtggttactaacagcttaactcctaaaaaacttactccctctggtctaaaaacaaattgtttggaatgcttgtagttaacatgtttttgttatatgaaaatggtatgttcaagtttgtgtcataaaagggctttcataatattattcttatgtaactgtttttaacttatgttaactagaaggtagttaaagttgtatgacattgactttgaaaagtctaaaacgacttctttttttaccggagggagtactaagattttgaaatatttgtgaaataactaaacagggcatcccaaactcatctattttacaccacaaggatgttacagtaacagattggctcacaaaggatctacaggctcgagataccaattcatcatgggtaaaaaaacttgctctgatcttattatcttacagaataacagaagcaccaaacagagtggaaacaaatacaagttcaaatacataccttccttctcaagatcaatttctacttcattccctgtcaaatgagtacacttgagaagttctcttatcttcgtctttatcctcagattcttttctttcaagcgatttgcgctgagttgttcgagttgggaaacctcgcattttatctacatttcagaacaccgtttaaatggcattgctactgataatcaatgtgacaagcgtcataaatatatagaattaccttgttaaggaatcttgatgataatgctttctcttgagttatcaaatcctctgatgcagcatcgataaaacacacaacattagcaaaatcgatttcctgatcaatcataacagaccgcagctcaatgagcctcaaccctagctccttaatctgtaaagggcacaagtagttcaggaagaagaatcaaacagacaacacaaaacaagatctagaaaagaaaatacaaaaaacacacaactataatctccctactacccagcagtcaactgttagtgttagtttagcctgggattacagcaggcaacctctttgcgctggcttgctgctgcaaactacactcatgaaaaagaatgcatcaacatttagcaagtccatctgtt

SEQ ID NO: 60333 - DNA, 8477 bp, Oryza sativa
  unsure (1)..(8477): unsure at all n locations
catttaacttctgttgattatctttgcagcatacctttttcacttgaagacattgcgaagtcgatgccaaccattgaggagacgacagagaatgacctgctaccttttgtccgtgaaaaccaaagctttgcgtttatattgcacaggagagattgagtggttccctcttcacagatcattcaccggctatgtgaaaaaggagcgcctctgtgtagcgtggatattacacgttattcatgttgtagactagtaacccatttaggaatcaagagcaattgcagctgagggtttctaggcctctctggtttgaatggttggttaagcaaactgtacatgttttatctgcagtgtgtataacacacgttattcatgttgtagactagtgacccatttatgaattaagagcaattggacctgacgttttctagtcttctggtttgggcggttggtcaagcaatcatacttattttctcacgtcatctagccagctgtttctttcttctttctttgggtgggataaagcaacatatgatgcaaccgttctcgcatgaaaaagctcaattcaggaaaggtgatcacaattatgttaattttactggtcatctcagccacttagctttttccaagttcaattattgtacaagggatacttcttgccagggctgaaaactgaagctgacgggatagaatggaggtaggtagatatttatccctagatggaagatacatctagcatatacatgtacaatttcttgaagcccagcaaaaaaaacagtgggtcaagtcccgtgaggaagaccgactagttgtatgaaactctttgacacacatcatggtcagctactcaagatgaacccaggccctgttatgaaatgttcttgagtttctttcgcggtttcaagtcgacaacaatgacagtgatgttatcctcgctgcctttcttcagagcgagtctcatcagataatcggcagctgcttgggcagcagggtcggtggatccttcaccctcatcagacaatggtgatgcagcgccattgttcttgtgccacagaaggatctgtcggcgtgcgactttgcatgcctcttcatttgacacaacatcccacagcccatcgcttgctagaataagacagtcatcatccttcgcccgtggaacgaccataactttcggttttggaatgacaaatggtttcagatagcgatcacctgcaacatcaggaacacggataaaattagcacaaggggcactaaatttggacatgcaatccaatgcacagggaagtcagctgaactgtcattggttcaaccaaatttcaggtgaaatggagcaacaatgttgtccaagtgtataacacaatagagttagtttatttgaatggcgcaagagatgtgaacaggtccaactaagacccatttagtcatggtccaagctgcaagtgccacttgcatgaacatgacataaggtacctttgttgcttcgataaacgatggcttttctactttggcaggtaacttcttttcctaatcaaatctgcatactcaattctataacagagatatgtttaacctcatcgcaagttcatcaacaagattagtgccaaactggcaatatccagatagtcacatgattgcagaatcttcacatatgtatgtctcgcatagaaacaagattttagggcccaaactgctgttacttgtaggtaaatatattcctaatgaataatacaacaccatggaaatatctcacagcacgtaatatattcatcactaaaaataagatctagcgtaatagttctttgggcaatacggtaacaggacattttgcctagccaatctgaaataatccactattgatatacttttcttagtgccgaaaactacaagcaatggcaaaggacttggggacttgcactaacatagtgttaacatcatcatataatatatggcaacaattaattctacagcactatgatgcagaagatctcaaaacaaggtggcaataggccaaaatcaatgtaagatcatgtaattttttacatcatgtcgcatagtttcatgtgctttgttcttgccatggccacaatttccaggcccaaagcacagtccttactatggcagtgtcacacaactcatttacagggaaaagagacagacaagtgcttcagcctagatctagcacagggatcaatatgcataccgattgatcgggacatagcaagtataccggacacccggtaaccattccattggatgaccttgcctccctgggcttcaatccttgcccgctcatccttcctgtcaggctgaaaacaaaggcataatcggattcagattaattatccccaaaaatggaccatgacctttacaggcataacaaagcttccccagtttaccttgtgatcaattgacaaggctacgggctccttcccgcggcagagcacgatgcgcgaatctccacagttggcaaccaccacatgagatgagcagacaagcgcaacgaccgccgtcgagccgacgttctctgcggtcaccggttctgaccggacctcaccgccaccattgacaaccctggtcactctccctgaaacctcatcgtccactctctggaaacatttcgtgaacacatcatcccagtgctctttcatgtccacctcgcccatctcccccaaattcttgccaagtcgcttcagctcctcgctcaagacgacgtggatcctttcacggcagtagttcgccacctgcacagcaacacgagggccacggaatcggtcaaaatcgtgagcttaggctgcgccgtgggcgaccaatccggacgccgcggatggttctcaagcacacgcgtatacctcggcgccgccgtggccgtcgaacacgccgaagaggtgcgccggcaggcggagcgcgtcggcgtcgaggcccagcgcgtcgaggtcgcgccggctggcgagcagccgcaccggcacgtccgcgaaccgcggcacggcggcgctcgcgtcctccatctccgcgctgcggccgcgcgtcgacgcgcagccccacaccggcgcgcagtccatcaggtagacgctcctcttccccgcccccgccgccgccaccgcctccttcctctccccaagatccaccctctcgatcccgcccgcccattcccccgtgcaccccacccgcgccgccgtctcatcctccccacatatcgccgccgccgccgccgccgccgccatcaccaagatcacctctccctcctccccccacaaagaaaatcacccccaacaacaccagcaacttctcctcctcctcctcctcctcctcctcctccaacaacaacaacaaaactacttcccaagaagccaacgaagccgaccacctgacctcgcaagcacaaggtggggtgggtgaagagaaccaaagagaggagcagagaggaagaagaggaggtgtgtgcttgcccaaagacgcgcgcgtgtcgagggggaggggaaaggggaggaggaggaggagaggaaggagggagaaggcgaggggaggtggtgagacgggattggacgggtgggggtgagcgggacgcgccgtatcggacaggtctccccgtctgctgctgctgctgctggagggggtccgcgtggcgttaatattcatttgttgctccgcgaacgggggtgtttgctgctaccttcacgccacttcggtacacttgttgcgctcccactcggcgccacatttattttcgccatcccttgcgctgattttgtttcgagatttggagggagagaactttttttaagaaagaaataatgaacctattgaggattggagactggacctgaagttgaaactatacatctcttgccactgtactatagatacatatcttttctgtctctagagaggagttgaaaggataaaataatcaataatacttgttttactaggtgagttgttactccatgattaattgagtattaatatatttttactccatgattaattgagtattaatatattttttacttttttatagaaaattttgtaaaaaaatatatttgtctagcagttcaagaaatgtgtatgtgtaaatacactttctatccgaaacaaatgtcgccttaaacgcctatgttgtatgcttattggtttatcagccacaaccaaactttaagcttttgaaacttaaatttaaagatgatactaagatttttttttaatatagtttcttttcaatattgattttgaaattattaagaacacatatataaaattttatttatacattataattttttttacttcgttcattctttcacgacttatgagccatggggcaaacaatgagaggcttaatttgaggtgaaaaaatattttaaattgtaaatatctcggtgtttgaattagtattactcctaccttatatgtgatgctttgacaagggtgtttagatttgattgggaattcatgattcaaaaagggtggtaactggataggataaaatatctgatagattggttaggccagatgttgatcttattaaaatatgtacaacttatatacaaatgtataagtttagacttccacttatttagggtagctttatactcatgttgcctattgttttttacttaatattgtgctacgtggccaaacttcttgtaaagtttgttgctgaaagtcgagatccccaagcaaacataatatattctaccaactaatatctggggtgcgtctatctgttctatactttactttgctcgcttatggaagcaatggtttttctagaaaataaatttgcattgttcacaattaaatcgcaacacaaaaatagtacatttcgatgtactcttttgaattaagctgttcttcctcatcccttatgcgcttctctgcttgtaaaattaaagctattttgtgatcaatgaagttcatgccgatcaacggtgatgacattcctgtggctcctttaaataattaagcaaaataataatatattttttattgctacacaaatatactgtacgtaggaagatagaagatctaacaaaatcttgccatgcccattactggaccttttagaatgggtgacctgtagtatctgcctagcaaaatgccaaagcaaaatggaagaaaacaaaatagccggagatgactggtacacatgtggtgcccccttacattttctctctccattgttttctctccagtctccactgtgcccaagcttgacacgtcgccccatttggtgagagtgttttgcccccggcaaagtctgaattcgcacctttctaggaggccgggcccactccccctccggccaatgcgagcccgccacttgtccacgtcggatgcgaacacagaaaggactagcagcagcagttgctttctgtgccgggtctcagcgggcgtttagatcggactaaaacttcctatgtcacatcggatgtttggacgctaatttagagtattaaacatagattaataaaaaaactaatttcataaatgagagctaattcgctagacgatttttttaagcctaattaatccataattatcaaaagtttactgtagcatcacattgttaaaatcatggcgtaattagactcaaaagattcgtctcgcaaattagtccaagcttatggaatgggttttgtaattagtatatgtttaatacttcaaattagtgtccaaacatccgatgtgacagggacttggaataagtccccggaaaacaaacaacccctcagccttgtaacttttgtcacgatgagaagtgagaagagtgtgacatacggctgctcgatccaaggagaaagccaagtgtcgcacacttggtagaattccgaggataacgtttgcgtgtaccaggatcgatcggtctttcagctggtagtagatggaaaggttgatcgaatccaggatttatcaaatctttcggggtggaattatcatcgttttacagtttaactgtaaccatgtaaccatgtggttactgtaaaaaccgcgtatattatcgtgtggtataccgttattttaaaaactaaaataaatattacacgtgataatcacgataaccatacagttttgtaaacgtccatcgaatgaatgagagtcacagctgttcgtgactcgtctaggaaacgagattatacggttatacgaagagaaaggattgatctagtactagtactggtgcactgtacattgtcatgatcacggtcacaggcgtgtatacttttttacgtggatgaatacgtacggagtatgagtattttcggttgagcttaggctgtgtagttggaagtttgggttaaaattggtacgatgtgactgaaaagttatgtgtgtatgacatgttgatgcgatgaaaaaaagttagaagtttggatcaaagtttgaatataaacacagccgtaattagcttgcctctacgaccctgtcgtagttcgtgtcatgtccaaatccaacagagcgttcgagaagtactacagatcagctcttcactttcccttttttttttccttcggtttcatgtgattatgtgaaacgtgatgtatttatgtctcgtacgtgctaccactactacttgaaatgtggcgggttccaccagcgagttcgcgagtaaaaatgacgaggcgatcgattaacctgcacgtacacctatatggaccaaagaaaaaaaagcagtatgggtcgccagcgcgtgggcaactcccaccgggcaaaggcacatgtacgcacgcacagtgtgggggtgggcacgtacggggccgcgacgtgcacacgatgacacggcgacatgtacaggcggccggcgccgctcgcgcggcgtctcgatcgcgggggaggggggggggggacgcatcaccgcgcgcccggcacacgtgagcactcgcgcgcgcgtacgtgcaatgcaccggtcgtttgatagccgcgcgagatcggttttgatcgccgagatctgcacgcgcgcgccgcgtcgtgccgatcgatcgtgatcccgccgcgcgctcgcgcgcgcaccggtggatgggggcgcctcgctaccgagtgattgcgccgcgtgcgcgcgtaccagccgccgtgacttggcagctgcgacgcccacccgcgcgcgaaagccagggttgctgcaccgatcgagcatcaaccacccatccgttggcgagctctctggtggttgggttttgggccttttggcgatggatcgcgcggaacctggaatatttgatcagccagctagcgcggagatgcgcccggggatcgatgatatgccgggcgttgccccggcccgccacgcgcgcacttctgcatgtacgacggttgtgttcttttagttaggtgtttggataataggaattgggggtgggattaggattaagaaatgaacgaaggtttagaattaaatggaagatggagaatgaatggttaggatttaaatatgggtggaaaattattttcatttcccatttactaaacactgtcttgaggttgacaaccttctcttctagtataaaaacagaacgacacattaacacatgattaattaagtattaatttagaaaacttaaaaataaattaatatgatttaaaaatattttttctatagaaaattcttgtaaaaacacaaagttaaataatttgaaaaacatgaaactagagagtgaagttgaaaaagtgttgtaacagagtctaggctctatttggtatccctttatcccttttcccaaccactcttctttgttttctgcggcacgcttttcaaactagcgttttttttgcaaaaaaagtttctatacgaaagttacttaaaaaaatcaaattaatcaatttttttaaaaaagctaatacttaattattcatgcactaatagactactccatttttcatcatcactcttatgggaacagatgtgcgaacagctggttcggaccgcatcatcggctcggcaacanaacggacggattatacgagacgaggcgcatttcagaggaaagtgaacgaggcactcatgataattgggtactacaccgacgtaagtgccattgagttgtaaaacggcgacaggtttaattatctcgaacgattttgacttaggtgattccaaactactaaaaatgcaaggcggaaaacatatgaaaagctacaaacctccggagaaagcagggaatgagattattggattgcagctaagctggccgggatatgccgtgcacacgtccctgtcatcgatcgttacgtgttcctccctgtggagcctcgccattggtccaactgtccatcaacgcctttaatttttatacgacgtgtgaacttagctgatgggaggaatcctatatacggatgataaagcgatcgatattagtagtagctttcacaggagcccacaaaagtggctcgtctcgtgcataataacttatttcaaggtcgagctcttgcagtggtcctcaaacgtatcgaaggttttgtatatggcgcaaaagaccgatatgaag

SEQ ID NO: 60334 - DNA, 825 bp, Oryza sativa
agattttagatgactctagctgtgcatccattggcctgcattatgacactcctataaatgccaaattaggtcatgttgagaaggagagaataaaggatatgcttttctatctattgcttttagtttctgattgtgtcattggtgattgacaggtttcagatttctttgctaaacttatccagagggtatctccaaagagctatcagcaagctcttgcagaagttcaagtctctcaaaaattcttggagaacttttgtggagatcaggtataaaaaaagagaggaccatttcatagtatcagtgtaatctacatatcagatcagttccttcattgacatgttcacaagtactatgatataattgatactttcattagcgctgcagtttgtagtggtagacttgtaatttgttgaaagagcacatcatttccaaggaacttgcaaaatgctgcattctgcagattgaaaaaacttctccgatatattctcatcattcacatcaactatttctctggtatggtaggtacgctttctggctcgatcatttgctgtacctggcaaccatcttggacaaagcagtaatggttaccgttggccatatggtccggtgagtactctaacaatgtagttgaatgtttagccatttatttaggcaataccaggttttttttgggtatcatgttagctctaatgttatatatataattctgaacaggttgcaattatcacaccgttcaatttcccattggagattccattactgcaactaatgggagcactgtatatggaaataaacctgtcctcaaagttgacagggctgcaggaa

SEQ ID NO: 60335 - DNA, 727 bp, Oryza sativa
ttcctgcagcccagaactcatcatagtaatcagggacgcagtgaagctcatttagccatggaatcatcaacacattgtcttgtctctactaggtgacaaactctgtcgccagccaatgcaaccagtacataaacacacctgcaggtaatggtgtctctcctggatcaaatccgcttcttttcttcagtgttgctactgttcattcagtcattcagatagctacatgctacattggaggccaagaaccaagttagtaagcagtaacaactaacaaccatggatcatagcatcatgatggtgaagaatgagattgaaaactactcaggatcatctccagcaatgatcatcaatgcgctggaaggcggcgccgaggcgggcccggttgtcaggaggagaaggagggagccgtctttgctcgcaccgatcaatggtgatggtgacaccaatggtggtggcattggcaagtcgtccttgtcaggcatcactgtcaagaggagctctaggtttcgtggagttagcaggtaaaagaagtaaaccatatatacactgaaaaattcttgtgccttgtgacagattcagagcttgtagagatgacaagaagatgttgtcatgtaggcatcggtggacaggtcgtttcgaagcacatttgtgggacaagaactcgtggaatcctacacagaggaagaagggcaagcagggtaaagggatcttgtcttcttccttctgc

SEQ ID NO: 60336 - DNA, 747 bp, Oryza sativa
ttcctgcagccctagctcaaaactcatgaatttcgtcaaattccacataatctcacatatatatatatatatatatatatatatatatatatatatatatatatatatatatatatataacttcgctagaatttcatctaaagaatttttctcatgagacactacccacttaggtagtgttcgtttctacttaagatggagatgaagttatggaaaaaaacaacaatgtcattagctcatagttaattacattttaattattactactatagataaactttaaaaatattttatataatacattaaagcagctattatatactcactccgtcgaaaaaaaacttaacctaagaggggaatctcgacaaaggaggttgtccaaattctttatccaggatggtcccatcctcttcaaggttaagtttattttagacggaggaagtagaaagttttagtgcaaatgcaccattcaacaatttaaaaaatatgataacgaaaatttcatgcctatgcggctatgcctaccaaaactgtttcatttgatactaacaatcactgtcaataatcaatatttacttctattcgcccatgttcggccagcaggcgggcacggccaggccacggtcacgctcttaccgccgatcgccatcacccccaccgccccacagtacaaaccatccaaccccagccgccatccggtggcgtcatcagcaatacgccgagacgggaggtcaagtttcaatcatt

SEQ ID NO: 60337 - DNA, 2143 bp, Oryza sativa
atatgcataatctttcataaagtatgtcgtttcagaagtgaaatctttattcctggagatagtaacatacaactcaatgtatgataaggttatacggagtaccaagacgcatcaatgtgtgtgatgtgaaataacaaagcagatggtttaactctcctttttccttgtggtcggtctgatgtctctagacgaaattgagctttcttcttaatataaagatgtccaagtctcttgctcgttcccccaaaaaatagtaatggaacagatgaatcaaacatacacaatggagcaagaacttacaatgatggtcagcaatttggtctcttcatcaatcatgatgtttccatactggagatcgttgtggcaaaatcctacgcactggtaatcctctgaaagctcattttccaacgcagtgatctcgttctccatgctatccaagcagaactctttggcttcgtcagaggggcacaaattcttggcagttttgagccagttcctgatgaagatgtgcataggcattgtcagttagtaacttagtgttttacttcgatgatgtgtttcattttacaagtatgcaatgctaaaaaacagtgtaaacacaaattaagtaataccttagtctgtcccaaatgagtacagattttggaccaggcatatcaaggttgtggaattccctcagctttgaggctataatggctgaaatctctggatcacgcagatcaacagctgagagtgtctgaaaggaatatttgcatcagtccttttgttcttttgaacattaatggacccaccatcctatataaacatatttatagtcatcatatcgtaatgctttgtgtttttgaatcgtccttcttcggttcttcccagcaacacaaacagaacatgatgctttcttttgaaagtgaagaaacaaattgagaaaaaagattaacattcccatcctactttgttttgtccatgccatattttccccctatatattatattaataaagtaatcgggctgatgccttattctgaagctcagacgccgtgttctgtgacctttagcaactcggtcatcagtcttactaatcaaaagatttcttgcatgattaaaccagtgctcattgaggtgttcagacaccaaattgattccttatggctgtgctcaccaaaattaactatgtcttctcttttttttattcacggctgtgttcagcgaggtagattcgtttcagtaagcaggtagaacggtagatacgttatacaatacacacacttgttctttcatgtggatatttggatcgttgaactataagcaattaaatatgataaaccataaaacaatttcatagacaaccatcattaaacatagtagctgaactgtatgacatcttcagcaagcataattgctaactaacgacagcattctgccaggctcagaagctatcactaaagccgtcaagaagttatgaaggaaaaagaaaatgattcatgttgtacaatttattcagcaagagaacagtttcatatgtcctaacaaaacaaaatagtacagctattagtcatctccaagaagcagaaatgtctttcttttcagggcccaagaaacagaaatgtcaactaatgacaacaccctcccatgcttacaagttactaggacaagtaatttatatgctttctgccaaaagtaatactcatcaggctctctggtctgattcgtaatactataatgtgtccaatccattcaaaatcatttatattttgagacggatagagtatctcagtctctcggaagctattaagaaaagttttttgttttaatttttagatataatattaggcaggcacagtgtagtcaacaagagaacaaaaacaatggctgccacaattaaaattgggtgatgacttcattgagtacggatttgaatgaacatcccggataagtttctgaaggtcaatgttgaaatttcgacagtacaactgcagagtacatctactacatcatcaagaggaaattttcaaagaaaggcaactgattaatattcatatgacgctacctactacacgattcccacgatgcaggctgaaaacgattgcaaacagtgaaacaactctgaatttctcgccgaaaaataaaaaagctctgaattcgcaaa

SEQ ID NO: 60338 - DNA, 2144 bp, Oryza sativa
ttttaaagtagatttaaaaaaccccacctgtttgttttagtttcataaaaacacaataactttgtcacgtgacacataatcctagatattatggtttcaacgttttacaaaaccacattactaatcattttgcgctatcacaattttgaattcaacaatcacgagcattttatccatcatacaaatgttacattcactttctctattttgatataggagtatgtcaaaatggttaatggtgtggttttgtgaaattttaaaaccataatacatgttatgtggcacatgtcaaaacatgtagttttatgcaaattggatcataataggtggggtttaatgaaatttactcttttttaagcatattatagctcatataaatgcgcgcacggcgcgcaatcacatctatatacgcggacacacacacctacccctacaaacacctccaaagacgaatagtggatatttaaaataaaagaatctcctgcctcgatcaatggaattgaagagaggatagaggatgttaaattcagttgtaaatccagttacccatgacaagcaagccaactgcggaacttgtaaatctggacaaatgaaagaatggttttgataatagtataattgaaccagcccatgtaatgacaatcacagaacaatgacacttgtgacaacttaagaaacaaagcacaatacccatgaaaaataatacaaaactcaaaacaacgggtagattcagtagctcaagaaaaagccacacctaagcaacagctcacgattaaatattggacaatccgtatcactcaacacttgaatttgtatggcaccagctgcagggttttagaacatccagcttcactgtagaggggactttcccgacgatgtatctctcgatagccaagagcgcgtttttggcttccatgaccatagggctatgtatgcggccacaacgaccaacttcgtgaacagatagcctatctgcaggattattatttccatcaaatattgtgtctagtgtaagaccttcaagtgatgttgcattctcaagaatatgacaagttagctcgaccatgatcttcacattcttgatggtgtcatgatggtgtcctggcatctgccttagatgtgatgaatcttcagaaatcacgtcatgctccatgcgagtctgtgatacctgcatatgaaccagcagagaatatttcaacaaatagttccactatatatgatagatatatatttccgcatattaaaatttacttacacgtgaaaactttacttaccttcaaagtgaaagtctccaaggcaggagatgcatcaagaaaataagctaaagaaagataatcatatgttggggaaacgaccctagggactgtgtgaagaaaaacagtaaggtgcttgaggtggagaaatcttaaaggtgcgatcggcgtattgataatctgcataaattgtcgagattaatcacatttcaaggtatgactattgctatatgcataatgctggaatctaatgatataatcttaagttgcgtaatgtacctcgctaactgaaaatacagtgagagtttcaatagtgggcacaatggatggaagatttgcacaggcataataaatagcattatgccaacgaatggaagctatggttaggttcttcacatacggtagacctccatctgatagtcgtgctagattaccctcataatggaagtttaaaagatttggagctttaatttccatcacttgtgatgcttcccatccatacattgccagcttgctgagccgttgaagcaggcaaggtatcttgaggtaactaagctctttgcaatctgtgagttccaactgctctaacacaaaggaattggaaaaaaggcaccctaattcgtgcccagtaatgcgcacctcatacagaaacagacttcgcaagcaattaagtccaccagtaggacggaagacacaatagctgagataaagatgcttaatcgagcttccacctctattgaataaaagtgagaatgggaagtcgtagtagtttgccttgtcctctggaaacagcaaaaggatgagttcttcaattgccggtgtaacagctatctggagccaacaatcaagataacaggcgtcgaccaaattataggatctcagcccaaaagt

SEQ ID NO: 60339 - DNA, 771 bp, Oryza sativa
cctgcagcccataatactccgtttcattaaaactaaaattttaatatattttcataatatgtttattttgtgttggaaacattgctgtatttttctaaaatttagtcgaaacgacctaaacctataatatgaaccgaatggagtatactctaaaaaagaatagcggtatactaaacaagctatggacgccagggcattaacacagaaacactaaacacgatgcaatgcgacgaagaggccgatggggcgatggatcaaagagacgagctcactacaggattggaccagccgacgtggccgcgtctgctcctgctgcatcgacatgagccgccgccgccgcttcacctcccctcttcttccccgccgccctctctgctcctcttcgattccgaaaccagcagggcggcgcgcgcgcgcggggagaccagatcaccccgatacgccgcgctctctctcgatcttgctccggtgtcagcggcaaggcgcggcgtggcgcggctgcgcgaggagaggaggggaggggagtggaatccgcagaggtgacggccaaaaatacggcagaaaattaggaaacgaaaacctgctggtccatgctgtgggccgatatttgaagcccaccaaacgaggccttaatgggcttttgtaggtatgtttgggatgtacctaggggtagtaatgggcccaattttttagttttaaaatagagtgggtggaatttttacacatttttaacctataaatatttgacaactacttctcccgtttcacaat

SEQ ID NO: 60340 - DNA, 12464 bp, Oryza sativa
tgacaaagcacaacccatgcaataataccacaggacctaaaacagcaggtacatcctatagataaagaaacaagccacacctagcttaagcaacaccacataattcaacatcgccacaatttaacacataaacttcaaaggcatggcaccagctgcagggcttcagaacatctaacctgactgtagaggggactttccccacaatgtatctttcgatagccaagagcgcgtttttggcctccatgatcatttgcctacatatggggctgcactcaccaatttcgtgaacagatagcctatcaggattttcataatcatcacatattgtgtctagagtaagggattctagtgatgttgcattctcaataatatggcaagtcagctctaccatgctctttgcagagcaaaacccaatgatcttcacattcttgaggttgacatggcggtgtcctggcatctgcctcagatatgaggaatcttcagaaatcacgtgatgcttcatacgagtctgtgatacctgcataggaacaagcaaacaatacttacaaatgattccattatagacaacggattaataggtattttttgccacatcaaaatttaattgtatcaaacaggagaaaaaacatgaaaaaagaaatgcttacggtcaaagtgaaaatctccaagacaggagacgcatcaagaaaataagctagagaaagataatcatttgatggggaaaagcccccacggtatatgctaagagaaatcgtcaagcacttgagatgaaggaatctgaatggtgaaatttgtgtattgaacctctgcaataatattcagaattccatattaatcagaactcttgctatgtgcacggcccagccaaaaaaaaaaaaaactcttgctatgtgcataatgctggtatctaatgatataatcttaagtttcataacatacctcgctttctgaaaatatggtgagagtttcgatagtcggcgcaacagatggaagcttggcacatgtgtattgaatagtatgatgctgataaaaggaagataagtgtaggttcttcactggcagcaaacctccatctgatagtcctgctaaattaccatcataatcaaaggttgaaaggtttggagctttaatttcaatcacttgcaatgttgtgcatccaaacactgtcagcttgctgagcctctgtagcacgcaaggtatcttgaggtaattgagctctttacaatgtgtgagtttcaactgctctaaagcaaaagagttggaaagaaggcaccccaattcatccccagtaatacgcacttcaaacagatgcagtctttgcaagaaattaagactagtggtaggacggaaggcacagtagctgaggcgaagatgcttaatcgagtttccacccctatcaaataaaagtgagaatgggaagtcgtagtactttgccttgatctctggaaaaaacataaggatgagttcttctattgctggtgtaacagcaatctggagccaacggtcaagataagaggcatcgaccaaattataatattcgagcccgaatgtcctcaagccaatgcctgagtggtttttcataatgaggtcaactttttcgttgagttccttggttacttcatcactttccgacaagccactcagccccagttttgcatcactaaagacaaggttggggcggtatctccatgaacgtagaaatgtgtgagacacgcatgcagtacgagcggcatcttttagtggcaataaggagtgtatatgataccagatgtcctgaaaacacaagagtcagagaacagttcaacatcgcatttgtaaaggtaagtgaacaatgatgcatgcaaaatttatacctctggaaggaaggtccatggatttgtcatagttttggcaccttcataatcatcttcctgttggcagggtgagcccgttcgtttagccaatgaagcaaccgacccatctgcaatacatcatgtgatcatggttatggcaggtaccgatgataatggagcgtaaaattgagagtacaatgcacacataaaatttgtttctcttatgcaaattttgggcaagaaccctcccaagttattcttctgtggtagagtgcaaattgaagtgcgcaatcagaaaaaagaaagcaacattcgttccgaggtactcagattttaagctagctaatctaatcgaatcacttagctactactgtctcagtcaggaaaaaccaaactttttcttctgtctcagtctctcggaacaataggaataatgcagtatacttcatctcaaaagaataaaagatatcttcctcaaaaaaaaagaaaaaaaaagaggatagcagtatcctgattactgatttaactgaacaagctatatgtcaggacaatgtacacaatacagtgcaacgaagagggccatggaagcacggagcaaagaagcggcttaccacgggcttggacctgccgccgaggcatggacgtgatccgctccaccgaccccatggccagcttcttctctgctcctctccgatctcccggctccgccctgccctgcccgctcgttccaaaaccaacagggcgcgcgcgcggcggcgcagggagagcaccacctgatccgccgcgctcgctcgattttgctccggagtcagcagcaacgcgcgacggcgcgaggggaggaggaggcgagcttgaggaggggaaccgagcggactccggagtccgtggaggtgccgaccaaccaaaaaatatggcggaaaattagggacaaaacagtcttgtccacgccgtgggccgagaatgaggcccatctgagaaggccttgtaggcttaataggtgtgcttaggctgtatgacccacaattgaaatgctactcttagggcggtttagattgatgccaaaatgaaccttaccaaaatttagcaatgttaaaattttggtaaaattagtaacattgctaaaattttggtaggattggtttaataatgttgccaaaattctatacgcattgctaatatttggtaacaaactaaagtagccacatacttgtcaattttaccaaatatggtatggttgaaaatgtcatcaatctgaacaagcccttaattgtagattagtgatgaaggaatagtctaacatagaaggctgagtgctttccacgcacacttctttctttacttaaaatacatacaggaaaaactacaaaaagcaccccaaacatcacccggaatttgatattacccatataagacctttttttttcaattacatccctcctaatttattttgttttgatactttcccaactgccgttactcaatcattctcgtgaacgcaaaccccacaatatgacactactgcgaaaatatggtcgtcactcatatcggacaggcacgataaaaatgattatggaatcctcactcacagtatcatgttgttggactttggtagtcacgagtctcgttcttagatattggggtggctagaaaatgagttgttacgtttatcttacagagtttaattaacagtggctttattttggttgattcaagatgagaaaaataatatcggcatgacactatatagttgagaaaaaaatatgtatattcacgctaaatcttgtaacggaaagaaaaaatacataaaaataaacttattttgagatgaaggacataaggagcaagtaacatgcttatgactgagttcgggggtgagggttataaatcttcattcctagtacgaaaaacggaataatagttagttcatgattaattaagtaataattaaaataaaattttaaaatggattaatataattttttttaaagcaactttgttatagaaatttttgaaaaaaaaccacactatttagaagttagggaagcgtgtgcacgaaaaataagtggatagaagttagaaaaggagagtttaaggagtatttgagagaaggagaaataagaagattaagaagataggccgtgtttagttatttggctaatttttttttaagtatacggacacacatttgaagtattaaatgtagactaataataaaacaaactatatattccgcctgtaaactgcgaggtaaatttattaagcctaataaatccgtcgctagcaaatgtttacttagcatcacattgtcaaatcataacgcaattaggctcaaagaattcgtctcgcaatttacatgtaaactgtgtaaatcgggttttcttatccatatttaatgctttatgcatgtgtccaaatatttgatacaacattttttatctaaacactatatataacgagagaaatcttcactcttttctctttatcatccatgaaactcagcagcttacatctgggtccacctgtcagccagccagattgcgtacagacagagcttctccctcctctcctccctcgtttctcctgacacgctctcatcctacaaggctccaaccccaaggcaagcatgccaaacgcgcttcttccataaacccccgcaatcccaacaccctctccaaaccctctccgaccgatcgatcccccaccacctcctccgcctcccatggcggccgccgcggcggcggtcggcgtcgtcgccttgctgttgttgctgccgctcgccgcgtcggcgtacggcgacgggctgggccgagcggccgtgggggtcaactggggcacgatgacgtcccaccccatactcccgtgcgaggtggtgcggatgctggcggccaacggcgtcgcccgggtgaagatgttcgacgccgacccctggacggccgcgccgctcgcccacaccggcatccaggtcatgctcgccgtccccaacgaccagctcgcgcgcctcgccggcgacccgcgccgcgcctaccgctgggccgagcagaacgtctccgcctacctcgaggccggcgtcgacgtcaggtacgtacgcgcccccactgctgctctcgctcgctctacgggtggtgtgctatggtttgcctcggccgccggcgcggtgtcgcgtgtgcttctagtttgcggctgcatgccaagtgttcggtgttgcgtgcggcgagacgacgcggctcttactctgagcgcgggcgtgcgagctaggtgagggtatggaatgtctgttcgggcgcgtcgaaagtgttcgacggaatgccaccgttggacatgcagtttcgtgtaaccgtgatgtccgtgatcgattgatcgtgtagtgcctgtctgtctgatcgggtggtgctgtgagtgtgagatgcacatgcatgcttgcatttgtggttcatgcagaatggatagttttctgttgttgcagtgcttccttggtggctgggttaaggttcccctgtcgcctgaaagacatgagtgttaattagacatcacttacaatcgtgtcacttagataaatacagtaatgtatcctgcatcatgcaattagtttcatacttcatgcatatattgcatatgggtgtgtagcagtagccgtactgatcaggggatgtttggttgatgcctaaccttgccataactaagtttaggctagttgtggcatggtggcataaatgtggcttagaaatagttggccacaagtgtggcatgcttagctctaaatttgagagcatgacatgtgggtcccaaagttaagaaagtgtggcataacacaattgcggcagcgaaccaaacacatgcctaaaaaactgtggcatggctaaagtgtggcgtggcaaagtgtggcaaccaaccaaacagcccctcaaatctgttttgtgtatgatacctcagggtcgagagttaacgttgtaaatgttggagaaacatgctttgattggtttatggaatacagtgtgtttagatcatgttccctctgttgatggtgtttatatgcttccatggatgttgactgaactagttcattgaggaaacctattcaaaatgtggagcaagtaaacgcaggaatgagccgacaattggattaccatttctaggcttctaattgtagatgccaacggaagccagaatgaacttgtatttatgatatttagagcattttaatccttaattgtgctgaatttactgtggaaatttaggtgtgtttttattggtgaagaacagtaggaattcagtggatttcattgacttaattcctactggatttcagtgactccactttctagcaattccttttgtaattactgtgctacttaagtttatcatgcatgatgtgccaaactgagcatatctctatgaatccgatgggcgatggtgtgttgcatataaaatgtatgtacttgcctagttacttatttctgaatattcacattgtctttggtgatactctcctgttatattcactggttatgttaattgctcaggtatgtggctgttggcaatgagccttttctaaagagctacaatggcagcctaatcaatgtaacctttcctgcgctcaagaacatgcaaagagctctagacaaacttggtttaggtgatcatgtaaaggcagttgtcccactcaatgctgatgtctacaactcccctgagaataaaccagtgccatcagctgggagcttccgcaaggatatcaatgccctcatggttgacattgtcaatttcctcaatatgaataatgcaccctttgttgttaacatctacccatttctcagcctataccagaatccaaacttcccactcaatttttccttctttgatggtggtagcaagccagtttatgacaaaggtgtggtctacaccaatgtgtttgatgccaactttgacacccttgtttggtcactaaggaaggctggtgtgcctgacatgaaaatcattgttggtgaggttggttggccaactgatggtgataaacacgcaaatgtgagatatgcacagaagttctatgatggttttctgaagaagatggtcagaaacattgggacacctctcagacctggttggatggaagtttacctatttgcactgattgatgagaaccagaagagtgtactgcctgggcgctttgaacgtcactggggactactcacatatgatggaaaaccaaagttctctatggatctcagtggagatggcctagacaatctggttggagttgaagtggaatatttgccagcacagtggtgtgttttcaacaaggatgcaaaggataagttcaaagacttgccagccgctgtaaactacgcatgctcaaatgcagattgtacaccactgggctatggatcctcctgcaataatcttagccatgacggcaacatatcatatgcattcaacatctatttccaaacaatggaccaggatgttagggcatgctcttttgaaggcctcgcaaagatcacaacgataaacgcatcgcagggaggatgtttatttccagtgcagattctaagtgcttcagaaagggttgtgccactgagatttttgcctacatccttcttgattctcctaatggttgtgtccattcttacatagagtcagagacaatggaggaccggtaagtgctgataccttggggttgttggagcatgacacagtaaagaacataggaactgataccttgggttgttgaagagttgaagctgcagtaacataggtttgtaaagcatttttcccctcgtattttgataggcaaaacaaggtggaaacagagctgtatgccttcaccaccgtgccagcggtaatttgcatggatgagaaatatgagacaggatagactagcccttctttatacctctgttttcagcttgcgatcttgcagttcatttttttttattttctaaacgaccttgcagttcaattgtcaagctgaatgctggtattttacagcagcatgccttccaaatactgatgctacctacctgtaactgtaaggctgtaaaccaatgtattggcggtacagagtcatatgtgaatgaacgctctgcaattttagctgctcttgaattgcaaattttgtttcgtccctggatgttaatttttctttctctgttgaaagcaccatggataatggttgtctatttgagtttctctgcttaaaattagttggcagaaatttcctttcgatgcaaatcctaagctactggagaaccaaggtagagggctagaggccaccattggcaattcggcattgagaatcactggaagcagtatttagttactggaactgtcagatttacttcatgtatatggatcgcgctcctctgacgtaaagtcagagagacgtgggtcactgacgtgggggcccaacctttgtgggtcccacatgtcagtgacagggggactttacgtccgaggagactcatcccatgtatactatggtactgaacagcaaggaaaaattgacaaatgtgaggttcatgtatacacgcggataaacctgagcgacaaagaatcagcggcgattatttccgagtggacaaaccgttgaagtgttgacgtgctagaccaccggacggttgagctacagcttacacccaccgacccgaaaagatttaacttctagagagcccgatataacgtcaaactgtaaaaattacccgagatacagggctacaaatgtaaaattgatagcgatccgaagggttaaaagaatgaccgctacataggcgatagcgaatgaaatcgagcaaccgaacaatgttgggcctccatttagccaactagaaaggaaaaagtctactttgactgccttaaaactatgccaaatctaattcgtcccctcaaccagaaaaccaggtaaaacgactcccctaactattaaagttggtttaattgaactccctcagcagttttataagatggttttgctgatgtgacgttttgacgcggtttgaccagctgactcagcatgtgggacccacacgtcaatgtcacgttttcctcaaatctctttcatttctcttccccccccccccccccctcccctttttttttctccaggacggtaggagtgggcggtggctagccagcggccgtcttcggcttcgacgtcttctctgcgcccgtgtcgcggccattggcggagtacgccgggctccgccacacgggacggcgtgtccgtgaacatcgcaccgccaacgccgcctgcacgaccgttgataccagccacaacgcgtccacgccgaccagctgcgccacgctcgacgcctgcccgagcgcaccccacaggccggaggccgctcctcgccgggaagcagcgcatccgctctccgccgccgatccggcccccgctccccgcgtacgggccggagctccagcccccactccaccccgagaccacgccaccgtcccgtcgctccgcctcatggccaggtcgcccgctccgctggaggccggtccgccgccgcgcgtcgcggggtcgcccagccgcggctccgcctgggcagtccccgcggctgcgcagaaccccgtgactgcgacgcttgggtggagggcgcacaccagcacgaacaaggactcatcctccatcatccactccaatccaactaatgcctgcaactacatcacctcatcttctccaatttcttcttcttgttgtttgttgcaatttactgactgatgaagaacgaagatgcttgcttggatactgctagtctgcgttcgttgcagagaaagcaagcaagcaaaataacaagtgaggaaaggaggaaagcagagtagcagacaaaagaaacagatcgatcaatgcgatgctatctctctctatttgaatttgaatagtagcagacaaaagtttatatatccgattcaaatttgaatttgaattcaaatattttttatatatagtatttctatacatctaaagtttatacacctaaagtttatatatccgattcaaatttgaatttgaattcaaatatttttcatatatagtatttctatacatttaaagtttatacacctaaagtttatagacctaaagtttatatacccgatttaaatttgaattttaattatatccgattcaaatttgaattcaaataattcaaatattttctatatatagtatttctatacatctaaagtttatagatccaaagtttataagtcaaaagtttatatacccgattcaaatttgaatttgaattcaaattttttatacataaatttttctaactttttgtttttttaaatttttttgtggtgtactgtaatagggaaagaaggggaggaggaagggggagaagggagccagggggggcgggaccgatcgcccattagcccccccccctgaacggcggcggtttgtggtggcgttcggaggcagaggggaaattttcggccttggagaaaaagaggggaaaaaaagagaaaagaaagtgagaaagaaaatgtgacatgacatgtaggtcccacgtgctgagtcagccagttggaccgagtcaaagcgccatgtcagtgaaaccatctctaaaacctctgagggagtcaaattgtaccggttttaatagttggaggagtcatcctacccagttttctggttaaggggtatgaattagattcgacgtaattttaagggagtcaatgtggactttttcccaacgagaaatggatccgatccaaggatctggctgggccaaaatgcgcttatagttttaagcctactaatgggccgtcttggcatgacaagccgagagcccgtgagatcgcaaaggacatagtagtttattttggagtaattgcagccatggtaaaacaacttgtcaggtgggtgcgatatagtgtaagaacttgagaattgaacgtttgagtgcaacaacttgacaagtgggtgcgttctagtacagaaacttaataatttagtattttggtgcatcaacttggctaagcatatgctaggtgagttcttttcacgatgccaatatgtcattacatagtaatcctacggatattaccttataatattgaatttaatctttaagaattatattgaacatacaatttacatccaaatacctttaagaatttttttttgtttttttctccttctcaaatatcaacagaaaaataataatttctacatccaattaaatagactttcagttattagttaataggataaaatataaatatgcttacacaaatccatgctagtatattgtcaaaataagtacttaaaaattggatttatataaaaatgctccttataattaagttgtcgcattacttcttaatttattgtatcaaaatcgtacctaccttgcaagttgttgtatttgtacgatcacttataaagttcttatactaaattgcacatacctgtcaagttgttgcactagaatgcttatttctcaagttattacaccaaattgcactcacctaccaaactgatgcactgtgggtgcaatgcaacatttacttttcaattattgcattcggcagtgggagattgagaggagatttgtctagttctctgcgcgcacgctttccgaactactgaactcaattacgtcagtgggagcttgagaggagatttgtctcgttatccacgcgcacgcttcccgaactactgaacaatgtattttttaaaaaaaagtttctataggaaagttgttttaaaaaatcatatgaatcatttttgaaatttaaaatagttaatactgaattaatcatgcgctaatgacacatgtataaaagttttatcttacgattataagtagaacgatagggttttagctctcatggtagtttgttctgacaaaacacaggattgaagaaacgaaggaaaggagaaccagttgcttcctgaaaaaatttgaagacgtgcgtttcttgttccattcatttgcagtagtcacaggtaaaaacattgatcaaatcatcaaattcacatgaaacgcagggctcctcttgtcattacagcaaaattgaagttgccggggtgtccagacttcatagtagtctacagcatggtagttaagatgtggcaaaattggcaacttaaaatcagtataactacagtaagataacatctgcatgaggcggactcctctactccactgaactgatggtggcaaaaaaaaaaaaaagtcacttggtagttgatagctcctgttggatgtaatgctacagaagtttgatgtcccaatcttgttcaggatcacatcttgaaatttcataacctcatcaagttgatgggaccaatcagtttcagcctgaagcagggccaaattgtcaaatgcacgtcctgatggatctgcctttttctaatgtcgatggatgatgaaagtagcagccgaaggaatttctgctagagatttattggcatcaggaaaagattaagagaaacgaatattgcagaaaaaatcagttagacgtgtaccaagttctgatgagaaagaagactaacctgggttagcaggattggtgactgataaatgggagatcccagcattattggtcgaactaatttctgaaggatatcctacagctgaacatggaatgaatccaggatataccgtatggtacctcgtacag

SEQ ID NO: 60341 - DNA, 2098 bp, Oryza sativa
tttttatgtaatagcacaaatattaacagaattaatttagaatatttagtctacataaagcctttgttattccagtttgcctgagattgagggccctgttcggtgtgactagatggcagccagcagctacggtagcaatatacaattctactgtagtcactgcagcagcagtgctgcacagccgctgtagttggccggccgaacacaccctgaacctgcaactactaggtggtagcgtcaaacgtatggtcttcaacaatgtcagtgacagatagctatatcaaaccagtatcttatcatttcattaaaaaggaaaaatatatctaggtatggacaccaggaacatggtagagactgaccaagggcaagtctagataggtctgagcatgtaaaacatagccttgattttgaaaaatgggaaacagaaagagattcaagagtcaaataagtgtgcactcttgtgggaaataattggttggtttgcttttcagctttgttagctccataattataccaatgaagtgcatgaaatcatccaaaataactgtccgaaaaactaatttctattttcacacattgaagttatgacaaccaggtaaagtattttttacactatacaaggtattggtaaaagctgttcaagcactgtcaaaggtctaaagctcaagttcattaactcacatcagtgatcaaaacttaagctgatttttcccagactacttcccctctctttggaatatttgaagagtaggcatccctgcatgaaagaaactgcctgaatggcttgttcacaatactaaaaaactggaatcaagtaccactaaaataaaatatactagaattttattctaacctggttaacatccttgatctatcctgcatgcacctaggccatccaacatttgaaaaaacttcatagcagaatttggtttgcttaaagatgctgtaaacatcatttatgtaaatgcagagagagactgagttggatggtcccaggaagtgcaccgtgtgaaattcatagattcaatgattgatttggggggattactgatgcaactatgaggcaaactcatagtttgttttcttgcatgtgtttccaatatgtaaacatgacaattcagatttgctgcataatatggatccggtagttctcatactgcactatagtttgtcaaggaggaaagtcaagtgctggtgcaaaaccaggtcgtctcgctagttctgcattaataaaacctgcacccttcgtctttaagtgactattatcagtgatgaccagcaggacaaatttgtcagatcttctgctatcctcctgtaacaatgcaaacaacttaaaaggttcacctccaatttcctgatattctgcactcttgtaatttagcaaatgcccgctttcattgcacctgccattcttccaattcccaatgatagaatcggtcctaagatcacgtccaaacacagaagcagcactagtgtagaccttccgctcatcagcaaaagtttctttgtctttctcttcttccaatgtgaataatccaatttcttcaagtgtgcttcttatatctctttgttctgaatagcaattatcttcggcatcctgttctggagccaaagtttctttagaatttctttttgattccacccaaccttcagattttttatacattcctacaagtgcatttgccacatatacatcagaaatcaggcccatttttataatggaagcatgcagttgccttcccaaatgaatagcacaaagatcagcacaccccctcaagattcttgcaaaggtaacacggtttgcacgcaacccactctgttgcatcatggagaaaaattgaagagcttcatcactgcatctattttgaatataacccaacatcaacattgcatatgaattgatgtttcgactcctcatgctatggaaaaacctacaagcattagcaatgcacccacacttgacataaaagtttatgatagagtttccaacaacaacatccaagtattcagaaccaatcttcacaagatggccatggatgtgctcaccacccttctttgctcctatatcagcacatgccccaaaaacagttgagaaggt

SEQ ID NO: 60342 - DNA, 4597 bp, Oryza sativa
cattgcattccaagcaactgagctcttcaccggaattccattgaacatcctgaatgaatagccaacattgccacatttcgcatacatatcaacgaatccaacctccacaaacctatcagcacccaatccagacttgaccaccattccatgaaccatgagcccctgttctatgacaccagaccgagcacaggcgttcagcaccgatgagatgacgaaccgatttggcttcacctcagaagacaggagttccttgaacagcccaatggcctcgaagcagtgcccgcggctggcgtgcgccgcgatgacggtacaccatgacacgatgtccttgttcggcatttcgtcgaacaggtggcgacaggcagccatgagaccgcctttggcataagtgtccatcaggacgttggacacgagcgacacggatgcgaagccgcgcttgaggacgtgcccgtggacggcgcccgcgcccgcggcgagagcgtcgcgcgcgcagcgccgcaggaggcgcacgtagaggcgcgcctcggaggacgggaagaggagctcgatggggcccacgatctccagcaccgcggagacgatcccatgccccccgccgactcgggcaccagaagaggccgcggcgatggcggcggcggcggcggaggaggaggaggaagagaggagcctagatggtgcgggcttggagacgagcgcggaatggaggagtagcagagggagagaccgggacataagagaggcggtggatgcgtcgccggagatgggcgacagcggcggcggcggcggtggaggaggacgggatcgccacgggcatagtcgccggcggcgagaggggtttggagcctagagatgtgggcccaccttcgtcagagacaccactcccaaaagtccccagattcgctgaacgctctacgcctcttgccttgcgctcgcgtaatttcgtaaaccgccaactaaaatctctccgtgaccgttcgatcacgtttggacggtagggattctttagatgccctggctcgtgacgtcatcatcttcttcccccaaaccgtacggagtccggttctagtagcctcttaatcaaaaatcgagatttaatccagcaaattaaccgagacggagatggggttcccgacgctgaagcggctactgtccatgcagaaggagcggcggctgcgtcagtatcagcgctggcggcggaatcggccaccgcggcaaatccaagaccgtagaagccgcctcttgcgctgtgtacacagcaaatcctcagccatggtaaaagtttgagccttgttttcttattgtttctgatgaaaatgcttcagaaggatcactgtttacttgtctagttatagattgtgtacttcctccgtcccaaaataagtgcagccatggttttccacgcccaactttaaccgttcgtcttatttaaaatttttttgaaaaaaaataaaaacataagtcacgagtagtaaagtagtattcatgttttaatcatctcatgacaacaaaatgctaattataaaaaaaattcaaataagacggatgatcaaaattaggcatggaaattcatggctgcacttattttaggacggaggtagtatcatctactgtcctccgtcttaaaatctgatccaagccccgcccctccggccttgagaaaggatcggggttgcacttgtggttgattctaactatatttcagtcctcctaatttgtgtcctcctaatttgtggttgcacttggatggcacaactgctatggttgcgcaaaaaataggataagttcctcaaagaatatggcacacggaaaaatgaacattaaaatgaccaaaacttgttttactgaacatttggagtgctgatacaatatacaaccacatcccctagggagagactaaaactgaattcaatttacagtactatctgggttttacattttggatgtcacacaagaactcgattggctatttcttgccatttcggtattagaaatgcagggcaatatgcttcactcttccattgtttactatttccataacacttacacttgacataagattgcttaaaatacgcagctaaacacaggaggcatcagaaaagtgttaaaaaaaggggtttccaccaacttggggcaaatgactttggttgatggggaaactggcattctgcatctgatgtgtaaccttaacatcatgttgttggactatgaactgatctgcaaaatagttattgtagcatgacatgatataataaggttttagagggaaatcacgatggagttaaattgaattcagaagatggcgaaacaaagtaaaaaaaattacggttgttcgtcgtcattggtggcagaatttgtggagttatcagatcagaattaacaaatcctgtgaatggagcacgcggcagcattgaagtactacccgtatgcggtaatgctcctcgcatggaagacaaagaagggaactgtacatagatggaaaaaaaaaagatcttcatttacctaatagaaaacagtaaaaatgggtatccttcttgataacttagacattgtgattccatcatgtgctaccatgatcagtaaatttcaagaaagtgacacaagtagatgtgtaacaatacaatataaaactcaacagaagaaatgcaaccacattcaggaaggagatacaaggttaaggaccataaaggcaagtcaacagtgcattcagaatcattctttctcgctgggcctgtttagaacaattcttgatcaaagagctgggaattcccacatcaaaggaaaaatgatgtcaacaatacgcagaacctatgtggcaaatgagtcaacatattgtatggccccagtgcatccggaccacccagatcttatctaattctttactactcaaacaagaggtaaaactctgtcatactgtcgatgcatgagaagatgagctagcaaggaacctttggcatgttagccaaattcaatgaactttggatgaaaaaatgaatgtcttgaaagggcctaatcaacaagatgaaaaaaggaacaagttttttttttagaaaaagaaaagaaacaagtaattgaatctgtgaactggtatgagtatgacatcatagaacttacattggcagctcctacaggatattgcatgttgtattgtccatatcccatatttaactgaggatttgctctccaatccccacgtttgcagcatatgggtggtaactcatggtaaaaatatcctacaaattgttctcgttttagagaaaacaaatatggagcacagtaagttattttgagcatctattacctctggaagtgcctttcctctactagatgtggtgcacagcaggtctctgtgatgctagtgttcctgccaatatatttgagccatgatttgaaggaagagcatggctcccttgtattgatgcttgcgatgcggctccccacaactgaaaataatcatgcagcaaaacaaaggtctaatacaattgctcaatggaaatagttcttcttacacaatatacaagcagagagctaacctggctattaaccggagcactattagctctgtttagtggagaactgtaagactggatattatctgtggggcggaaaaagaactggttctgctgactgccgttatttgcttgggaaaaagacaaggacttggtactttgcctggttggaaaactaatttgaggtgctgagacagaatttaggatctgaaccagcggaccgttcaaagaattggtactggaaattgaagtggctgtagcgtttttaggagtagtgtcatcaaaagtagcccaaccaacatcaggtaaaggtgagctcttctgcacttcagtttgaccaaaaccttgatgaggctcgaaatctgaatcaaagtcaatcaaacttttcgatatttctaatttaacatctgttgtagtttttgaactgggatcagcagccctcggtggcactactttctgcaaaataggacttccacataaatattttaagttaaagatatcattccatttttactttgttttttgtgacatagaattcgtctgacttctgaaataggacaagtattctcaagaggcaagaccactgttaggacttgggaatataaatatggaaatccctccctagctacctaaaataatgtttccacaaaccagataagaagagcatggcaaaacctgtgagctagcttacaatatgacatattgttggtaaaagttgaaatcaagaataggaccttatgtaagaggaaacaagaagagaaactatgggcaaagcatgcaaacagcaaaagtaagatcagcaggaattggattacctgtatttcagcaggagtggtagatgttgtggctttatgagatctaggagggtcaggaagccttataggcagaacttttctattagtttctttggaaggttcaaccacagaagatactgatttggtcgtatccttaagattattttctgagcttccacctgtcttttgaagtccatccaggtattgatgtttcccagtgttggcattttccctttctgtagtggttctattcttttgatccactttagcaggtactggatgcttattgagattgtt

SEQ ID NO: 60343 - DNA, 963 bp, Oryza sativa
ccatagcttcagtgtgcagagatatataagggcatctacaatcaaggatactacatgggcgccttcactaactgaagacactgtgtgggaaacacctcttacaatggagaataccctggtgacccaatgagtatccctaacccaaaaagcctacgtagttattttactgtacaatcctctcttctcccatactccctctctcttccccatatttactccatctaccggagacgacccggcgaaggaagttggttgttgtttgcgaggctacgggctggagacacgcattggtgatggcctaagtattcctattgaatgccttgcactcaatgaaatggcatccgattattattaagtgagggcaacttggtcattttcccttccgctaatttgcttttgaaaccttaaagcgtcatgctttgtgggacagaggaagtagtattttcaatacaaaacaaacatattatcaaaatatattcaatattatatttaataaaactaatttaatattttagatgttgctaaaatttttttataaacttgataaaacttaagtttgacttaaaaaaaagtcaaacaacttatcctatgataaacagggagtagtaaagtacctcctaccgaataatcccaacttcaagggtgaatctacaaaaagcgccccaagcaaatataaaccgccataaaccgaactcttggatccccgaagaagaaacaaaccatttctgggtcgcgctcccacgcccagatccccctcccatttccggaaaaggaaggaagattccgaggcggcggagcggaagggatggtggcgagcgagacgaaccagaaggcggcggcggcggggagcagcatcccggagggggcgcggcagctgctgcacgagctggcggcggggtggggcgacgtggcggactgccgggcgctggaggtggtgccgctcaggggggccatgaccaacga

SEQ ID NO: 60344 - DNA, 1403 bp, Oryza sativa
ataatctgataaaaagtatcgagaagtacaccttggcaagccatctcatttgggccctctggggaataatttcggtttggtttctcctcagtttcacttgcctccaactgtgtaagactgaacaccatgtaaacatccaatttacatcttttgcaggagcatgtcaacgatattgacttcgactacatggggtatgcgaggcagaggttcgagcagtactggctcaagaagcctgcaatcctaacatgtcaggtcgttgaataagcacctgcataacatcaccaggttctaccttgatggatatccaccggccgctgcacatagcttgtttatacataggggatgtgaaaggcttaaccagagatcagtgagatccaggcttctgttgtccttgtatagctgttgggttgttcatagtctggatgggagacaaattaataaatcttactacaaactctcaagggatgtatcctccttgtttgtatgtcatttaaatgattataaagaatattaaaaaaagatcaataagatagattaatatgtgatagatcacttcagaaatatgttctacatggtataacgaaaaaaacaaactaactagttgcagtttaatttttttattgtaatttgtaaaagttgaattttaacttgtatgtttgtaaaataatatatcacatattaatttatcttcttattatttttttaaatttcttttctaactattaagattacatgtaaataacgagaggatgttctctcaagccatattaaagttgctgctatattgatattgctgatgttctgatatgtcaacttacctatcatatatcctatgcgccgctgcctcctctcccgccggccgccgcgcgcgtcagtggcatcaatgtcggcgaaggtgatgagcgtggccacaatgccatggtggtcgacgagccaccgccacaccctttcccggacggtcgctgtcgccgaggtgcgcgcgtatggaaagggaggaggagaaaagcaagagggagaggagggaggaggaagtgggcccactgacatgtgggccccactatcttttattttattgtttgactgacatgtgggtccaaatattttgttttaatttttaaattgttaaattttgcttcatatgccacgttaatgccacataagacgaatatcgagtaaaattagccatgtgggtgccacatcagttgaaaccgtgctccagaccgccttggacttaccggttttaatagttcagggacccattgtatatcgttttccggttgaaggacgaaaatcgaattcgttgacaaattaagagacctctgatgaacttatttcataaaatagttttgaaaatgctcaggctcgagcgcccgatcgggtcagtaaaaattggaccctacact

SEQ ID NO: 60345 - DNA, 1442 bp, Oryza sativa
tctcttcttatctgtatcaggcaataatagagccgacaaacataatatgaagattgaaattagatagaagtaaggtagattcaatgctttgtggtacctagcactgattaagacgacgaaaggggaacaaagaagatgttgcccctgtcttgtaagtaggaatccgcaaagaagagttgaagatgagggaacaatcagagaaaaaataggtggagatgaaaaatggactgaagaagatgaaagaagagaaggatggtttctcagaaacgaaagagggggagagctagggagagagaacttgctagagaaatggatagtgatagagcaggattagagtatgggggtctggaaagaataggggaatagcttgccatgctgctacctgtgttgtcttttccaagtcttttcgagggcaggtggcagctgagcataattatgtttattgttttcatactgtgtaggttgggtgatgttggttacggtttggagaacgaatcaattttgtttgccatgtgaattgtgtggtttaagatttgggttgttatgtctatctaaaacgctggagctgataagttttttgcacgcttctatgtgagaaatagcacacatgttacgatagtttaatagcagtcaataccagctatgcgaggcaatgctaacatgcgaggagatataatatttgccaccatctgttagcatccaacatcattacgactgatcatgataatctagccatacagagttatgttgccattgcaaaagctacagtttgttaccatctgacagcattcagcattatcacgatgaatcatgataatgtggaatcccagccacatagataatggatgttcacctaaaagtctgtttgcaaaaggagtaagtctagcttaattggtttgacatgcactcatgcaacacggcaacaacgcagtctctagaattatcataataacattagccatagattccttttgatcggtgtgaagaaaagccttttagtaatgctgggcttctcaggatcaaggctaacagagcaaaaaacaatagccattctgcttgatgtatcaggccttgctgatggcactgcaagtatgtaggaaacatcatgttagagatgcagaagaatctttcatataccgtcagagacaaacccactatcattatacctgccaccaagggaaccatcagtatcatcagcagcatcatctttgaacagtttcttagcagcacccagttccaggagatggcctaggcctgtttttgtgtgtttcggtttccagttagctgggcagaaaggtttgcacccggtactctgatggataaagaaatgaagtgatgtacctttttttgtacgcctttgaggtgctgttcttagttgcaggggcagaagccacttgtgtaaggctgactgcctcatcatcctatttgacagtagatagagt

SEQ ID NO: 60346 - DNA, 7766 bp, Oryza sativa
taattcccttcaacactgcacaaaaagaatcagtttagctcaaaaaatcaggacaaagtaagctaagagaacattgtctgatagcgaagtgtagagaataaacctagcagcgagggtgttgacctctggcacatcaatatttatgtaccatttgcaagcagagttacccgacaacgaaacattccctataacaacagtgtcccacgctatgagaacaacagctgaaaacataggacaaaatgcaagcaaggaagctaattgacttacatccatgtcccctgacaagtgtgccaacaaagataactatctgtggcttctccttgccagcactgagaatttcatctgcaggaaagcttgtagctctttctccccataacacaatatttgttgtctcatttctatgttgtgtatgtttaaaagaaatcaaagaggaattgtggtatggtaagtagttagtctcaaacccaaaacagtggtgtgttggaataaaagcagttgtcagggcaaggcaatatgcccagtatgaaagaaaaatgttatgacagtgattgtctgatgtagatgacagattatttgagaggggttagaaaacatcagaaaatgcattaataatatggagtagtaaataagggatgagtgctaactcagcattgcgcatgtagacattcctttttaaactgtcactgtctctaacacgtgtccgaacagttgtcacagatgatatgtcagtgatcactccaatcacatctgttattttgagagcaagaacaaaacacatgtgtgagcaaaccagaggtagtaatataatagataaccaattatagaaccatatctgcagtacctgtgaaagagtctttcctgtcgacacgagagcggagctcttggtaaggtgtgagagtataagcatagtgaccaaagccagcttgtacgtcaacatattcttctataccagtccatctggtgaaattgatcatcatcttgttgtcaactggcctgtaatgtttggtgcatggcttgacccgatagtaggtaagcaagtagaccttgccttcgctgatcagtggtttgaatttcttgccccatggaggataaatcatagcagcaatggcatatccctaatgaaacaatactgtcagtaaaacaaatgacatattgctcaggttttacagcagataaagttcgcaaagcaatcaccttctcaccaaccaaaacaagaccaatatggcgtaagtcgccttcatcgtcctggtcatgatattcccataaccttgatacacgtaccaatagagttggattcccatcaccgagctcaaggttaggaatctgtacttcacccatatgtaaacatagcaaaaaaaacatttggtttgagagatcagcgcacattgaaattttgaagaagctaagtgtgcaagttaagaggtcattagatgaatatacggaaaaaaattcacatggacaatgaagagcagaaaaacagaggcgcacaacagcatcaaacatgggtagtgcgagtgatagctaggtacaaacatcctgcaattgtaaagatttaatatattagtgcatggtatggcatcctggtaatttagctagggatcatccaggaaaaccagacatcaaagtataccatagatgtgactgcttgcagtacttcttggtaaacaacatttttggttttcgtacaacatgcctcgtcctcatcctctatgagaatcctaagaccttctcttgatgttgatctagaaacagcaaacataaagttgcccatgtgtgaacacaggttttttcaagtacacggctgactcgtgaaaagggtttgcccttggctcttgttaatcgtcattgcataacaaacacgaaacaggggaactgtcttctctaaagcgtaaaaggccacttaggacttgtggtgggtagtgcaattcgtgggtatgaatgttgtctcgccaatatttgtcccagttaaaattacacactctaacaacctattaccaagagaagtgaccaataaccttgtcccattgcatagacccatagattgatttaggtttcgtagtagcataatcgtcacaccttttttgagcacaagcttgtgcgatgggaagttgttgacattaattgaattcaaaaattcagggggtaaaggatgtcaaagtcaggtaaatgatctcttgattttgaaattgtatcacatattaaatactcctttgcgtcgctgggtatcatgtcaacaatacaatcatttatttcatcaactgttgagttattcgggcaaacaattgcccgacatgcaaggtaagaatgatctgtatagcaatttgcaaagtgtggaaagatctcatctactatagcccttattttgtcaccgcatgtcttgatcaaaaggtcatcagggatatcaatccatgttggctcaaattcgtcaagcttttttgttgcaggcaacctaccgtcaccaagtgctaggacccaatcgccaaagttgctaagatcgacacggttttggtcagtaacgttaccatgaagaagtctcatgtttattgtcagtctaagaagaacaacatgccgccaaagaggagagttcgtgatggatgcatcgactatagaagcacgtgaaccttttcttatgaccggcaatatttgacggaaatcacctccaagaacaacaactttaccaccgaacggaacaatgctgttagaaggcgtgtgctcagaaagcaaatcacgtaacgttcgatctaaggcctcaaagcatcgtctatgagtcatgggagcctcatcccagattataagagacgttttctgaatcaaatctgcaagcatagttcctcttttaatggtgcaaatgttgttttcatctatgtcgatcgggattttaaatctagaatgagcagtgcgccctctaggtaggagtagagaggcaacccctgaggaggcaaccgctagaacaatttttttctcggatcttattttagaaatcagtgtattccacaaaaatgttttgcctgtcccaccatggccatagacaaagaataacccaggcctgttttcgttcacccgttgcatgattgtgttgaaaacatttctttgatcagtatttagcctaggtatattcaaattagcttctgcagttagggccgcaacatcaagagcaagttcttcgtcaaccatcctatttcctgtaatgtcatctgaataaattgccggctgcggtaagtcgtaatcatcaatgctaccaccactgtttgaaaacacaatgtgaagttctttcattaatagagacaggagcctatcaggaggtattacgtacgaaggattcgataaagcagttctgacacgtcgctgaatgtcatcggtaaaatatgtccaatatttttcaaagagcgagcgcacatatccaacagaacaaaacattacaacgggagcaaacaactgtctcaattggcccgaagacgcagatactatagcctcatcaaatagcaagtgccattcgttatcgctttcaagtaggcctcttgcctcgcatgcttgcctaaaggtcggataaacgataccatcataggtcctaacatcagcatagcacgttgcacctttcactatcattaatagcattcgtaggtagtagagctcaccgctaactgggctgacatagtatatcctgcctattttttcacatggtgttctaggacgccaactacgtgagatgctgtcccatgtccactctctcggaaaatcacagtaagtaagcgttcgtgcactgttatgttttctgttagcctcgaaccactcggttagcatcgtttttttggctacagggctggatagcaaggactttaggtcagaaccttttttgtatcggacaaagttcatgtttggaaggtgcacagctaggcgttctacagaaggcactctgtagtgaatgtcaaattcaaatgcatgccaaagggactcacaggtggacagaaatcttgcatcgatatattcttgtatttcatttcgtggagcagtacagttttcagctggtttgttcggtgcatttccagaaatctcaaagaatgcttttgttctatccgcccctttagtgacatatttgaagagatatttaatcatattagatttattgcaccattctacattaatctgagcctggtattttttcagaagttccatgttgtagggaacaacccatctgttgtcaagtttaataccatttttgagaacataccgaccatcattgctacgtttgtaaacagtgaatacaaattcatccatgatggtctcttcttgaaaagatttagggaaatgcttagagcactctcccttcttcatacaggagcatgttttgttcacatcgccacaagggccatggatcataaattcatcaaccaaggcatagcctaaagggtcggttagcacatcaggtatttcagcggaaataaaaccatcgacaataggagcactaaactcaatatttcctgcagcaagccaaaccaggcaatggatatgaggaaggccacgcttttggaactcaactgtatataacactacatatagggatagccaatgttaggacctatacagaacataaaaatggaacttagaaactaggtaaacatcctactagcaaggactggaccaaatgtctttccttctctaatatctgaaatgaattcattcactttcatgttaaacaccctcacaatcatatcggaacgatcgcttggcacctggcctggctcaaacagcaaagcatcatatatttcttgccactttgagttgcatgtaaaggtcacaaaaagatcaggtgaaccaaaaacccgacaaatagccatcgcatcttggtaattttgaaccatgtaacgacgccctccagtaaaactggagggcagcacatatcattggccgacagaatccccggaatcaagaccatgatcaatcgcatcagctattccctggacagattcagaacgcaggtcgggctggttgtcgaaaatgtacttaagcctagattactcaacagttgagtatgagtcaacacataaggaatcgctaagacgaccacagcaagtatatggatttggtttgttcaatcggtaatgtaaacgatagtggtagtactcaagcatggtaacatagcgtctggaggcaccagtgatgctaggaaagtcagtgtactttatacctagatggaatcctcgttcaccataaggaaagagcaaagggtactgaagagccatataggatgggtgcaaagctgagacacgtcgcaatctagcatcgcaagactaaaccatcacatcatacatgtattcgccagctgagtaatctccagctactataccagcaatatcaccactcgttggcaaattgtactggatttcatctcttgaatcacaaccaagcaatctaagtgcaatcttttgatcaccattatcttttagccgatctctagcaaagcggaatgccttaaccaaatcattatgctcatcaagcatagaactaagcccattaacaatgtctgggtctggttcatcagaaggattgtctttttcgtaaatattcattctgtttgcagtttcattttcagtgtcatatatgtaaagttgtgcaaatttaggtcgtgagccttgctgtggcagcaggctgccaatacctttgtggacaacccctttaatcttgaacccacaaggtgcggtcccattgtttatcgtcttatcaatgttggctcctgaggaagtaaacgcaaaaagagagttatatgatcggatctggcgtaagaatctttttgatcgcacactaccatcaaattttaacagttctgctagcaaagaaggtggttttttcaattcaggcagactaatcttaccacctctacagcataggttgtacagaatcttgcgctgcgagactacagatcctttctttaccctctcctggtaccagaaaacggcaccgcagtgtggacattcatgagatggaccaccatagtaggactgatgagggtacaaagctgcacagcattgatatgagagtacgacagacagtaaagctgaagaaattggtgtagtatgcaacacaacaaacctttcaaggacgcaatatagtcttttggcaaaggcaagatgtcatcagcactgggcgtgggacctatgcgaaccaaaattgtgtgcaaaataagcagtatgcggtgagtcaacccttttttaccccgcagggacacatggaaggcataaccaaggtaagggacaccgaaaaatcgtaccgttaagaataccatcgagagaatggtttgtctgaccaccagatattttcatacgccgcctttccctattaacggcagcagcacttcgtggtatatctagcaatgaacttttccctatgtgttcaaaaatacttagagcactatccgagcctcgcttcgtttgtttggtcaaaatagtttttcggtttattttatcaaaatctggcttacttttggcatttcctaccaaaggctcactgtcaatgggctgttccatggatggtcctgcaccagcactggtaccctgctgcccaacatgtacagattgaaccaggacagaacacatggaatggttgactgactgtgaggagctagaacctacggcagcaaaaatgggagcctgcaagtagcctattggaccaaaccaatatgtttacttacctgtcccagaaaccaaaagcaaacatatatcagaaacgcatggacaacagaccctggcctatggaagcatgccgccttagccggctttcacgtgcgcgctgaacacgcaatgctgcacgacctgacatctgccacaaatcctaaatcacaaaacactgttccctgcaacgtttcttgaaagacaaatgcatcaaacaatccagctcagaacacaatctcaacgcaagcatgtatacacaaaagaatgaatgcacggaacagaaatagctaaattaactgcaaggatcctggcaatacaaaccaactcagcattacaaagtaaacccaaactctgctctaaggttgttgtgtgctatagaagaagtgttcttccctaagaaaactaaaccaaagtgatttgcactggcccagcacaccctcacacggcagatctagcgccccatagcgtgactggagcctagcaagacatgaagccgctgtgagagcagcatccactgcagaggatgcaatctttctataggaaagcagcatgtgaaaattgtagtcatgaacagcgaaccggtactttgcttgcatgaacctaacaacctgctgagcaaccatctcgtgtgaaacaattagcggatctgttgcagcaacccaaaagaacttcctagccagattgttggatgggtgagcctgaccactggcagggtcttcaggcggaaggataagctctacaccagctaacagcgtaccatgcccatcaagctcccaaaggtatgacaccaagggcaaccggcaatgagaagctgcagcattcaacaacgaaacgaacgaaaccccaacaacggccatcccaccaacagcactgcgaattgcagagagagttttcaaacaggagataaaccacccttaaacagtactttaaaggatgaaggtgaggaaggaggcagtgtgcaagaagaaatcgtcaagaagcaacatatagggcaagtatacagggccaagaccaggagacactatatctgtccctttcgtcaagcgtgggaaaaaaagcgctgacgatgcgtcagccccaccaacgggttagcgccccccc

SEQ ID NO: 60347 - DNA, 9769 bp, Oryza sativa
agagaggccggagaagaagcgaaacaaaagggacagcaagacggaagagcagtacagtcgaagcaaagaggattaggctggagaagaagcggaagaaaagaagaggagaaaaatatggcgcctttcttgcgtgggacgccgtctcgggcagatctgtaccacgttgtctaacaccgattggccaagcagtacatttgtggggcccacccctctgtccacaaccaccctcgccataaaaaatgggacccacacgtctgcccaccaccacacgcgcgatcaaaaaacgcacacctgggcaattttcacagggcaacatctacccaccccaactatagcagcagggccacccaccgtacacagcggcagggccacccatcagcgaccgagctgcccgttcccgtcgaatgcgcgcataaggaagagggaaaaaagggggcgaggagggggcgaacatgggggcagcagaaagagcagcatgcagcaagaatggtgggagcccacaggacagaggcacatagaaaaaacggtgcagccccacaggacagagacacaaaaaatttaccgaacgacgtggatgcaagtgcaaacgaacacgctagtgcaaataccgcgcaaatcgctccgggaggtgcagatcgcccttacctttaattactctgattatttaaaaggaagagaagggatctttacaaaaatgcaaacacccaacaacatgcattgaggtattttatatctcactgacaaatggcccaaactaaaaaccaactgaattttgctttgcacataacagcttgcctcttgtatcactgatgattggtccaacctatggtggaccccttgtacagtctatggagccatgcaacaaccaaagagtttgcatctatggagagggtaaagcgaacggtaaagtaaagcatgtactactactactactaaccatgaacagtgcaacagtagaagtagctacgtggatggctgtggcagctcaggctgtacctctctaggaatatagatataggtagatgagcccctagtaaaataaggcctatttaatttgaaatacgcgtgcaacaaataacacaacattctctaagtcattctttaaaatacacgtcaacaaataacaaaatattcaatttaaaacacatttccaagaaacaacacaactttgttcatgtggaggaggaggtcgatagggtacacacaatacataaattgatgacattgcacaacttcattccacaaacaaacataaccctaatagtagacacatgaatgagagcacacacttgtctaaaagaaaacacgctctaagaagaaacaacatgtgattcttcttctcttccatgtcaggacaggaactgcatgcattggaactaactgaggaatggaagaatgatgatgggaaacatagcgtgacaaacaatatatgagcatacataaacatgctcttacgccaagacatgtggttggacggccggttgttgctgtatcagagagggcaactcaagccaaggtcctccttatcagctgcatattgtcccctgcttgccgcaacgatgccaggtgcacctagctgccatatggcctacatgaccacaaatccaacaatggcgagggcattccttgtagttatgcatcccttacagaaagagcacttctcccagcttgcgcttgatgacattgttttgtattgttcgagtttcttctttgactgtatgattatgagtttggcaatagactttgtgattatggatttgagactttatatacgagccacaccagatcaccacgggcatatttagtatatgacaagcgggggccttggccccttgtcaaatttaactttatattgtatcccacatgtgtctgttatatgggccccaaatcacatgaggtatattcaatttaaaatacatgtgcaccaaacaagccattgatattcaatttaaaacacatgtccaacaaataacacaatatttattcatcgaggagtaggtcaatagggtatacacattacagaaattggtgacacgacacaacttttttgcataaacaaacataaccccaaaaaatacacacttgaagcatagcataagcacaaacttaattaaaatgaaacacactctaaaaagaaactaacacatgatcttgtccttctcacatgtcagggtcgacatctcgcttgtgcatgagaattaattgaggaatgaaagaatgatgatgagaaacattatacatgcatacacaaacaggctcttaccaccaagacatgttatagagagggaacctcaggcctcgtcccctacttgccacaacgagaaaaatgtcaagtgcacctagctgccttgtggcctacatggctgcaaatccaacaatgacaggggcactccttgtagctatgcatcccgcacaaaaggagcacttctctctcttgcgcttcatgaaatttttgtgttttttgtcacgtcctgataaattcatcccgaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagccctcaaattttacttgaattttcagagcacaaataataattattaagaaataaacaaagttaaaaaggttttataaaaagaaaagctctaaaaagtctttttccccccccttccccctcttgggccggctcggcccatctccctccctctctctcctcctccccgcggcccactcggcctctccccgcgcgcgcgccgctgacgggcaggcccgcccgccaccctcgctgacgggtggggcccacctgtcatccctatcctcccgccgctcccgccgcctcgcccgtgccctagcgccgccgccgccgcgaatcccgccgcctcccgccgtccccgcgcgcaataaagagggggaaatcactccccgtgattccctctctctttccccccatttttctctccctctctccctcggattcggttggaaaccgctcccgcaaacctcgctggcgccattgatggagcccgagatcgccgcgccggtttccttcccctccggccgttctctccccctcccaacactatataaacgctccccgtgcctcctccgtccggttccgcctctcgccgcccttcctcttcgccggatttgagctcgcgacgtcgctctctctctccgccgtcgccgccgagctccggtccgccgccgtcgtcgccccggacctcctcccgtttcggcgtcgcccttcttagggttcgccgcaacctcgccagacctcgtccacccctccgtttcgcccgccgaccgccggaacgccgccgtcctcgtcgacccgagccgcgccgccgccttcctccgctccggtcgtcgttcccgtcgccaccgatcgacccggggtgagccgtggaccgccgtttcgcttcccccttccctcccctctctcgggcgccgctccgccgcgccggtggtcaccggcggcgaccatcggggcgcgggtgcgccgcctcccgtcggctatgccggcgtggccgccttcgggtgcgccccgcggctgccatgtggggcccggccgtcagccgcccgcgccctcgggtgcggctgacgcgtgggacccacggcgccggccggtgtgagccgggtgcacccggtccaccgtggaccgagaggctgccgcgtgggccccactcccgtggacccggtccgcgcgctcctctctcccggctgacgcaataaatctattttaaattaaattttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgatttaaattaatgcattatcgctttatttaaattcccgcgttatcactgttttatttagccttgcctatttacctttgttatggccttattattattgctattgttattattaccttgttcaccctagaataaacaaaaccccaactagtgggtactctattcatggttccactagtataaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaataaaggctacacgagctgcggcccggtagtcgagatgtcatggcacagggctggtgtcctgctgctagggggctcaatcctgcctgcctgtcccgggggttccggccgtaggtggggttgggtcggtactcttatttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctattattatccccttctacccccttacattaattatgcatctccggtgtggcttgctgagtactgtggttgtactcattcttgctctatctttctccccccttcagtaagagaacctttggagaagaagtcttaggtggagtcttggcttataccccagttgagcgcctgtgaagatggagccgtaggcccgctagtccgctgctatttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaagctggtatcagagccatctcgactgtaggataagccaagtggataaaacctaaggacatattttataaataaaactatttgcgaaagttcctctttttcttcttcccctaatgctatttgcaaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtgctttgcatcggtgggtggtgatgtaaccatgctaggttggttgcttaatcaacttgcagattaagtggaaccaacaacacatcaaccagaagagttagttcctttaaggtcttatctctagttctgggctattctttcctagcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccgagcatgctgcttggttcacagctaccattggttggaagtcaagaccaaaatcagtatgtgtttgatcgagcatttgccacccaggtcgatgagcttccaatgccagaagaggatgtccccttttgtcacgattgtagagagcaaggacactatgccctgaattgtccatgggtatatgccaaagaagctccttcctttggtttagcagggcaggcatcgctaaaccagcctcctcgcaccaagtcaagcttgcagcctagtgtgccaagtagagagcccaatggagagaatccattgaatcccgagaattgctttcctcctagcctttcgtaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacatcaaagaggaaataccttccgaggtgcacgacagttgacccagcacctcctaagccatggtggcagagtatctgatagtgaagggtcagatcaagtctcctcggatgatgaagatgagtctccccgacatctcggcgaggaagaaatggaatcaaaggcatgcacccgttgtggagaaattggacacgttgctagcatgtgtcttacactctgccctcattgtgaggaagaccatccaccaggtgaatgtcccacccgcaaggtgacatgttttctgtgcgaaggtacaaaccatgtgcccaaggattgccaactcagtgtgttgttgaccaagaccgcagaaatccaacgaacaaccctacggttgtctcatcagctagtcagctccaatagcaacatcgacaatatcatccacaacaccaatgctcctcctgctccacctgactctgcaataaatcatagcaataataccttcagcaccaaccattctctgcaccgacagcctcagcaaagaattgttgtcgatggaagaagttgtgtctctccccgacctactccaggccgagcaaagggcaatcaatctcaggagggcgataccaagcagaagaccgttctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggttttcagttcgctacttatcattgtgtaatcgggagtttgcagcaatcatgtaataaataaatacattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttttaagaggattctattggaagatgcggatatgtgatcatgtgtataattgtttactgataaaggagacctagggtctcatttcagaggaatcatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcgggtatacctacaaacagttaagaagatccaggggacatcaatatttgagaacatagtagtcgatggttggtaattagtctatcaggtatcagaaaagggtcaaaggtgatatggcagaagaacaatttggatgctccccatctcgaggaagcactaaagaggatcatcggcaattaaaccctagtggcatagatacagatagcaagcaatgtatttccctgaaggtagtcagtgcagctttttgacgaaccacatcaaggtttcactgaaaggcagcaagccaaaggacttcatcgtcaccagaagcgtccgcaatccacattaaagagtaccacctgttagagataagccgaaagaagattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgaggcatcatgaagtaagcaagacgacctaggtaaaagtatttctttgaaggcaaggaatgaaatctttaactcggtatcagatgctacacggagtgaaaagtgcaagcaccggttaccaggcaatgccatgtcttgggagatgatccaatgggaaagagcacatcaaggttaaaggtgtaaaggaatacgttgaatgctaactaaggacaacctgaagataatagtgggaaataaactgaatgtaaagaaagtgaatccgagttgtctgttcatgggaactattcccagttatgaaccaagtgatatgttcgaagatagtctacagaggtcagacaacgaagcttcagatttggcaggataacgatcaaacaataagaaatccagcaataaagccatttgggaagacgtcaaagtatgtcaagtgggataagttggttctcttgggaagcataattcaaaggcaacgttatcgacccttgcatcaaatagcagaagtagctattacccggagaccgggaaagctaatatgaggcagctggtggcaagttagaagtgaatgacaagcatgatattcttatgatgacaaacatggtatcctagtaatgacaagctagtgttgacgcatgacatgaagtggtaacttccatgaggttgacgccaaaaatatggactatgcgaagttctggaactgaagcaccatcttcaagtgccgcaacccagtcgaagtcagctaaaggttcaaccagggacaagtcgggtgaagagaagattccatctgcaacaggagatcgagccaagcagtccagagtggagaagttttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcaaacactaaaatacgtacaagaaaaattcaaatgcggccccggagaatttttgttaaattctccttggtctaaaaggagcccttaaattttacttgaattttcagagcacaaataataattattaagaaataaacaaagttaaaaaggttttataaaaagaaaagctctaaaaagtctttttcc

SEQ ID NO: 60348 - DNA, 17216 bp, Oryza sativa
tattgtatagctctaggatcgtgtttacaaaatagctttgggcaactaagtgacttttaaatgctgtttactgcaaaacttaacccctattattatccccttgtacccccttgcattaattatgcatctctggtgtggcttgctgagtactgtggttgtactcattcttgctctatctttctccccccttcagtaagagaacctttggagaagaagtcttaagtggagtcttggcttataccccagttgagcgcctgtgaagatggagccgtaggcccgctagtccgctgctgtttatttttgattgccaggcctgaaatgcctttgtaataatgtaaatattatcgatataataaagatgtgtcttttatatcatgtttgtgtggggtaccccggcttttccttggacggggattaatacactagcgttcgggaaaaggcaattttcccggtcgcgacatttttgttcgagtttcttctcaaactttgtgattatgggtttgaggctttatatagcagcaatagcatatcgccaaaggtagatttaatgtatgacaagtagggccttggccccagtaaaatcctatcttactataaagttatcccccactaactccttgagcttgacatgcaaagatgccacatcatcatccactaacaagatgccacatcatcatccactaattaacaagatgtcacatcatcatccactaacaatcatcacatttaaacattatgcaaacatgctatatctttagagtttttataatttaagagcttttcaaatacaaacatgttaaattatcatccaacataattcacataatgtttcaatgtacatctttattatgttttatgatatcctatatacttttatagttcatcctcacttagttagtacttaaatgattaatctatggtccaaattatctttctcctttttttcatctaattaattcatatcacatcacctgtttttagcctttagatgattaatctacagtccaaactatctccctacttttcttcttccataaagtcataccagcttactttttatgtttgaatcaccattctacatactatttaaatttaaattatcataaaccacattaatttatttaatctgatgttatctagctatcttacacgttatttttttattattatcatactaaattcccgcagcaatgcgcggggtttcacctagttttactttgtattgtacccccacgtgtgtccatcatatacttactccggtttagctaacacatcacccccactcctcgggtacttttcttttcttcgcgagcttcgtccttcacgtcggtgattcagcactgcgcatccactctaatcttctctccaattgaaatgggaattagttaaccaaattaagagaggtgaaattataccctacctaaatttgaggatctcaattcccaaatcctcatagcaaacaaagtgaaaagtaaaaggatattcatgtcgcctagaaatagggtgaatatgcattcctaaaagcactcgcaactgaatatacactcccgtcagagtatctgaccacaaacactagatactccgatcaacatgttctgattgacaaatttggtcaactggatagtctggctaagtaccagatattccgatcccctaacaacacctcctaaggagcttgtgtcgagaacaatctcacacaatgatttgtgaaggttttccctcaacaccacaagggaagaggtaattgagtgtaaactgagctagattgttacatcttggtggttgcttagaggctaaagtttcttgttggtttgctagcttggtgagatctacaatcgaaagagatctggcttggctccttggagtgttctaccacaagcgatgacaaatcagagatttaggaacccaatgagaaacatactaattaatgtcttatgtactgatgtttgtgatgcagaagtattatcgttctaccctcatagatttcttttttgctatataaatatgatcagaaatttgaatgccgatagcatgtatcattatactctttcataccagaagaaaccagatcttctaatttttatgtacttcaatttagaacttgtttggcaagactccaactctagctctacctcttctagaactggagcccaactaaaaaaagagagtggactggactagaatgatctgaaaaagaactagagaggtggagcaaggtctgggacgttccacaactcaactccaaactccgctccaagagttagattgaggagttagagctctcccaaacatgtccttaattggtctatcagatatattcagaattagggaggtatgaaaaaagaggttacgattttgcaacttccatttgaattttttttaaatctttacattctttaatcctttcattttaggtactgttcctgcttgatgggaggatttagattgaaacatgtgtaaactccctctattttcttaatagatggcattgttgactttaacatgatatttgaccatttgtcttattaaaataatatgtctcatttttttcttttataacttgttttctcatttaaaaaaactttaagtatggcttatattttttaaatttataatatgtttttaattaagacgaatggtcaaacattataccgatagtccattgcgtcatctatttaaaacggaggtggtaacatgaaccaacctaccagcccttattatgctatttctagctcttttaacagcatttaggatagctacatgcagttctattcatatgctataagatctatgcaaaaatattttccttccaggtcattcatgttttggctaggtttgggtatccgtgaagcactggttgttttctatttctatgtttgaaagcactatttaacggatctcctaagatttgttttgacaaaaaaaacaacaagagggcaaactttacaagagagattacataatttgaatttacaagaagtttatgctaaagtgtgtgtccatattgccaaatgggtatgtgttccttctttaccatgaacatatgcagggtaaaataattcctgaagttggtcttccataggttccatgaaggatttacatagttaaaatttttattatccatatgttccaagtgacgatgacatgacttcaataaaaagggctttccaaactaatttgctgcaagtacaatcatattaataaagttcatatgcaaagtcacaggtgaaaaaaagatgcatcacatcctccagggcagcactatacattgcataatacacactctggtcctccttggacgttgtattgtcttcttttcaacatatctctagtgtttaatctatccattaaaagaatatagagaaatacctttagattcattgtacattttcttttccatatcaattttatcggcagaggtggttgcaagtgttcataaaaaagattgtaaacttttttggtgctatactgaccagtgaccagtactccatatattgtgttctgagattattgtatcttgaattgtactttccatttattgaagctgttgtaaagactaaactgataaaggaagagtgaaattgtcgtctatgtttgcacttagaaaaaaaatcccttgttgattgatcttcatttctaacaaaaccaaaagatcagggaatttttcttccaacatatgaccattcctgttgtctttctagcaaactattgtatccctattccgaatgttattttcgatatagctctatagagtggcaataatcagaagatgtctttccgccaaaggaacctttttcagagcaagcatgcggaggttgctgagattggtagttttctgtccaaactaacttgacccagcgaagatctcttctattataaagtttatccagttatttcatgagcagcgctatattatggtgttccaaattaatgattcttaacttcccttttgtttaggttttttaccctatcctaagctgccaaagaaccactccctccgtcctaaaaataaaccaatctaagatgtgatatgatattacatagtacaattaatctggacatgctatcctagattcatttatttttgaatggagggaatagacttgagttgcataccattttctcggtaaacaacacctccttgctctgtctttatgttacatgatttttttggaaccttcaatgtacacatgtggtaggttggtaatgatgaaaaaaatagaattaccactgttaactttgaccatgtgataaataaatttctatggaagatagcctcctgtcagttctatctataagtggaccacagtcaacaactctggactttgttgtgcaacccagaattcctgctatatgatttattgaaattaattttaaggcctgttgactggacatgagtatgaagaagggacttaagaagaaaaaaaagcttatttttaatatacttttgttataataatagtatcatctacacattgaataactggaaaataaccatcttctcctaagattgttgtgcaggttcaatggtcaatgtacttctttccgaagcttctattcttttgagcgctaatggtgtagagtaatagcggttgaggtaggggagtttccccgtaggatctgatgtcaaggtctctgcacatcacccgtgagccatctctgtgcttccttgaggttgccactgccacggacgaaggcagaaaaatctcaagcctagggctggtctgattggacttaagtattttcacaaatcgtgtggtattttcacatgatttgcatggaatttcagagctaggtctagggctcaatctttaagcccacccccagaattttaaattaagttgtgtattcaaaataaaaaatgggtcaaaagtatgatatttggcatgtataatattacatagtattgatggtataatacatagcatacgtattatgtgttggatacaacctcttgggttaaatacaacaactcattttttatacgcacgcatcacatattatatatatatatatatatatatattgtaattaaaaatatgggtattcatcctaatacccttgaattgtgttggggcctcccccgagcagcagaggccaaggaggtgagggatgtctgtcgcattatttgtgtttatatgctctcggctcacaatgttctcttacatgggccttatccaatgacatgggcagccttcaactgatctgagttacaccctcacagagaagcactaactgatatttgtgatggcaatgacatccacctccctcaactgcctttcacatcgcaaagatgtcctcacaacacaactttaaagcaaaactggcaacaaagaacaacaatgacccgaattgtttgaatattcttttgcactatatttgaaaaaaattaggtactaaatatatttattgtaatttttgttttcctgttgtaacgcacagacattgtgctagtaataaataattcttggtaaattatatgatatatagatggtacagattgtaatatctttgaatacattcagagatatgccaaattatgtgacgcgtggaatggatggtacagattgtttcgacaagatgtgttttattaatgatttattcaaagatatatgacttgtttattgatttgcctggctagattaagccaaattctgatgatgtttttctgatggcgaactcaaacggcgtgtctgaagtggtcttgagaaatgaaagtgacgttttcctggggcagccgtccacttttaccctttactgtgtgatgctacaatggcagaagcgttggcatgtccttgagctatgcagttagcatctgaattgggtgtttcaaaatcaatccttgagaccaaacagtctggaggttcagaagatggtagctgatgagaaagtcagcagatcaatatatgtagtaataatccaagatttgaagcaacggctaagtttgcttcatgatttcaggatcaaatggatttgtcggtcagccaatatggcgtcccattttttagcaaagaaatagtgtgctacgaatttacttcgacctatttctctgtctcaccagagtgtttaaggtcccagattgttaaaaactgtaatcaaaccggttccgctgaaaggaaaaaaaaaaagaaacctaagctgtgatgatgcatgaacatcacttagagttagatttgaaatctatttgctgtttgattcactaaatctttttaaataaatatcaaaccttaaagagtaacgtaattgatttgatattaattttggcacagattttgtgaattgcggccatgaatttcagacctgaggctaaaatccatcaaatcctccaaaacatcatttcacaatatactgatgcacacatggcacatcaccagtagtttcagtgctactttaattgcaacatgtataggcgtctctatgatgaacaagatataaagttgcagacccatttttttcattgtcaactatgatgtctgttaagtcaggtattctccgaaaacttgagataaaaacgacatagatatgcttcgtatacatacacatgattgcatattgatcaatcccctatggaacttgatgaattacatatccatttaagtagctaccgtttgaggcgcctcaacactatcaggaaagtatcaaggcagagtgtgtagtcatcgaaggcacttattccacaaaatttaccacgagtcaaaactaatttgtcccctccaatttgaagcctatcaaaggagcaagcgttggaaacctttacaccatggccaaagttcttgtgtgcctgccaatgtacaacaagtgtcaaaaggatttaacacaatcaattaatggccaataatgttgcgagattagttaaaaggcacagtagtatatttatatatactgtaccatataataaaactatgcgaaaactataaagtattccccacctccccacttttttccaatctgtaaggatattcaagaaacagaacaaaattagtgatagtttccggatggcttaagtggataacatagtaattagcaattaccattttattcacttcaatttccatttccatttaccaccttattaacaccacgtgcgatgcatgtacatgcttaagactgactagtgagtgtcaactatggtcattgccaccaaattattgggacataacagtaaacaatggttcaaaaagagcatgagctgaagggaagatctaagtcagatggtaacaattgatgagtttagaacagatgaagcatgaggaatcctgctttgtttggcctatttgatgcatatccaactgacaacgggtaaggatcagggtagagcaatgttgagcacttttgttctacatctgtacaaactatgaatgaattcaacatacatcaactgccctcatcactatataccatcaaaatacgagcgcatttctctatgaaaattctgtactacagcttaagttcatgatcaaacatcaaatattcaagcatgaaacaatcaacatccgcataaagaaaagaaaataacaaatagcaataagtatggactaagaaaatggagtacatgggaatcaatgataactaatttcaagctgtaatgttgcaagatgctttcaaactaaattaaacttacaaacgatatgcccactattttagcatcggagttgctcatttgttgtgcaatttgataggcacaagataaactgcctgatagaactcctctgataaccccattctaggtctaggagtgccaaagaaccatatagatcttcatattacatagctaagatcaaccaagtggaaagtgcacaacagtaaacatcatattacgtagttactgacaaccaatgaaccagaacctgtcagcccataccttagaatgtatgaacaatttttcatatttcaaactactgtactctagaatttcattaatctgataggaaatgaagagggtggcattcagtcaagtctcgtgatgttaagtggaaaaaaattgctagatactacagcataccattgtgatttccagcatgactaaccaagaggtcaaaagttcccttgagaaaatacaattccttagttcactaattaaactcgacagagagttaaatgcgggtacaagaagtgaacaagatagaaaacaaccttcctacaaattgagttatttaggttctcttaagacaatggcaccaatagcaaccactggagcaatttttatcaaatatgaaatatctacttgcctaatcatatgacgacaagttaaattacagatgaaatacaaaagacttacttgccaaggctttatcattgccatatttgggttattggtttgaattggtaaggcatcgatacataaactctcagtacgaaattcaggtgagaaggcaagacaagtagacaactcaaactccatatggtaattgtataaaccaagcaaaggatttcaagaaaaaaaacaaaaatgtttgattgatctagccatgaatattacagaagactctggagaacaacggtgtttcttcaaaatcagtaatcaataccagatattatcaatgagactcagcatagaatgccatgaaaacttcatccttgaaaatacaaacaaacaggatgactgttgataaagatgtcggtgtaacagcaaaaaatttcatgatcagatcattagaataaagtaggataactttggttctgtttattctacacaaactggaagctgctaattgtaaaagagttgttattactcattctgcagccaactggtatgtccaacatcattgtgcgtgcttggcaccaaatataattagtgtgtccagcatgcaaatctccccaaaaaggtaaaatagttcttttgccccatagtttagtgtttgctcatttgccagtttccacattcccagtgaatgacaaccagaactagggaccacatgtcatacacacatatggggcaaaagagcaaatgccatcaacttattgtgggacagaagagcaaatctccccttggaaaattggtttaccagccacaacggcaactgatattaagatggtcccagtccagaagggaaaaaaaaaagtcttgcatggtgcaccattcgtcgaaacaatgtttaggtatcaactcaataatctcattgcgtagcataactacaaataatgggatgttttacttctggtgcgccattcatcaaacaatgtttacgcagcataacaaaatagaccaatattctagtggagcgcttagcttgcttgacatacatagctcctaaagcgtaataagagttaaacaaaagtaggatataaaacttaaaagcacggttgcataagaaagtaaagaaactcatgacacagggcaaaaaaggttgcaaatcactaaataaataaataatgcgtgtatattgctacagaaaaactatgtgcacagaaagttgaatcgcacctagctcctctggacatattactgtgctgttgcctcaaatttccggagcatgtcgcagtgcggcgtctcgtaggaaagcccccagtggcgacgctgcacctcaaccctacaattctgtgagagtattgagaagtaatcccgctcaacatgccgttcgagtgttgcacgctcagtgctctggtgtggatactgctcctcaaagttaggcaacttgacatagtatgtgactccacgtgtggtttggaatttgtgctcataagggtaagagcgggacagcgagtagaccggttcagaagatggcaggaagttgagcaacagcagcaatagaacaggcaacagctgaataagcatccggagagtggagccaccggaattttgcgccccatggccatggtgcatgccgccagtcctgaaatgaaacgtcccaaactgcccaaactgtctggtggtggcaggcgccatcccgccaaagaagaagtttctgaatatctcatccggatcaaattcatcctcataaaacccattatacgcacgggcagtggaggcagccctcctgttgtaagtcaccggctcgtccgagccaacaaggtcatagcgcttgcggctctcggcatcgctgaggcactggaaggccttggagacggccttgaacgcatcctcggcaccgggggccttgttcttgtcgggatgcaccttgagggagagcttgcggtaggccttgcgcacgtcctccacagtgcagtccttctcgaggccgaggatctggtagtagtccctggtgtgcttcttgacctggcgcacaacctccagctgctcagacgtgtatgacctctcaccggcgctctcgtcctcctccttcttcttacccttctgcttcctctctctcagaccatcgctcccggttgcttcctccgcggatgctgccgctgctgacgaccgaggtggcggcggcggcggggcctgtggggacgacgacgaggcggaggacgagggcgggtcgtcctggttgaggagaggatcgagcaggtggtcgatggggagggaggggtcgaggcgcttggccttggagaggaacttgacggcgcgggcgctgtcgccggcgtccgccgcggccttcccgatgcggaggcacttgaccgcgtcgtccttgttgccctccatggcgcctccccccgcgcagccgccgcagatctggccgcgcgacggcgagtcaccccctcctcctcctcctccgtgcgatggaccccgatcggatcggctccgcccccaaatccaatctgagaagcgatcgattcgcacaacaaggtggggggaatcagattccgatttccgaacgagccgtggaaatcggccgcatcggatgattgggaggcgcgaccgtgttgggagatgcttacctcgccggagttggagcggagaccggatcggcgtcggcgtcggcggcggcggcgagtcgccgtgggaggggaggaagaagagaggaggggggggagatgtgatgagacggcgacgcgacgaccaccgcgggcggagtcgatatttcccacgactccgtctcgctttgcttcactttcctcaattttctcaggattccttttttttttttttagttttccctctgtttgttcgttctctctgcgagactgcaaatacgcgtgaagaaaagggtgtgggcctgtggtaattgggccaattagaaacctatgtgaggccgtttgtgggtaattagtttaggtttaggaaaccgtaatgatggctccatcgtttgcatatttgcaaacgagtactccaaccatcccaaaaataggtaaacattggtttccgtgtcgatctttgactgtccgtcttatataaaaattttttataattcgtattttcattgttgtgagatgataaaacatgattaatattttatgcgtgacttgtcttttttatttttttttcataatttttttaaataagacggaaggtcaaacgttgggcatggaaaccagggtttctcttttttttgggatggagggagtaataatttgtgaataaaaattttatttgtgtgttcctagcgatcttaaaaaataaagtttaaaaaaaattcaaaatcaactctgaatttaaggttgaaattttaaattttggttgataagtataagtataagagaaaagatgaggcctatagtttcccagttgcttaaaaaaaattctcactcaactcaattggtaaccgtgagaagcacgcggtcacgtaaaaatttttatttccgtcaatagagatatgttatgtgacgatgtatatatgagtacgatgttaatagcctaaaagctcaaagtttagaggagtgacttaaattaaattaaagctaccttgaaataaccatgataccatcgaagattcaaatgggaatattgtgggatactcctattttggtgacaaggatgaagaaaaacaagtggtatcaaaagacactgaaaaacaattggatatatgccaaacgcatgggaaaatgagtgttgaattgtgtcagaattataaatgcgaacacctaaaacttaatctagatcgtaagacaacttatggcctgtttggattggggccaattcttgccctacctatcatttgatagttttgaatagtactagtaatcgtgcacgtgcaatgcacgtctatgttaaaattattggtccaattccactaataagtgaaaaacaatatatttattctaaaccactgatattaacatgaaacttaagtgacaaataatcaaaagccatctgtagtccttttgttatccactgcatttcaaacaaaataaataaaaaatacaaaagcttcacttctcactacatttataacaaagttttacaggtgccatcacaagttaaacttttgcaactaatttggtctaaaataagcaactatagaaccatactctcaccgtaacaatatgcaacctggagattaaaaacaataatccaattaagctaatcaacctgacagactgtcacttctgtcacttctgtccaaggatgaatatctcaatactatacaatcaccactattttttcctttcaaaaaaaaatcacccctattttgcatctgatatacggataagcaaaacattgtggccttgatcggcagcaatggctgctgccgcagctgccctataggtgtaaataccatgtgaaagaagacatgcatagcactcttatgtcacttggccatataaagttttcaactccacaattatatatatacatccctcctgtcctcaacataccagagcacagcagaggtgcatatgaatccatccagattatatatagagaaacaaaccctcttgtaatcaagccgaatttgaagagaaaatgtataacatatgcatacattaattcctttaatatccaaactgaaaattaagaatcaatagtatcagccatggaaaagaactgagttagatcacaaaatcttctgacgaaactaaagatattgaagccaattttctatcaaccactaattgcatgcacaattgagttgtttatatattcatacaacacaaaattgtaaagtgccaacccgaagaagtacatctcgatgtgtcatgcacctatgtttaactgcatgtccatgcatgaaagtcaaggaactccagtagaaagtgatgtttctaccttcacggagtgacagtaacatcaaatgcaaaggttataagtataatacaaaaagaaacactgatctgttcattttgaaagcaacaaactattagcctgaagcacatgtattcacagtaagaaaaaactattgactgagagatcaacttggttcacaggagaaaaaagtatgcttagagctccaactgagacacgaaggagtagctaaaaaaatatgcatcatgagcttaggacttagagcctcctttgcttcttagagcaagtttaatagtatagccaactactagctccaattcatctatagccaatctaatagttcattcatacaatagttacatactacactattaatacctggtcccacctgtcatacacacactgcatcttagagtccgtgctacagctggctataaatctgtagcccgctactcttctctcttctcatttatctacttaaaatatgtttgcagttggcttatagcctgctattgtacctgctcttaggtcctttgcttcttcggttcctcctaactactgaagccaacacatggatgtcacagcattcacattgccatctcccaactcccaagaaacttgcttcattctcatccaccaaggaatcaacctatatgagcataaccttatatgtcacctgaaaagaaaaatgaaacgttcaagtctcaattaatcaagctactactgatcatgggattgcaaccagcgagcatgtatatccatctgaaccatgttgcagtgttttcgttatacatagtgtagctgcagaacacatgcaagaatatgaccccaaggatccataatcatatcttcttggctgttccactgaacaattaatactgaattcattatatgaaaatcctgaaaaaaaaaaggaaaaatgatggttaattggatctcttgagaaaatgacagtataatttatgctcataagaggcaccatctatgaaaaatatataatttagcatagtcgtgacacaacgcaacatgaattctaattgcaccggacctcattcttagtaacatataaattaagcagaaaatcactggacaatgggccataccttatcaccagaagtcatatctcggtaaaacaaatatcattatgttgagacttgagatgatcagcacccaaggaattaacacttatcatttgcacagttgtaaagtaaaacctagaaatgtcttagcaggcattctgatatgggagttgtttagagaaaacatttagagatgtaagttgtcagttgcacaccaatagtgatctgcatctcccatttgtaccattacaccaaaaataacttttagatcacaagcatttgcaattttcccatctataataaatgcacacattcatatggaagcataaaaacatacacaattttaattgccggagtacccaaagtcataagcaagagtaaccgggacaagggaagtagtgttgttgaacctgacagcgccgcaacgggatatatttatttatttgcttgtgatgatgaacacccatcggtgttattattggtggagaaggaggacgatgccccggagctgtcacagcctgattttcgttttaggatttaaaattatttaatcaattattaatagaatttatattaaatgttcattaatttttaagtgaagttaaatgtgggaaataaaattttctaaatataaagcatggctggatttaatttttattaaattctccatgattaattatactatctgaaattttctcggatttttcggagctcaattcctaattttaataatacaaagaatatttcagtaattattcacatattaaattaatcattaaatgagctggtttcaattttgttaaatattttgagtgtccaagtatgttcaagattgttcttggaattatttgagcattggaagtatttttaacaattgaaagatcatttcagtgattaatttaattgggaaaagtaattagaataccgatttttttatttataataactaatccttcacaaattaaataagtagtaattatctgtagggatttaccaaagtagtaaggacgctattgtcatcagcgtccaggtgtggacactgttataatacatgtccagctcgagacgcacttcttaacagcgtccacagtctggtgcaacccaatgtgccttactgccttatcacaccggccgccttatcacaccggccactgtaagcgcttgttgacatctcctgctagcgagccttcgtgttgtcctaagcaacgttagctcgatcactttgttggcgattgagcatgtttaattacttaattatatgctatcactctataatttttgcctttgaagtgcccacgcatgcgttagcttttcctttatctggtccggttgcctctaaaacagatatatagctcgttgttggatcaatcaatttgtagttatatataggtatgtcgattcattttaatatcgctgcatatcgtatcaacatattatggttctagataaattatactcatatatttcaataatccagccaactgtgtcaattacaaatacaggacaaacaatctgggtaggtgttgacgaaaaaatcgaatacaccggcctgggagatctgcttaactccagtgcaggtccaaatcttggtgaaatgcgagcgtgccagtcagtttgatcttgcaactgacaagatatgcaaatagtatatcaaaacagccgatcggctgacaagccgatagagtagttccagccgatagcgataatagccgatgccgataccagccgatagcgatagggtttaagcaatcggctatatgtccaatgtagataataatataaaggcaatcggctgatgatgatgtaataaaataacaatataatccagtataaaccaatcggctagcattgatatgatagaataagcactgatctgaaggttaaagcatacatcggctggaggcccgatgtcatgaaatctacaagattagattaaacagtgaaacctttgttgtcatcggctaaatccaacttatatgtatatgcaatccttatgagccgatgcaacgtccagataactcatcagctgaaaccccgatgaaacccttattggcaatcaagaagcaggctagaaattatggttctaagcacgacttagtagatcaaacttaactgatgcagcactaagtatgaaaagaaatataatatctagacaatcaagccgttgactgagttttcagggtggtagatgtctaagctaatctaatctagcaacgcgatttagccgataccggcagaaaccctaaaatgagaagcagccgatagagctaaattgatatgctaaaactagattaacagagacatatgataaataggtaggcaaatatatcatccaaaccaaagcaatccaagaggtcgaatgtactgatgcagccttgaacgacgccaacgtagacgatacaattgcctggatcggcggaacattggacttatcccttcgccggagatcgaagacgatgcaactccgcatcgggtgccaagttccgccggaacgtaaaaacaaaagtagaagtaaaaagggtggcgatgcgccgaattgtattgatcgtagcgattgatagattacaatgaccccgggtgtacatatttatacccataggttgatacaagtccttgtcggacaagaaagaaactttcctaaagataaaaggaaaagataaagtccttataggacactaaacacactttcctaaagataaaaggaaactaacaaactattcctaattaatagatacaactgccttcttcggactcgatccgtacgtggcaatcatcatgaagcacgtcaactcaatctgacaatgattccaatatcatcttgccggaattggctacatcggcttgccttgtcctattcggtaactgccgatgcacactgtagccgatgcggttccgaagccgattcataccctgtttccgttatcgatttcctcccaaatccgcttcggccttaactccaaatccgatgcatgatttaccaaatttcatcgttaacagtaggtacaatacgttcttgcattaactaggcaaacaaaacgattcaaaccaagtatatatccggacactagata

SEQ ID NO: 60349 - DNA, 6112 bp, Oryza sativa
  unsure (1)..(6112): unsure at all n locations
nnnnnnnnnnnnnnnnnnnnnnnnnnnnnnnnnnnnnnnnnnnnnnnctaaagatccccaaaggaaaagataaagtccttataggacactaaacacactttcctaaagataaaaggaaactaacaaactattcctaattaatagatacaactgccttcttcggactcgatccgtacgtggcaatcatcatgaagcacgtcaactcaatctgacaatgattccaatatcatcttgccggaattggctacatcggcttgccttgtcctattcggtaactgccgatgcacactgtagccgatgcggttccgaagccgattcataccctgtttccgttatcgatttcctcccaaatccgcttcggccttaactccaaatccgatgcatgatttaccaaatttcatcgttaacagtaggtacaatacgttcttgcattaactaggcaaacaaaacgattcaaaccaagtatatatccggacactagataagttcttatacatacgaagaaacgtccacaatctaaaaaagctcacttaaatatataagctagttgcaatgtgcttcttgaaacttttcttagcacttaactacttgtgttgaacttcccgaaaacctaaatcaaacgaaaatgttagtttcaccaagataaaataaggcagctagctgattctcacagagttactgtttgttgagtcactagcttggcctccaccatcttctgtgtgggcactcctatctccatgctctatactgcaaccttttcctgagtatacccaatagtcaaatacttcattgtattgatacttttggataacttgacggaaccatggcaccacaaacaacaatagtaaatctatcaggatgaaacaatcttattgctgaaacaatcaaccgcacaaaaaacctgactagggtccgcatagaggacgtcgctgtcgagcggtcactggtggcggcggcctctagcgcaaggaggtctggacattgttacgaagatgttgacgggatgctggacgtcgttcaatacagcgtccaggtctggacattgttacgaagagcgtccattcctggacgctatagcgtttagcatccatcctacaattaaaatttccctctatcatttactagatatttaattaataggttgttaattattatatataaaaaaatcggaattaaaattcccttttccttttcgggccgaaacaggaaaagttcacatttaatcctccgcccattcttccttctattcggccggccttatcccttcccaaagtctagtttgcatccctccttctatcgggctgtgcaatggaagcccatccaaaagtctgttttgcgtcccctcgctacagtgcatcttcaacctccagccagagccgagctcctgtgcccgtgtcctgttgccgccgcctcctccttccaaatccgacctccccgttgctcctctttccaaattagttgcggaatggaatcctctcaatctcctatacaatttccccacgaaatcctcaaatgtttctatggaaatcctttccaatttcgcggatcaatctttccttttcccggcgaggatcctaaactttcccggagtttctcccgtcgatttgggcccggacccgagctcccgtgcctatataaaggaccctctagtcgtcctccacctatcccctcaagtcccgtcttccaccgtcgctggaaacgctctccccgcgagcaccttctctctccaccgccggccgccgctccagccgcgccgttcgtcgtcgtccatcgtcgccttaggtcgccgctgccaccgttgggttcgcgaggaggagaagaagatcgtcctccacttccccgaagccgaaatccaccggagctccatcgtcgccgtcaacccgaagttcgccgtcgtgttttgatctccaacgaggccctgctgctccttctgtcatcaccaatcttcaccgccacatccattggattcgcagctgcaagcagaagaccgtccaccacctcttctccgccaaagatcgccggaaagtcatcgccaccgtcgatcagtaccccgtcgccactccaacctcgccgccgtcgtcatctgtcgtcgtttgccgtcattcaagtcatcggtgagctcccctcgtcgtgctctttcctccggttcagatcaatttaagtcatccaatcttggtcgactcgatcgagattaatctcagccgtccaaaatcgatataaatctgttcgctcttttcaatgacatattattcctttttaatatatgtcatctatcaaatataatctaatctttttcggaggttgttttaatcttttgtcttaattataaatcatttgtaaatggtttaattaatttggaatagtctttttctttaataggctttaattggaattaattttgtaaattcataattaaatcatatgaaattggaataaggccgttcaagtctcattcatctaaaatcatgatctacatgtttgtttactttatatgttttgtttatttggagtttcttagtctttttctttgttttgcgtgttagcttgtcgtttctgtcgttgcaaaggttcgcgagtgcgccggaagtgttcaagaagattaattgaagaccgttgcaaggcaagtcacacaggtcccaaacacaattcctttgagcatgttgatcctatatttaattctctattaatttcaactatgcatttattttcgaatgtcactggtggtgtgtcacgcccggaaattcactagtaatttccgaacttatttgtgcataaaatcctcgtccagaaatcagccgaggtacacaaactgacaatttaatatacaaatccatcataataataacgttacacttacaaaagaaaagaaaacagcagcggaataacggtctagcgatggcttcagctccactcccacaggcagcttaactggggtataagccaaacatcttctccttctggatcatttttcttcaactgaggttgattgattattgcaagaatgagcatatgacatactcaacaagccacacagcaaatatgcgagtgcacaaggataccaaaggatggcataatataggctcatttgcaaaagcagcatttagcaaaacatttaagagaagtaaaacagtggagtaattaattagaaattttaatcaacactgaacagcacacccatgctgcacaggcccaaccatcctgaacaaccatacccggctgtacagatctaactccaaaccaggagctaaacaaattattaccaggtataacatccataattattgtgagaggtgtgagactaatcacgaaaaacattgctcaacccgcccataaccacgggcacggctattcgaatagttttactctggccagaggtgtaccactgtacccacaagacacagcctcaacatcatgtctaccatgcgtcgcgatactggaaagtacccgaatagaggctgtgacaataccatctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatatttctaatcatgactaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacagtatatataaagtaaacaaacatgtagatgtcgattttagatgaatttagcaacttgaaccactcaaaaccgagttacgatgatttagttatgaatttcctaagatttaatctattagaaaaacaggaaaaagaaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacgaggtctagcggcggcgcggcttcggtcgacggtggcgacggggctgcggtggtcagcggcttcgggggtcaggcggccgggcttctccaccctcccgcgcacctaacggtggtgacgacgaccggtggcgacgacggaggcgacggcgcgacgcggatggagctcggccggcgacgacggcggggtggagcacgtggcggcggcgctacgaggcacgggagatcacgggagagggggcaaacgaaagaggaggactaggggatcctatttaaagccttggattgaagagatcggactcctccagcaagaaatcgatccgggaaatcaaaaactcggttttggagataaactcgaaaacgagttcgattcggataagatactcaaagattagctccgatttttgggggtaaagatataggaggataagaggaatatttcccctcaactaattttagaaaaacacaaggggaaaggtcagatttggaggagaaaaaccgagccaaatcggtctcagttcggctgctagaggtagaagataaacagtgtcgagggaggcaaattagacttttcgtcttgggctggctgaaaacaaagcaaagaaagaaagagaaggggggagctcggctgggccgacttgggttgcacggccgtgcacacaaaagagggagatgggctggaaagggcccaagactaggaagaggattattattacttttccaattaaattaatcaatgaaatgatctttgaattgttaaaaatacttcctatgctcaaataattccaagaaaatcttgaacatacttggacacccaaagtttttaacaatattaaaaccagaccatttaatgattaatttaatatgtgggtaattactgaaatgctctttgtaagattaaaattaggaattgagctccgaaaaatccgagaatattccagagagtataattaaccatggagaatttaataaaaaattaaatccatccatgctttatatttaggaaattttatttcccacatttaacttcacttgtaaattaatgaacatttaatataaattctaataataatttattaaataatttataaatcctgaaacaaaaatcaggatgtgacatggtgtgaacctattcctttgttatggccaatttgcattgattaccctatgtcttgattacctcgggttataatttgactagctggatttatatattggttcagctagatgtattagatattgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgttttggtgaatttgtgtgtggaagagctacaaaatgtgggccgacctctcccttgttctaggctctgaatctggaaagaatccccctccctctatgggcaaggtcctccttttatacttcaaggggataccacacgcaccctcctctttc

SEQ ID NO: 60350 - DNA, 4350 bp, Oryza sativa
  unsure (1)..(4350): unsure at all n locations
gcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggcgagcagattcgtctcgcccggagatacggcaacgccgcttcggtcggcgagcgtaattaacgcgcgcacgatacaatccgtttcgatcgccacaaccgcatatccacttcatgcgccgtaagcgggcgaatgggattagtggaagcgtgggcacgggaaacgagggagcgagatagcgagatatgagggagcgaggtagtgggcgcgagaaacgaggagccaggcccagcgatggcaagggtataaaagcatcgagaaaaggatttgcttccttcctttcgccattgttcctcttgccttcaccgcctgagctctaactctttctctgctacgccctactttcgccacacgcgctcgttctcaatcatctcttcctccaccgccatggcacggggctctgctctgctcgacggcagtgtactaccgccttcccgcatcgtgaacgagaggcacgccggactgccgcgccgcttcatgcctgagtccgccaccggtcgggagatagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggtcggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgtcggtagatctgggggaggactacgacgccgtcctcgaccgcctggcgggcctgcgatcccaggggctcaccggggccatggtgtacggcgattacctccgcccggccggattgcgccgctccaacggcgcgcccggagcgcctgggagtacactgggcctgaagactacatgcggacccaccagggagccagatgggactgggctcccgaggacttcaagatcgtagttcaaagggtgctgaatcttagctccgcggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaaccatctgccccaggagggggtcgtgcttctgggccccgcgtcgggggctcggggagcagccgccctgccgacgcccaggggaagaggaagctgggaggaacacctcccacatctcctccccgagggggcggggcggcgcgtgccagcagtcggcgcccggaggggggcgcgccgacgtcgcagcccgagggggagcgcaagaagaagcggctccgcaagatgggggagacggaaccatcccggggaaacctgatttcccctccaaagtggtcatttaaccgaccccctcgcaggttcgccccattcttattgcgaccgtctttcttctatcccattaagcaagttttctcttacccatcttgtttgtcttctggttttttattctgcttcagcgatgccccgtcacattcctcccgccaccccaagtccggccagtccgaggccgaagatccggcggccgcagaggagcggaggcgagaagactgaccggcgtgaagccgcagatcgccttcgggaagctgaagaggccgcccgggaggccgcccgggctcgccaagccgaagaagctgctcgggaggaggccgcccgggctcgccaagccgaagaagctgcccgggaggagaccgcccgggctcgccaggctgaggcgacagctgctgctggcgcgtcacttgggcccactctctccgccggccttcaggcgacatcctccgaggcgggtcgcgacgaggccgcgggcgcatcgcctgggcctacctcacggggcgacgcccaggaccaaacgggcccgggggacatccccgagcccagcgcatcctccggggggccaagccgcgtcgcattttctccaaggcggctcttttcctcatcttctgtcgccccgctgagcgccgagccccttctgcaggccctggccgccgcaaacaccgcagtgctggatgggttcaacgcccaagtggaggccctgcgtgcggaacgagcggagctcgaggccgcatgggcgcgcgttgaggaggggcggcgctcggtggacgccatggtggaggtgggccgtaaggctcaccgccgtcacatctcggagcttgaagcccgcaaggcggcgctggcggaggtcgcccgagaggtggaggaggagcgagaggccgcccttatcgccaccaccgcgatgatcgaggcgcaagacaccctccgccttcagcacgcaagctgggaggcggagctgaagaaaaagctcgacgccgcccaaggggtccttgactccgccgctgcccgagagcggcgggtaacggagactgaagcggcgtctcggcggcgcaaggaggcccttgagtcccgtgccatggcgctggaagaacacgccggcaccgtggagaggggcttgacggaccgcgaggccgccgctgctctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaagaggagcaggcgcgccgcaatcttgaatgcgtccgcgccgagagagccgcactggagcagcgggctgctgacctcgaggcgcgggaaaaggagctggacgcgagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccacatgaagcgcgccggtcggcaagcgggcctctggagaggccagacgtcggtgccccccaccaatctggaaggcctcgctccgcacctcaccaggatggcctgggttctcgaacaactccccgaggagcttgagaagaccatcaagtcatcctcgagggacctcgcgcagggagcggtcgaactcgtgctggcgagctaccaggcccgggaccccaacttctctccatggatggcgctggaggagttccctcccgggaccgaggacgacgcgcgcgcgcgcgtccgggatgccgccgaccacatcgtcaacggcttcgagggctcggcccctcggctcgcgttcgcccctagctccgacgaggagggcgatgccagcggtgaggacgacggtggcgacgaggccggcgacccgggcgcgtcggaatgagcccccgagcccccgtcaatcttcacttttnnnnnnnnnnnnnnnnnnnnnnnnnnnnnnnnnnnnnnnnnnnnnnnnnnnnnnnnn

SEQ ID NO: 60351 - DNA, 702 bp, Oryza sativa
gcccttcgcttggcgggcgagattgggcccgacatgctttgggatgcggtctcccacatgaagcgcgccggtcggcaagcgggcctctggagaggccagacgtcggtgccccccaccaatctggaaggcctcgctccgcacctcaccaggatggcctgggttctcgaacaactccccgaggagcttgagaagaccatcaagtcatcctcgagggacctcgcgcagggagcggtcgaactcgtgctggcgagctaccaggcccgggaccccaacttctctccatggatggcgctggaggagttccctcccgggaccgaggacgacgcgcgcgcgcgcgtccgggatgccgccgaccacatcgtcaacggcttcgagggctcggcccctcggctcgcgttcgcccctagctccgacgaggagggcgatgccagcggtgaggacgacggtggcgacgaggccggcgacccgggcgcgtcggaatgagcccccgagcccccgtcaatcttcacttttttctttttctttcttctaaggccttcgtgcctcttttgtatagatcaacttaatctgcaatcaaaaatgatgaaaaatttctatgttaactttattttgctatacttatgagttgaggatgatttgtgccgtggtccttttgcattttagcttgatttaaggggatcctctagagtcgacctgcaggca

SEQ ID NO: 60352 - DNA, 2288 bp, Oryza sativa
tgcattctagtcagcaaaaataaataaataaagtacgtggggaccacatgtaagtgagagaaaatggtgcgggccccacatcccttccttttcccctttcttctcttctctcgttttcttcgacgagacgagatgggcgggatgacggccggcgagagcggcggcggcggcggagggcgagcgcggccgcggcaagcgaagcaggcaggagcggggcaacggccgacgagagcggcggcggcggcggagcgcgagcgcgcccgcggcaggtgaagcatgcaggagcggggcgacagccggtgagagcagcggcggactgcggacgaccgcggcgggaggtgggggcgggatccggaaggtggcggcggaaccgcggcgcgttagggtccccgaacacgaggtcatccttgagcccgcagtccaccgagcgcggcctgtgggcagaatggaggcgggtggcgcggcggcacgcggagcggcgttggacggcggagggcgagcggaaggcaagcgcggcgggctgcgagcagagcggacgacgggcgtcgagcgagcgaatgagcactgcaggcggatgaggaggccgcaacggcggaggtggccaaaggaggagcgtggcggtctactccgccagtcgcgtcggtggcggcggcgagagcggcgcgcaaagcggacagagcgaacgagcacatcgttcttgctgctggttcccgccgccgccgtcgcactcatcggaggagcccaacgtggtggcgcgccgcagcggcgggagcggacggagttgggggagatgaggccggcgggagagggggaaagaggtgacgcgtcgccggcggtcgcccgtcgcgcccccgcccctttgctcggcccgcgctcggagacaccgccggtccacctgctccgggcgcgcaccgcccaccctcggagccgccgcttgcccgccgtcgcgctcgcccaccgcttgccgtcgccgtagtcgcgctcgcccggagacaccgcgcgctccgcctgctctagcgcgctgacgccgtcccttcacctactccagtcgcgcgctcgcccatcgccgcccgccgccggcaaagagagaggagaggaaagagaagaggagagaaaagagaagaaaaaataaagtgcagctgacatgtgggccccacgaaattttttaattttttttttctgactaggatgccacgtaagcgaaaccacccacctatactgccaagggacctcctgtgaacggtttgaatgagtttaggggcgaaaatttctggttttgtggttgagggacctcaaaaaatctcgctgttaagttgagggacctccggtgaacttattacttgttttttgtggccttggaagaaagcaatttcaaattggaaaaagtataccgaatgtccctcaacttttcatcgagttacaaaatcgtcccccaaccgcaaaacctgatacatgacatccttcaacttataatatcgttaactttaggtctttcggttgttttgaccccggttttatccgatgtggcggctaagtcagcgtgggacccacatgtcaggatgccacatcatcacccacaccgtctgtcaagagcgcggcggaagggacatgccatcaccatggtcatcggagaggatgtgggagtggcagaacctggccatagccatggtccgcaccttgcacccgccgaagctgcatttcttccgcctcggcaccatcgcggacaccggcctgaccaccttggacgcggagggcagcagcggcagctgctctgcctcgagcaggcttcgcccatgccacgcccgcagctccccccgagcgtccaatagaaccgccagtacacatcaacgagatgcttggcgcggcacctccgccaacacagcacccctcccaggtgagcgcctccgcggtggcctccatctccggcgagggagggtcatgggggatgatagggtttcggagcggtggcgcctccgctgtcgccgccgctaccgcggcgaagggatcgatagggttcgggtgggacagaggagacgacggcccgcgggaggaggacatggcgccgcagaggtgggatttgtaccggcgggcgccatcaccgcatcgccggcagtcggacctcctctctcgcctcgtcccggtgacctcctcctcacctgccggccgccctgcccagaggagaaaagtgagagggggagaggaggaggaagggaaaggaggggaaagtggcatcctgacatgtagggctcacgtgggtatcacgttgactcagccgctacgtcggacta

SEQ ID NO: 60353 - DNA, 8212 bp, Oryza sativa
  unsure (1)..(8212): unsure at all n locations
nnnnnnnnnnnnnnnnnnnnnnnnnnnnnnnnnnnnnnnnnnnnnnnnnnnnnttttatatatctggttttgtggttgggggacgattttgtaactcgatgataagttaagggacctttcgtgtactttttcctttcaaattggaaacctaggcagtaggcagcaggtttgggggcctacaaatttgagggatttgaaaattttgaatttggttttggttacctctttccaaatctatacgtatagctaacctaacatgtctcatttactcgaaccttatttcagtcatcctatttactaggctgtaccccgcgggaacatcgtgaagagtactataatggtaagcatgcacgcaatatttataaaatgtggaaatgaagattgatctggacaaaatggctaattagttccctgatgcatatataaccaaaaagaaaaaacaacaccgtaccggtgatcgaatgtaggacaactgtccatgtagtgtagtatatactaagggtgtgtttttcacaccaaaattggtagtttggttgaaattggaatgatatgacggaaaagttggaagtttatgtgtgcagaaaagttttgatgtgatagcaaagtttaaaagtttgaagaaaaattttggaactaaacttggcgtaaatagcatcgaacatttggttgaattcgatgctatttagagaaaaggtacccaaaaggcataagtttaggcaaaataaacataaaagaacctaaaaatatatattgcgtaaagctgtgaaacaaaggagaaaagggacgatgagcatagcaagcagtaaatcagaaccaaccatgaaaattaaaaaacccattggagaaagagtgcagcatacatcagggcatcaaatctctctccactggggagtgggtaatggattttcctagagaaagttccctgctttcgataaaatctactaaagaataacaacagaagatcactgtacatgtctaacgggtactgcattaagaaaaattacaatgcatatgtgggaaacatgatttgataccatcccgtgaatatccaaaatgaatataggacttctcaatcacggtgaaaaacagcgtttcacaatgcaggtcattctagcattttccatatttatattgatgttacatttaatattaacatgaatatagaaaatgttagaatgacctatattgtgaaacaaaaggaagtacatgataatagagaaggatgcatgatctttccttttatccaaaataaacggctatcaaatgccactgataccagcacatcacaatttttttttgttctttttccatgagtgaaaattatgatcaatgaaagccaaaaattttgaaggaaaacaaaaggaaagatgcaaacgttagattaaactggaaagcaaaatgttgatacagagtcagttcagtgcctctaactgttagctttgagtggcgatttttggattaataccttaagttagtataaaagctttttttaacccaagtccaccacatttataattatgggcttgttcaaattgtagccaaaataaacattaccaagttttggcaatgtcaaaattttggcaagatggcaatattgccaaaattttggtattatttcttatgtattgatcaaatttggcaacaaactaaacatagccatttttaggtaactttgaaaaaaaatggtatggttgaaactaacatcaaaatgaacaacctctatgttcacagatctcatatcaataactataaaagcacccctaaattcagaaattaggtacataaggctaatcaaggcggccctccaaaaaaagctgctgctattttttttcgccgggcgaagtagctgctacctcctcaaatatttacggaataccatcattgcaatggcaatgcgcttagcctatatatacaacacatttatgttcactcatatcaagtattttaattaagacagcaaacaaatactacctccatattttaatgcatgacgccgttgactttttatccaacgtttgaccattcatcttattcaaaaaatttattcaaaaaatttatgtaattatcatttattttattataacttgattcgtcatcaaatgttttttaaacatgacataaatattttcatatttacataaaatttttaaataaaacgaatggtcaaacattgatcgaaaagtcaacggcgtcataaataaggagggagtaccttcagggacagtggaacagcaagaacaacacaggacttagaaacagtagcaaggcacgaatcgacggggtttgggtctttgggaggaaacaggcaaggtgacggaggaggatagcaattgcgcgcgatacgactccgattcagcttaaatggaggccgtatacggtggacagatatggccggtggccggagaccgtcgccaaccatagcgaacgggtacatgccggtctggcacggcagcaggtgaggatggcaaggatggcagagaaatacatggctgcgcggcagactggcagtagacgcaagagatcgagaaggagatgaaagcacacatgaaggcagcgacaggggtagccgccgacgaagttaacaggagggcgtcgggcggcggacgcagggaagcagaagaccgcgttttctttttgatagacagaatgactcaacgcgatggtgtattgatcatggagcattacatgcataggcctctatcttccatactcactctaccgatttatggaaacatgaccggaaaccatgatcgggagaaggaaagggagccggtgatagaggagacatgatttacattccaacacttttcccccgatggatgaggagaaaagctatcctaatgctacggatggccagcacgcctcgaaaggactgatcggacggctagaaataagatgaacagtggaacagtagcctggtagcgtggcaaagagcgctgcgtttactgtagcaaatgatcttcatagtcacatccgtacttcaccgaaaactataatctttatagaattgactcatagtcacgactacttgacgaactgagagctaacgatggctgtttcggtttgaagtcctattgaattaggtagatttagtgggggaaaaaatttaggattggttgtcacattggatatacagacacacatttgaagtattaaatgtagtttaataacaaaacaaattgcatgttccgttagaaaactacgagacgaatttattagcctaattaatctgtcattagcaaatgtttactatagcatcacgttgtcaaatcatggcgcaattaggcttaaaagattcgtctcacaatttacacgcaaactgtgtaattgttcttttccccacatttaatactctattcatatgtccaaacattcgatgtgatgggtgaaaagtttttattttgagaactaaacacggccttagcctcagtccaaatagtaaacaaatatctatactaatataaaaaggatgagttcaccgcttgcaatccaaccggtgaaatcaaatctaacgggtgaaagagataaaagtgggcagctggaatcaccaattcggaaccctccccatccccatccccatccccaccgcgctagcgcgcgccttcatcgccaccgctgtcgcgcgccatccacgccccgcgcccgcggtatccgttgcactatccacgcgctctttctctccctgcgattgatgtgcagctcacgccattgaggggcaggggcgagagtgctcccctcaatcacctcctcacccgcatcgcatatccatcatatcctcctgctactgctggcattgcccgtgatatgtcctctcctactcatcccttatgtgcccttgatgtgagctctcttcttcctccctgaccagccatggcagcatcgaatctgaggcgccggaccaagccatgcgaaggcttcggatctagccaccggcaccaccaccagtctcagcctcgatgatgacaccggagaggggagcagttgaggaggggagagggtggggatggcggcatgggcaaagctacagaggtttggcccaagtcctgttgagcctcctcggctgcgttgacgcccaccacaacgcacgtcgtccccgcgccatcgaaactcagaggttgctcgatgtccacgaggctgacgctcgccgctaccagcatcccctgccaccacacccctgcggtagatttagcctatccggctggtaattcactagtaatttctgaacttatttgtgcattaaatcctcgttcaggaatcagccgaggtacacaaactgacaatttaatatacagattcatcatactaataacgtaaatacttacaaaagaaaagagaaaatagcagcagaattatggtctagcgaagctccggctccactcccacaggcagctcaactggggtataagccaaacgtcttctccttcgcaacttgtcttcaactgaggtttgattgattattgcaaggtgagtacatggaatactccgcaagccacatagcaaatatgcaagtgcacaaggataccaaagaatggtataatatagggttcatttgtaaaagcagtatttagcaaatatttgagaatcgtaaaacagtagagtaattaatcatcaatattaatcaacactgaacaacacacccatgctgcacaggcccaaccatcctggacaaccatacccggctgtacagatctatctccaaaccaggaatatagcattccaaaccaggagctaaattaattaccatcaattaccacattattattaatgagtagcgtgggactaatcacgaaagacattgttagacccgcccatgaccacgtgcacggctattcgaatagttttactctggccagaagtgtaccactgtacccacaagacacagccccacgacatgtcaccatgcgcctcaataccaccacggtacctcggaaaggagctgtgacagtacccctcgcataacacaatccaccacagcgcaccgttcctagatcataatcaatcccttataaacaaggcatggactccccagcgacccccgtgggcttatctccgccacttctcagtctggtaccctgcaatgaactatgctatacaaaaggtaaagccgttgcccatgctggcttgtggttagcacggttaatgtttcacaaccgaaactcgtgaaccggtccttaattgtcatgagcacgaccatcaaaaccatatgctcacaacccaccattatcaagttttagttggcaaattaattaatcaatcacgattgaccatcgtgagctacaattaaatatccatcaataagtaatagtaaaacattagttatcccaatcgtgtgctaatgtttctaagcatagctaagcaattatatctgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggtcgggttgcgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggttagatttataccaggcttcatcctaaccattacaggcaaggtgttacacgaagaagggcaaacatgcatcttgttaaactgacacatggtggacaagaatgaccagtctgacactggtcgcgtcagcaacgggcagccacgatcccacgttgcgcccgtctccgccgggagtggaggtaggtgtgggctgtcccatcgaagtgtcattcggacagcaaccataccaatctccgtccataaagagaagaaaagtccagtttggaaagaggagggtgcgtgtggtatccccttgaagtataaaaggaggaccttgcccatagagggagggggattctttccagattcagagcctagaacaagggagaggtcggcccacattttgtagctcttccacacacaaattcaccaaaacacaggagtagggtattacgcttcccagcggcccgaacctgtatacatcgtccgtgtctcgtgtttcttcctggcacgcgatctttccacacacagcgagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgggcgccaagtttttcttgttcagcctaatggccgagcaaggagaagcgcacgacctctctccgagtgtgagcggcgacgacggggagccgaatccacgccgtcgagctcgtactcccccacctcctctgcgccaaagccctaagcagggggaggcgcttgagaaggtcgacaaatccgtggcatcaccagttgcaggtggtgcaggaggacggcaagatggggagcgccgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcgtcaaggcggagggcgcggcgagcggcggcggctgcacgtcattcggctgccactccctcgtcgacaccttcgactcgggaggatcagcatggggagccggatgcccgcctcaacatcgagcgccggcgtaatagccggcgtactccccgcgcaacggaggacgcctcttcgtccagagtgtcacctcgacatggacgtgaggatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcagaccgagtggctcgtaaggaggaggcctggacctggaacccctccggttccggtgtggcagcttcggccgcccccggatccgccgctcagacagggcggcgtgacaggaggaggaagaaaaggtcggcccattccggcgacgaggggcacgtcctcgccgtcgagagcgctccgcgggccacccgaaaggggaggcctgcgagcgacaaaaagaaagaggctggtactcccagccgggagcgcccagtcagcaagtggtgctccgtccacaacacctccctccacgatctcgcggactgtcgcgcagtcaaaaatttggctgagcgaacgaggaagtgggaggaggacaggaggcaggaacgccgtgagggcaagtccccggcggttccttccggcaaacggcgaagtgaggccaagcagagggcccccgctgctgacatcgatgacggtgatgatgacctaggtttccaagaacctggggccaccattgccactgtcgacggggagcgtgtgctcacgtttctcgcc

SEQ ID NO: 60354 - DNA, 4116 bp, Oryza sativa
  unsure (1)..(4116): unsure at all n locations
nnnnnnnnnnnnnnnnnnnnnnnnnnnnnnnnnnnnnnnnnnnnnnnnnnnnnnnctacaccgaccttaacaaggcatgtcctaaggatccttaccccctgcctcgcatagatcagattgtcgactccactgcggggtgcgaccttttgtgttttctagatgcatattctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgcgcaaccaagagaccttactctcagatctagcggaaacttttgaaaacctccgctctgcccgcataaaactgaaccccgataagtgcgtgtttggtgtacctgcgggcaagcttctcgggtttttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctccgggccgttcacttggacggaggaagctgaacatgcccttactcagttaaaggtatatctcagctctcccccggttctagtcgccccggagccaaatgagcccctgctactttacttagcggcgaccccccaagtagttagtgcagcgttggttgtggagcgcgatgaggacaatcctcattctgcgcacccccactctgtgctgacttggcccgggagcaggcagggaggagaggcccccgagtcgaacggtggcctaaggcccccgacgaccggagtcggccctctgcccgcttgtcagacggtgccgggtgcccccgaccctcaggaaggccccgaggccactgcgggaaggccgcatctaccaccctttgaccccgaggctaaccctgtgctgattcgacccgggagagagcagggagaagaggcccccgagccgaacggaggcctgaggcccctgacgaccggagctggccctttgcccgcttgtctgacaacgccaggagcccccgacccccgggacggccccgaggccactgtgggaaggccgcacctgtcatcttcggaccccgaggtcatcagcgcaggagacgagtgtgccccgagaggccacttggacgaagagcaccccggggatacggcccctagcgaagaggatcggccccgccgaaaggtgcagaggcctgtctactttattagtgagaccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagactgtctcaatgcccgaggccagcacgaacctctcacagctgcctcaaaccgcccactgggtgatgcagttcgacggttctctgtctctccagggcgccggtgcaggggtcacgttgacctctccgaacggagacgtcctcagatacttggtccgtctcgactttcgagcgactaacaatatggcagagtacgagggactccttgccggactcagagtggcagctggactggggatccgccgcctcttggtattaggcgactcccagctagtcgttaaccaggtctgtaaggagtaccggtgctctgacccacagatgaacgcctacgtacgccaagtgcggcgtatggagcgccatttcgatggaatagagcttcggcatgtgcccaggcgggataacatgatagccgacgaactctcacggctcgcgtcctcgcgagcccagaccccaccgggcgcctttgaagaaaggcttacccagccgtcggcgcgacccaatcccttaggggagacggatgcgcctgaccggcccccgagggccgtcggagtccaggcctcgggactcgaagggagtgctccaaactcccttagattgattgcttggatctctgagatccaaacatacctcacagataagactctacctgaggaccgccaagggagtgaacgcgtacaacgcatttccaaacgctacgtgctggtagaagggaccctctatcggcgcgcggctaacgggatcctcctgaagtgcattcctcaggaacaaggcgttgagcttcttgctgacatccatgagggcgagtgcggagcgcattccgcctcacgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccctgggcgggtttgagtatctgtatgttgcgatcgacaagttcactaagtggcccgaggcctatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcttacgccgcgtccaaacgcgtgctggattgagcaagctctcaccaatatgggagggtccgtatcgagtgatcggtgtcccccggccgggctcggtacggctggccacgggcgacggcacgaagctgccaaacccgtggaacattgaacaccttcgtcgcttctacccctgaaggggggggtcgggtgtcaggttttggctcgggccaaccccgcacccccctcgggtgtgcagggttggccgggggctaccacacatgcacagtctaacttttcttatttcagcatttcaataaaagaagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgagccgtgccccggggcatggtgaactccgggggggaatcggcaaaaacccacaatcgggtcacccataaccctcggtcaccatgttcccggcctggccagtctcggcatgtggatctccccaggcactagccccgacccgagccatctgaggattgggacttgagcacgagctcttaaatcaagctaaaatgcaaaaggaccacggcacaaatcatcctcaactcataagtatagcaaaataaagttaacatagaaatttttcatcatttttgattgcagattaagttgatctatacaaaagaggcacgaaggccttagaagaaagaannnnnnnnnnnnnnnnnnnnnnnnnnnnnn

SEQ ID NO: 60355 - DNA, 739 bp, Oryza sativa
taccagcagagcctgcggcgctaccatcagcgccacgtccgggcccgatcactctgcgtcgacgacctcgtcctacgccgcgtccaaacgcgtgctggattgagcaagctctcaccaatatgggagggtccgtatcgagtgatcggtgtcccccggccgggctcggtacggctggccacgggcgacggcacggagctgccaaacccgtggaacattgaacaccttcgtcgcttctacccctgaaggggggggtcgggtgtcaggttttggctcgggccaaccccgcacccccctcgggtgtgcagggttggccgggggctaccacacatgcacagtcttacttttcttatttcagcatttcaataaaagaagtttcaattttctaaaggttgtgtctgtgccgtttttccttttgaagaatcttaacttgaaataaggtcactcgtgctcaaccttgccctcgggggctcggttcggtcagctaaaatcgccaagcggggcccagaaccgagccgtgccccggggcatggtgaactccgggggggaatcggcaaaaacccacaatcgggtcacccatacccctcggtcaccacgttcccggcctggccagtctcgacatgtggatctccccaggcactagccccgacccgagccatccaagggcacgaacccttatttcaagctaagacgcaaaaggaccacggcacagatcatcctcatctcgtatgtatagcaaaat

SEQ ID NO: 60356 - DNA, 714 bp, Oryza sativa
gtcgtcgccaccggtcgtcgtcaccaccgttaggtgcgcgggagggtggaaaagcccgtccgcctgacccccgaagccgctgaccaccgcagccccgtcgccaccgtcgaccgaagccgcgccgccgctagacctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgttttttctttttcctgtttttctaatagattaaatcttaggaaattcataactaaatcatcgtaactcggttttgagtggttcaagttgctaaattcatctaaaatcgacatctacatgtttgtttactttatatatactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgat

SEQ ID NO: 60357 - DNA, 1034 bp, Oryza sativa
ccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagttgaagccagcgtttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccatactattattgttattgatattattaccttgttcaccctagaataaacaaaaccccaactagtggaccctctatttatggttccactagtatgaacttaggtagatgcttcgctgattaataggacaacattaggtggttttataattttagactttgggtatattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgcgaggaagatgtgtcttgggggtaaagatgtacacc

SEQ ID NO: 60358 - DNA, 1216 bp, Oryza sativa
tctcatgtggccagcatgactcacgcacccaacttatagcatatccgaatgtccattcgcaatcatgtcgggtgatcaagccgacggtgttcgcgagaaattatccgttaacaatcttttctcgagtagtccagccatggccgatgctatgaggtaggtcgtcggtcttcgttggtaggttgggcgcgacgactctgcatttgtcgagatcgttctcgataatgcggtgtactcgacgacaacctactcgggtgctcaattgttcctgaagaatattttctagaaggcaagacatatagcagagaatatcgagtatgtactcaacaaactgcatggatcttctagcattatcaggatataacgagcagatataaatatcaggcattatgtagaccataaacaagcatgatttatacagaagaaaatagagcgagcccccagcgttagaccgtagtcaatttaacatcggggacacccgcgcaacaaatattgtataaaaaacatgctctaggtaaacataataaattattgatctgacaacatctgaaaataggtacggtaaattgtgtataaaatattgcgtacctttatagatacatgccggatgtatctacgggattagtagattaatttaaaaaatcaatctactatataccttgatttgcatgcccgacatactatcaatagaagatataagtatgcatgcagtagacctggacgtcaatatcttgctgtcttggaagagcaatgccacctgtcgcatgcatacatgtgtctaggcatgtgtacgtggcatggttaggcaagcacgcttggttgaccaattccggctagcacacggcaagttggcgacgcagtggcgcctattctcggagaatttcgcgcggcatgcatcgaggtatattggttggtgggaatcggcgtcgtgtccggcctgtgcgcagccagccaataactcacaccaattgatgtcgtgcacgaggaggaattgatattggatcggttttggaagctgccgatactgaagattctccacggtggcgatgacttgatgaagcttggtcgatctcgccggatcgaatattcgacgacgatggttccgatcttgttggacgacatactccggtcgggttagatctccccataaccgaagttgtcaagtagcttgttgttgaagaatccatctcttaaacccatctcgtcgaaaccctgaagc

SEQ ID NO: 60359 - DNA, 850 bp, Oryza sativa
gatgatattagagtagtatcgggtagtttagacgtggtgtctagattacgggatatcattatttggggttatatattgcgaataagaggtgggccgctgatggcgacagctcaatacgggtattcctccgcgcctatatataatcctaagttaatttcctggggagggtattcctccgtatttagccccggttgtatggtcatgacgggctgtcgtaaggaactcggcagtcaggggtgccttcttgaagtaccaggagggcatcggataaagggtattagctagtatatcagttaactagaatgtatgtatactatatatattagacgtataggaatagatttcctttctcttttctttccacttagcttagatgatatattatgaggatgagtagttaatgcttgtgtgtcactctaccctttgattatcttaacccctgcttaaaatatgattatcacaagtaatatataaattattagttgagttctctctacatgatcttcccacgggataaaataaatacgataccattggaatactctaaggtgaaatgctacaatggtatatccatgcgcttgcggatgaactctgtaaccataatataccagaaatatttctgcgccattgttgggaattatatttcttgtaatgccgttaagaaataccaacaagcaattctggcgccgttggcggggaagattcataatagagattacttgaactaatactttatatttacctctgtataatcatttcctttgcaggctaaccttggttgttttcactttttgttgtgaaaacagagtagtgcatgactggtttcaacttgccggaaaactttaaagaa

SEQ ID NO: 60360 - DNA, 2059 bp, Oryza sativa
ccattgaaaatgttaaggcaatcacgacgaggggaggtaagtccactcgtgatccgccgtatcctaaccttgcaggaactaatgggatatcaaaagaagcgtcatctaatgactcggctgacaaggagattcagccagaaaagaccgtgccgcaggagtactgcgacacgcggttgctgctgtttccccaacggattaggaaaccgtcagtagacgagcagtttgctcgttttgttgaagtaatccaaaagattcacatcaacatgccattgttggacgctatgcaaatgccgacatacacccgttatctcaaggacatactcaacaacaagagaccgctcccaacaacggaggtggtgaagctgacagaacaatgcagcaacgtcgtactccacaagctcccggagaagaagaaagatccgaggtgtcccatgatcacctgctcgattagggcacaacaattcgaccaggccttgtgcgatcttggagctagcgtcagcgtcatgccaaaagccgtcttcgacaagcttaacttcatggtgttgtcaccgacaccgatgcgcctccaactggctgactcgttagtccgttacccggcaaaatattcatgtggtcgaagtggagccacccaagacggacagcctggtgaaattcatgcaaaacttcctggagaaggaaacaacaatgcctaggaaccgctattggaggacgtcggtaaaatcacctgtaccggccaagaagttagagcagccggctcagaagaagccatcttccgcaccaaaatcaaagaaggtgtggaaggaaaagccgaaaacgcccgctccatcacctccagagacgggtagaaaatccgtgaactaaaccaaaaggaggtacggtcttgcacgtcggactttaaatgacgcgaccttcgccaacaggtaaattggtatgtatccgcatatttgctttcaacaatttgaatttttgcatcatcacatatttgaatttcatatttgcatttaggatttttgaattttgaggaaattcttcaaatgaatttttcaaagcaaacaaaaaataaaattttcaacaaaaattgactgtgccacgacaacactgaccgttggaatccaacggccgaaagtggggccggttgggcccaccaggggttcggccgaaccggccaggcaacggtcggctgcctcactttttgaggcaacagctagtgggccccacaggtcagttttgaccgttgtgggtgcactacttaagccaaccgaccgggagaagggacttcaccccatttcaacacattttcatcccctctccaaagtttgctatcaagttcattcaagctttgatagtttccctcaaattcaaaatagtttagttgcatatataaaagttgctttggtgaaactaaccggcgggtgaaactcttatcattcctaacccccgccgagtttgcatatgcaattactctatgttatgacgatgatattatagtagtatctggtagtttaggcgtggtgtctagattacgggatatcattatttggggttatatattgcggatgagaggtgggccgctgatggtgacagctcattacgggtattcctccacaccggtatataatcctaagttaattccctggggagggtatttctccgtatttagccctggttgtatggtcatgacgggctgtcgtaaggaactcgacagtctggggtggcttctcgaagtaccaggagggcatcggatagagggtattagctagtatatcggttaaccagaatgtatgtataccatgtatattagaagtatagaaatagattatatttctcttttctgtccacttagcttagataatatattatgagaatgagtagctaaaacttgtgtgtcactctacccttgtattatcttaaccactgcttagaatatgattatcacaagtaatatataaattatttgtcaagttctctacatgatcttcccatgggataaaataaatacgatacccttggaatactctcggttgaaatgctacaatggtatatccgtgcgcttgcgaat

SEQ ID NO: 60361 - DNA, 1048 bp, Oryza sativa
cgacacatggaacacatcatgcacgttgcccaaggagccgggcaactcaagctggtaagcaacttctccacgtcgagcgatgatacggaagggacccacataccgaggtgcgagcttccctttcgtctgaaacctgtgcacacctcgcaatggcgtgacccgaagatacacaaagtcatccactgcgaattccagatcacggcgacggttatctgcataacttttctgccgggactgtgccacctttagattatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttgatagctgttattgtaggagaactcggcataggggagactcttatcccaggtcttcccgaagtccaggacacatgcgcgaagcatatcctctaggatttgatttagacgctcggtctgtccatctgtctgcgggtgataggcggtgctgaaattcaatcgagtacccagctcttctggaagcttcttccaaaagtgagaggtgaattggcttcccctatcagatacgattttcttgggaataccatggagactcacgatcctagcgaagtagagctccgctagtttgttccctccataggtggtcttcacaggaatgaatcgagctaccttggttaatcgatccactattacccatatagagtcatatccaccttgggtttttgggaggccggtgatgaaatccatcccaatttcatcccatttccattccggcacttggagaggttggagaagtccggccggtcgttggtgttctgccttgacacgctggcacacatcacatagagccacaaactctgcaatttcccgcttcatgctaacccaccagtatttctccttcaagtctaagtacatcttggtactgcccgggtgaatggaataaggactttcgtgagcttcctgaagtatcagctgtttaagttctctgcta

SEQ ID NO: 60362 - DNA, 1719 bp, Oryza sativa
attgaccaaaacttggaattacatgaaattatcgggaaccagagggccagaggcccctatggctcagtacatatgtaagccagcccatgggaagatattgtgcgcactctctccatgaagaaattaacagcccatgttggcccactaaatattctactacctctgtcccaaaataagtgtagccatgggtacccatgtccgatgtttgactatccgttttatttaaaattttatgaaaaaattaaaaagaattaatcacacataaagtactattcatgtttatcatttaataacaataaaaatactaatcataaaaaaatttcaaataagacgaacagtcaaacgttaaacatgccggtaccaagttgcacttattttgagacggaggaagtatattttaactctttcctttcagacgactataactactgtgattaaaaaaaaacacttgaccgacgcgagaatggacgtccccatggtttttcattaagaataagcctcaacacccggactcaccacctatggatcaattcttaaccgttactttgaggcccttgcttccaacacgaggactcaccctatataggtcgaatcttaacacatgtttttatgtgggatcagagagagagatttttttttaactaggtctgaaattcaccaaggaacccaggaaaaaaagtgatgcttaagtgctcttgtggcaaagctcaccaagtatattaacataaaatgtatatgcattttggagcaattttttttataagtaaaatacaaacacaggcgctcacaatgcgctcacactcattcctatgaatacacacgcacactctacctctatgaagtcctcatagaatcatttgtgactctggtacaactaagatagtctctggtttctgtttctgtaactgtagttctgttccatatggttttactgaaatcaaccaacatgttatgttagtgaaggctgtatttgtatcaattagagatcggccagagattaattggcatgaaaaatattcttgcaaaaccaggacacatatatgcaatatgtagaacattaatgtttgccaacacatacatatttgtatactaaaatctgtatatatacaaacacaaccatgggcgtcatcatcagagggaaaaaaggttacgttcagtttataccatcgaagtttaattttctcatccttcgccatctaaccaatgcatgcagggatatgcatatatatatatatatatatatatatatatatatatatatatatatatatatataaacattgattgttaatggctttgggagagaatatggtgttacagcactgatcagtgagtgtttcactgaacaggccactacttgagcccagtgcctaagccttgtcttcacaagctgagggttgtcacctgttaagttgcatgcatcacaatttcacatcatcttagcagacaaaaacagtgacataaattaacacaaatagaatcaatattccaagagaaaggggataaatattgttcttttttttctttacctggactgcaaatcttccacgagtccatgaaagaagaaggtgcgacggggctacccgggttcgatgtgccaccgagggtagaggaggacgacgtcgctgatgtcggtgatggcaaggagctagtggacaaacgcatcttgggctccgagagctgccggttgacggcgaagtagaggtcgagggcagggag

SEQ ID NO: 60363 - DNA, 1341 bp, Oryza sativa
  unsure (1)..(1341): unsure at all n locations
nnnnnnnnnnnnnnnnnnnnnnnnnnnnnnnnnnnnnnnnnnnnnnnnnnnnnnnnnnnnnnnttggtatttcttaacgacattactagaaatatgaattcccagcaatgacgccagaaatggtcctagtatatatatggttatagaaggaatcggcaagcgcacggatataccattgtagcatttcacctgggagtattccaaggtatcgtatttatttaatgccaagggaacattgtaagagagaactatgctaataatgtatatatgctacttgtatgatcagagtctaagcaggggttgatatattcataacggtagagtgacacgaagcaaagaactcatatctctcattaaacaatcctacactatgtggaagaagaaatagaaaagcaatcaattcctatacttctatacactcaatcttagtttacatctgctagtatacaactatgtagccaataccccctaacagtgccctcctggtgtttcgagagaccaccccgggttgccgagttccttacgacaacctatcatgaccgtccaaccggggctaaatacggagtagtaccctccccaggaatttctcttaggaatatgtactaacgtggaggaatacctgcattgagctgtcaccatcagaggcccacctctactatccccgcatatatccctaattaatgatatttaataatctaagtaccgtgcttacattactaaatactactctacacccgtgcacatgacatagaaactgataaatcagacattaaacccgcaccattgcacctctctggatggctacccacaaaatcggtacaacacagatataaggtaagaacagtactcagactaaacaaagtaccgaagatatataaagaagaatatttcattaaaattgaaagtattacagaaaagaatacaagagctgctagagccataccgaaactctttcgaagactccgaggactccgaatactattctattctactccacttagcactaaaatactaatactaaagtatgaagaggaatttgagctaacttgagtgtgttgagagagtgaatgagctcctccttttatagggccggtatgacggttgtaccaatgcgaattgtgcattttaccctcacaaccgtcattaagagtgcatccggatcgtacacgtggagggccaggctgattgggcaccgccagttcggacgaaacctgggctagcccaacaggcctacagcttcggtacagtctttgacaggtgggtcctattgacggttttgtagttaaggcggtttccaggacgggtacacctggcttctgagccctttcatccataagcttg

SEQ ID NO: 60364 - DNA, 1527 bp, Oryza sativa
  unsure (1)..(1527): unsure at all n locations
aaggaaaatattatcactgcataaatctgaatttgtgatgtgtatgaaagcatgatatccagtaatatcaatagaatactctacatgcaataccattgcttataatgatgtccaaagtatcaagtgatggtgcatagaagtataggactataggggcttgtagcagcagaaatattagaatggcctcatcctgaaactaaagtatgcagtatttttagtccataacggtctccacatgtctttagtagtaacaatgacaaagatatacagggactgtcacacagtcagtcacatatgtgggctgggccaagcggtgggaggagaaaaacaaaatttgcatcaacaagaagcacgtgaggtaactaacaatgtctattggtaaaaattgtacaaatctacgaaacaaaacgtctagaacaatccatgcatacaaacttttataaaaatatttctaaaagtaatgaccttctcaatctcagatgattcacattgctagcgttcacctttagaatgaatatcctactctgctcttttcagcttggaatttcctcctggaatcaaataataataccaggttgaattttatattgacaatgtactattatttgcatatttcagaaaaaagctagtgagcaaggcatcatacactgttaactgttcaatgtgcaagatgtctaaaatgacaggggaagtatgcagtacgacaataatcaaatctctataacttcgccactttctttactatagtccctcttggtggtgtttggatccagggacttaactttagtctctgtatttagacactaatttagagtattaaatatagactacttacaaaactaattacataaatgaaagctaatttgcgagataaattttttaagcataattaatccataattagagaatgtttactgtagcatcacatagactaatcatggattgattaggctcaatagattcgtctcgcgaattagttcaagattatggatgagttttattaatagtctacatttaatatttataattagtatccaaacatccgatgtgatagggacttaaaagttttagtcccatctaaacagggtcttagacttttttctcgagaatacacaaaagtttttcatgcctttgtatctagaattgggaggtagctcctcctagatttaaaaaatcatccaatattatataagttaagttgtctaaagaagattatatttcacatgttattaagtacccacggatgatttgcttctttttttcccccaaagggncaaattaagggtactggtgccgtcttctccttcatctatctctcagttgtatcattttccacgtacaaaacatgctttgagtcagtgctaccactgataaggaaattgatattggcattcatactaatactaactaaagaggaggaagggcaacaaaggatgggcttgcaaataaatttaaggtacttgaattgcacctcagtggaggcggtggagagcctagcctaggatatgagcattttgtttgttacct

SEQ ID NO: 60365 - DNA, 1039 bp, Oryza sativa
ccaaggacatcaattataaggtccactttgcgatccgcccatttgcttcgcgattatgacgtatatccccgagtggaaacgatgtgaccaccgtgaccgagtgaccttgaaagtagtgagatagtttcttgatagtaattaaaacaccatataatagcttttgaacctgaggatatcttgtcttggaattagccaaaacctcgctaacgaagtaaattagtcgttggactttttggacatggccttcttcttcacgctcaacaaccaggactgtgcttacaacctgggaagtcgccgacacatataacaacagcggctctcggatgtggtgaagctaggactggtggagtagtgagaagttgtttgaagtcttcaaaggctttttgtgcttcgggtccccactggaaattgtctgttttcttcaacagcttgaaaaagggcatcccccgctcgccgagtcgcgaaacaaaccagttgagcgccgccatgcaaccagtcagcttttgaacatctttctgggaacttggcggcttcatgttgaggatggcattgattttccccgggttggcttgtatgcctctatgagacaccataaatccaagcagcttccttgatggtactctgaagatgcacttttcagggtttagtttcatcctaaaagcgcggatgctcgcaaaggtttcttctagatacgtgatcaaatcatccttctgtttggtcttgacgactacatcatccacataagcttcaacattgcggctcatctgagttgaaaaacatctctggatcatgcattgataagttgctcctgcgttctttaatccaaagggcatggtgatgtagcagtaggccccgaagggcgtgatgaatgaagtctttaagcagtcggattctttcagtcggatctgatgatatcctgagtagcaatccaaaaaactgagtagctcgcagtcggccgttgagtcaactacctggtcaatgcgaggtaacccaaagggatctttggggcaagatttgttgaggtcggtgtaatcaacac

SEQ ID NO: 60366 - DNA, 2042 bp, Oryza sativa
ggcgaattcgagctcggtacccgttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagatcgcttccaaagagccccagactaccgcagaactttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggcccattccggcgacgaggggcacgtcctcgccgtcgagagcgctccgcgggccacccgaaaggggaggcctgcgagcgacaaaaagaaagaggctggtactcccagccgggagcgcccagtcagcaagtggtgctccgtccacaacacctccctccacgatctcgcggactgtcgcgcagtcaaaaatttggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatggcctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcagaggttgctctcactttcgaccagaccgaccacccaccgtgcattgcccggggagggcaggttgcgatggtagtttcccccaccatctgcaacgtgaagttgggacgtgtcctcatagatggaggagcggctctcaacatcctttcccccgcggcctttgatgctatcaaggccccggggatggtgctccgaccgtcccagccaattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccatggcgatcttaaagtcgcgcttgcttgcatggagcagcgcgccgaccgcctcgctgctgcgtccaagcccgagggtggtgacgagaggcttggcccctctgcccccaccgccccgaggcagcggattgccacatgcgacgaggtcccggtcaaggaggttgccttgggcgacggcccatccaagaccacacggatcggtggtcttctggatgacaaataggaagacgcgctcgtctccttcttgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtaagtcatccatccggagtggctggcgaacccggtggtcgttcccaaggcgaacggcaagcttcggatgtgcatcgactacaccg

SEQ ID NO: 60367 - DNA, 1744 bp, Oryza sativa
  unsure (1)..(1744): unsure at all n locations
ttagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctattgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccagttctagtcgccccggagccaaatgagcccctgctactttacttagcggcgaccccccaagtagttagtgcagcattggttgtggagcgcgatgaagacaatcctcatttcgtgcacccccactctgtgctaacttggcccgggagcgagcggggaggagaggcccccgagtcggacggtggcctacggcccctgacgaccggagccggccctctgcccgcttgtcagacggtgctaggtgcccccgaccctcagaagggccccaaggccactgcgggaaggccgcacttaacgccctttgaccccgaggctaaccctgtgctgactcgaccgggaaagagcagggagaagaggccnccgagccgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaaaacaagtgcgcccccaaaggccacttgaacgaagaaccccccgggggtacggcccctagtagagaggatcagccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttctgagttcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccgggctggggatccgccgcctcctggtgttaggcgactctcagctggttgttaaccaagtctgtaaggagtaccggtgctctgacccgcagatggacgcctacgtgcgccaagtacggcgtatggagcgccattttgacgggatagagcttcggcatgtgcccagacgggataacatgatagccgacgaactctcacggctcgcgtgctcgcgagcccagaccccaccgggcgcctttgaagaaaggcttacccagcc

SEQ ID NO: 60368 - DNA, 877 bp, Oryza sativa
tacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagaatatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaagaaggagacgagcgcgtcttcctatttgtcatccagaagaccaccgatccgtgtggtcttggatgggccgtcgcccaaggcaacctccttgaccgggacctcgtcgcatgtggcaatccgctgcctcggggcggtgggggcagaggggccaagcctctcgtcccaaccctcgggcttggacgcagcatcgaggcggtcggcgcgctgctccatgcaagcaagcgcgactttaagatcgccatggacagagatggggccaccggggcccggcatcttatctggaggtaggcgtagtggaccgccgacatgaactttaccaacgcgggc

SEQ ID NO: 60369 - DNA, 2877 bp, Oryza sativa
  unsure (1)..(2877): unsure at all n locations
tttacttactttgctccagtgctagtagaaattagaattataatagtcttctctagttcttcaagtcttccggagatttcgggtatggatctagtatctgttccctctcttgtaagactttatccgataatgaaatacttttctttatctagttttggtcctttactatacttgcataattattcgagtacgaactttagctcatacttgtctcgtattaaatatgtagttagcttaccagagatatgcaatagtattgtctaagtgtctatttatatagttgctctatgtcatctgtagagatgtagagtaatatttagtattgtaagcgtggtgcttagattattagatatcattaagtggtgctatatgccacggatctgtagaggtaggccgctgatggtgacagctcagtatgggtattcctccacgtgcgtaggtagggctaagagaggttcttgctgtgggtactcctccgtatctttaaccggttggatagccatgacggattgtcgtaaggaacccgacaatatggggcggtttctcgatataccagggggggcatagttagggagttattagccacagagttgtacaatagtaagtgtatactaaatgactatatactagaagtgcataaatgatgttgttctaatttcttctctatttagcctagacttataatttagtgagagtattctaaactgaaccttttatgtgtcaaatctatccttatcctcaattgattaatccctgcataagactttgatctacataagtatgataagaatttatagcatattactatcctaccatatcttcccttgggattaaataaatacgatatcttggacgtacttccgggtgaaatgctatagcggtatatccatgtgcttgcggaattatttctttaacccatacgattaccgtttaatatttctgacaacattgcttgggactaagttcctagtaatgttgttaagaaatatcaacagccatccctaantcggccaaacctagtcgaagccgctcgtgccaacctgcacctgggtcactgcctagtgggtcttcatgatggtgtacggtggatggccttaaatatgttggttttactctgatttttgggccatccaatctgtgtattcacgtctgattagtatatttcatcgcatgtcagacggttttcctccataattcacatgcatacaaatattcaccaagacttgtggaactagttagtaatatccactacctctaagtttagtattcaattttatattctttaattttctttcttgcaggaattggcagtcggatttgacacttaaggatctacaaacatcgcctcacacgctactctcctgttgatgtgcgcaccgatgccgtgaggcaagagaagtttatgtttggtcttaatgatgaactaaccaaccaggtcatctatggagattatactgattttgagaagctatttgacaagttgatttgtcaggaggatcagcgcaaccagatggatcgcaaaagaaagggagctagttcagggcgcgtcaggggaacaaccaaaagcctcgcttcatgactgataaatttttaagtttagatcagccatgcaaagatgataattcttctaattttagtaaaatttaaggctagatagaaaatgaatctgtgatgtgttaatttggggatgaacaattgaaattccgcacgaagcantgaactggctgttgacggctgttaaataccaaattctcgccgtcaatacctacataaaactgaaagtataaaatatctgaaagtataaaatatccaaaatagtggtaggatatatttctaataatttccacgagtgttgtgtatattagatgtaggtgacaaactacttaagttgagaagaaatatacataaggaggagatcaaactcatattcaaacttaggagtttggacgaaaacaaaatcaacacctcaaatgggnccaaccnnnncacactagaatgaggtcacaattagtgnnnngagaaaaacggggccacggaccggccagggtcagccaccctacaagccacacgcccccccccaaggggnggcccaaagttgagttcggtagcaaccgctccccaatgtgggtttctaccgttttcggctctccaactgtcatccaaatagacgcttggcttgaggagagtgaagatgctcatatgattccatggagggtctccacactccgaaggcacctccaccaataaataccactcctcatccttcattccaactcacaccaagatgtagcttgagctgaattataagaggctctttgtatgatttattttacacatagaatagggagagtatggtagaagaaatcggacgagttctggagttgtcggtaatctcctcttactttttgtacattgttaattactctggtttaatagaattatcttcctgagtaattaagatttacttcatgtgaataattcttggttattttctaattagcatgcgggatcattgttcactaaagtccattaatttattgtgatcgctttagaatttagctagcactaaagtagttattaattgaatagacgcagtatctgggtaattaatttccggtgattccttcgtatcccacagtaggtttgagatcggtgtagaggtggtgatagccctcaagtacactaaagtcctccatgtacgggtatgtagtagagtgacatttgggagtagcgagctggccagtgcctgaagtatcgcattaggattaaactgagctttctgtagacaccgtttctcactaggaaatcatctnnnnnnnnnnnnnnnnnnnnnnnnnnnnnnnnnnnnnnnnnnnnnnnnnnnnnnnnnnnnnnnnn

SEQ ID NO: 60370 - DNA, 2193 bp, Oryza sativa
ttgctagcatgtgtctcacactctgcactccctatgaagaagaccatccaccaggggagtgtcccactcgcaaggtgacatgttttctgtgcgaaggagcaaaccgtgggcccaaggattgccaactcagtgtgttgttgaccaagaccgcagaaatccaacgaacaaccctacgattgtctcgtcagctagtcagctccaacaacaacatcgatgatatcatccacagcaccaatgctcctcttgctccacctaactctgcaataaatcatggcaataataccttcagcattaaccattctctgcaccggcagcctcagcaaggaattgtcgtcgatggaaaaagttgtgtctctccccgacctactccaggccaagcaaagggcaatcaacctccggagggcgataccaagcagaagaccgtcatccgcttcaaacagcaatcagaaggaagcttctcctgtgaatgatagcaatatgcagtcctatcacataatcacagaaccaatcaaggatgatgcagtcactagaacaatgccagctatatctctccagaatcaaaatgagcagccatgtttgtggttttcagctcgctacttatcatggtgtaatcgaaagtttgcagcaatcatgtaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgggattcttttggaagagatcggaaaagatgtttggttactgggaaaagaagtaggtcgaaaggtgattgataaaggataacgagaaccatgatttgtgtcactcgaggaagactcccgatagcaaacaaccctacaacagttgccctgtcattaaagtaggtgaattcacgagtaagagagatgaccgcaggtagaagtacttctatggggacaaggatggaaacttttgtgacatgaccaagaagtcaagaagtaaaacctgaacagtggaatctaaagctcggttcaaccttgggctttgtatcagatgctactagaataaaagcacttgcaatagtatcgctcaacgcattttcctagcaatcgatccatcgagaaagaacacatcaaggctgaaggtgcacaggaatacgttgaatgctaaatgatgacaacatgaagagaatagcgggaagtaaactgaacataaagaaagtgaatccgagctgcttgttcggaaagccattcccaggtatagaaaccagtgattggtttaagatcagtctacaaaggccagatctaaatcacctctaacaacgaagcttcaaaactggcatgatcacgatcagacaataactagtgcagcagcaaagtcattcgggaagacgtcaaagcatgtcaagcgggataaattggttctcttgggaagcataacttatagttagagtggttgaccctggaatcgaatagcagaagtagctagcacccggagaccaggaaagctaatatgaggcagttaggggcaagttgccaaacatgatatcctagtaatgacaaagctgatgtcgacgcatgtcacgaaggtggtaactggtatgaggttgacgccaaagatatgaatgataagaagttctagaactgaagccccatcctcaaccaccgcagcctagtctgagtcagttaaaggtgcaaccagggacaagtcgggtgaagagaagatttcttctgcaacaggagatcgagccaagcagtccagagcggaagaagtcagacaagaagagaagaccgcccaacctatcttcttgctagccccctcgaatctcggggacgagattcttgtaaggggggtggatttgtcacgtcctgataaattcatcccgaaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagcccccaaattttacttgaattttcagagcacaaataataattattaagaaataaacaaagttaaaaaggttttataaaaagaaaagctctaaaaagtcttttttccccccccc

SEQ ID NO: 60371 - DNA, 1051 bp, Oryza sativa
  unsure (1)..(1051): unsure at all n locations
tttcaattcattttatctccaacaaatcaatatataatcttaaatctcctatggttttcctatgatacatccaaacacatgttttaaacgattcctgtagtattacttcctgtatgattcaccatcgtgtgacatctcaatccttgtgttttttatattcctgtattctcctgtgacttttgttgagaatgccttggaaggctgaaacgataggtggtactacgtgttgtttaaactgtgctgataggtagaccacaaattagaacttaagaattgatgtttgccagcagcctagcaccctagtcggaacttggaagggaccagaataatgaaatgatttgttggtcattaatagacagtttcttttgattgacagcggaaattactcgatattgttcttcaaattattagtggtatgaaccttttgagtgattgacaggaaacaaatccaccactatctgttaaagatgagagccaaaagtctgcagttggcctgacgatattgttctgttcatagtcagtcgcgtcttcttgtattggttttgttttaccctgattgcgtgaagtgaaactattattcaggttcgctcaagtcaataagattttcacatttctctttttaaaaagggataagattcagacaatcatttctgcaagtgcatattgttctgctgctccttttgcagattataattgtcgacgctatttgtgatcccgtgcatgcactttggcactcgtccatgcctcattttttccccttccgcagccactgcagatggttggtgatcataggttattcaacactcaagtcctgaacttcccttttccttaattgacaataccagggttggtgccgatattggcttttacctaatttaagtatctccgccatgtgtggcagggatttctcttggttaggattaacctaattaaccatccggcatgatccatgcatggcacagcttgtgggtctcctatttttggggttgannnnnnnnnnnnnnnnnnnnnnnnnnnnnnnnnnnnnnnnnnnnnnnnnnnnnnnnnnnnn

SEQ ID NO: 60372 - DNA, 1076 bp, Oryza sativa
  unsure (1)..(1076): unsure at all n locations
nnnnnnnnnnnnnnnnnnnnnnnnnnnnnnnnnnnnnnnnnnnnnnnnnnnnnnnnnnnnatgtggagctttagtagttagtgggcatcaactttatagtaagatatgatttgacacattaaaagaaaactaaattctattttaccacctaagttgtttcttatcagtttaatattccctccattttagaacataaggtgttttggttttatcctgtattaaactttctgtaagtttaacccagcttataggaaaatatagaaacaaattgttaacgccaaaatttggtaagccccgaggtcatcatcggcctaggaaccgtatcggcttcagagttctagaatcggctaatgggaaatgtcactcgccagcggtcagattcttagtggattcggggcatggcaattacaggaagattatcgagaacagaccaagtttaaagagtatgcggcatggcaatttttgtattaactagatagagtcagttagttccttttatttttaggaaatattgtttagagtctgatcaggacttgtatattttactttatctttaggaaagtttgtgtctttttccagcaaggactaatatctacccatgtgtataaatatgtacatcccgtatccttgtaatatatctctcgatcaatacaattatggcgcatcccaccctttttatttccttctttctcaacgagttcttgtttcaagttaggtttcattggcgtcgatctccgatgaggggtaaggcttgttaaggatgtttgatcggcagggctagggcctcgatactataatcttgtcgatgtaaacatctattcattatatatcttagttaatttaagtcaatgtctgaatttacctgtatcgactagatcttttctaaggatttattggtattaggtaaattggttcatcgatctagattagttaaggtatccaccaccctgaaaatcagtcaaaggccttattgtttagacttaatgctgcatcaattgggtttgacctacaaagtcgtgcttagaatcataaaagctaatctgcctttgattgacaataagggtttcattggtatt

SEQ ID NO: 60373 - DNA, 5201 bp, Oryza sativa
  unsure (1)..(5201): unsure at all n locations
nnnnnnnnnnnnnnnnnnnnnnnnnnnnnnnnnnnnnnnnnnnnnnnnnnnnnnnnnnnnnntttcatcaacacatatacaacaccaacattaaattaatttaataaaataaatctactattgtatagtattcatgtttcaggttaaaatgttaattattatggttttaatagaaacttgctcaaacatggagaaatttgacttagaaaaaccaaaacatcttcattttaaaatagtggttgtactatatgacaaccattatatctagacaatttacacccactaccaaaaaaattcatttttcctgggagccaaaaccggtcctggcatgcggttggccagcacgcatgcacgaaaatgtctgcaaaaatcactattttcgcatgcgctcacccttaatgcagcacatacaataatcgatctttgcatgcaactgggttaagtggcccgcatgcaaagatcggttttcgcatgcagacaagttatgccggccgcatgctccatgaggcccattcccaaactggccatttgggaagatcgtgtctcgtatgtaatacaacatttcccgcaatttcataatcgaaatttgaaattctacgcataggagctaaccaagttgtcattctaactacaatattgcattgacatgtaaatagtcttagaataaataacacaaaacatttatggacgtgtcatacatatattacaaataaacaacagtttcatcacgaacaaaaatattatattttcactatatatgttcttcctcccactctcctagtgggttgaatatgtcttttattgcgatttgactctccttttcgtagaatagcccaagtgcattgtacgcatcatgatgggtgaaacggcagtgctcagcgcacatgttccatataattgtgtcgtacaaccgatttgctacgtaagggattgacgggatctatggacaaagtggacaatatatgttacaaagttatttttgacagaataccctgtatggagtgcaatatccggacttacttcatcactgttagttgtgtacctcttattgactctaaccatctcgcacatgtgttatttacatacggaagtcttgggggttgcttaaaacactgtgaacataataataagagaccggtcaatactaacaagtcaggattctacgaaaaatggtgttaatatcatttgtcagtactgacaagcctgtcttggcgtgtagattattccttgtcggctcttttactggcccacctgttttgcggtaatacatatgtgtgttgctcgaacaaaacatttgttatagttacttagaaatttcataatagcaattatgcacatatggattattacattacttacaaaatcagaatactgaggaactccatgaacgtttccttgtcgtagtgtgttgggtccaatgctacgaacaaatggtcctttggatatactaggaatagtatatagtgatcgctgcaaacaagaaagatgaattagagacatcaattgttaaaaaggatgtattactgcggaaaaaaaatacttagatttacgagcggctgcttatgtaaaagcataagggactgttatgacatttttgtcggcatgcactaattaacatcgctagtgccaagtatgttcctcaaggcgctaagtattgcattagcggcttgagcattcctgtgctcgttctcgtcgtcctccttcgtgggatcctcgggtttctacaaaacatagcctttttcgactattctccaaatagatgggttaatagacttcaaatgcatcttcatcttatgtttccaagcgacatagcgcgtatcgttgaagtacggagctttgccgctataggtactcacataagaagtagatgtggatggatagtcataaggaaacgtatctcccttatcaccatctttgccatcccccgtttggcccgacatgatctctccaagcagttaaggctaattaggagattaggctctgataccagttgaaagggtcaattaggcctagagggggggtgaataggctaatttaaaactttatgcagaagctaaaactgaattagggtcggaaagtttgatccacagccagactatccgaaaataatagatagtctgatgttggatcagactgtctaatctactaaagagtcacaacaagaagatctagcacacaaacaagagtatagcgcaaacagcgactagatctatagcagcacaattaagcaaagctaaagagaggatgaagagagatcaccaacgatgaagttcatggagttgttcccggagttcaaatccttgaggggattctactctccgttgaggagctcactaagagccgggtctttgctaaccctttcctcaagaggttgcactaagcactcctccttctactaaggggtatctctgtccttgcggagatgagatccggccttcacaaacttctcccggccaaccacacgcagagcggtggctcgggagtgacacctagccgtctaggagtcctcaacctccaagagtaaaagacaccacacaactcttggtcaaaccctagtgctcaagatcgagtgaaacacacactaggccctcaaacaccaaatccacaaccacatggatccaccacacaaagaacgaggagggagaaagagctcaaagatccaaagcaccttagcaccaagctcaacccaaagtgaatgagaatgaatgagttgggtaaccctagaaaagggttaggtgaggggtatttatagattcccccaaaatgtggccgttgagagagaatcttttcatcccacctcggaaagtccaaggtgacatcagatagtccgatgttttgacccccaagcaagccacagatagagaacgaaattctggagaatttcgggcaatccgatcgatcggatagtccgatgtcatatcggatattccgttatttttgaagcaagaatttcatcctcttacagagactcaagttccattgaatttcggagtctctgggtcatcggatactctgatcacatcggataatctgatttcaaaatcactcaagaggaaaaaaacaattcaaaacagagagtgaagttctgagaaatttcagatagtccgatgtatcagacaatccgaccttatatcggatagtccgatattttttcgccaacactcagaccaaagacagagagcaaagttctatgaaatttcggatagtctgagcatcggatagtccgatcaggatcggatagtctcacaagaataaaacaagaacacttcaaacaaaggattttgagcactagtgttctaccaattatatgcatgtggtatccctcttaatagtacggcatcctaatactcaagaacacaagatatacatggattagaagacgattaccacaaaacatgctgcaatgcttttaaactcaagttccactcctttttatccttgcattcatctcaacaaaaagcattagtgaacctctaattgtgttgtcattaacaccaaaacaattgaggggtcctagatgcactttcagcagtgaagcttgaactgtagtcggagagggaggagtcggcgcttgagcaggagatgcgggtgatgacctcactagagttggggaaagtggactagtgttgacgcgaaaaacacacactagcctaggagatctgcttagctctagtgtaggtccaaaggttgatgagatgcgggcgtgccagtcagtttgatcctgcaactgacaagatatgtaaacaatagatcaaagagccgatcggctggcaagccgatggagtgattccgaccgatgtcgatacaagccgatagcaatagggtttttgaactatcggctataattctgatgtagaatccgacacttgaagcaaataacaatataaaggtaatcggctgatgatagtaaaatatagcaataatataatccaatagaaaccaatcggctaataatgatatgatagaataagcactgatctgaaagttaaagcatacatcggctggaggaccgatgtcattaaatccacaagattagataaacagtgaagcttttgttgcaatcggctaaatccaacttgtatgtaatccttgtaagccgatgcaatgtctagannnnnnnncctgtgcagcccgatngctctcgcccnnnnntgnnnnggggttcttcggacaaggtctataaaacacctcactacactcacttacgcacactgccaaccaaaaaaaggggtctctgacgcgtaaataataagagactctattgtactatattgtatactagaataggaagagagtagagtagaagaagttagaagaattccggagttgtcggtaatcttctctcatttctttaattctgtttattactctgatttcaatataatattctccctgagtaatttaaatttatcttgtgagaattatctcttgtttagttcctaaatagcatacaggattattgttcactataatcaactaaaatatagtgattgctttggtgagttgtaaacactaaagtagatattaattgcttagacgtggtgtttaggtaattattatacagtaattgctgtgtatcccacggtatgtttgaggtaggtgtagaggtggtgacagccctcgagatcacttaagtcctccctgtccgggtacgtagtagagcgacatctgggaacagcaggttaccagtgcccgaagtattgcattaggattaaacttaagctttccctagacattgtttctcactagtagatcctctctatccttgcctatcctttccttggtgtcnttaagtgagcagatgaaacatctgatcacacacgttcccttggattcgctaccctttcaaatactccgtaggggaagtgcacatcggtatatccatgcgcttcggatttctatctgtgctgtaaaataccacagtcacgcccaaagggggtttttttggatccctgcaactgacaaggtatgtaaacagcagataaaacagccgatcggctaacaagccgatggagtaattccagccgatagccgacattagccgatgccgattctagccgatgtcgatagggttttgagcaatcggctatatgtccaacatagataatgatacaaagacaatcgactgatgataataagatataataataatataatccaatagaaaccagtcggctaataataatatgataggataagta

SEQ ID NO: 60374 - DNA, 1553 bp, Oryza sativa
  unsure (1)..(1553): unsure at all n locations
nnnnnnnnnnnnnnnnnnnnnnnnnnnnnnnnnnnnnnnnnnnnnnnnnnnnnnnnnnnnnnnttattttacacatagaatagggagagtatggtagaagaaatcggacgagttctggagttgtcggtaatctcctcttactttttgtacattgttaattactctggtttaatagaattatcttcctgagtaattaagatttacttcatgtgaataattcttggttattttctaattagcatgcgggatcattgttcactaaagtccattaatttattgtgatcgctttagaatttagctagcactaaagtagttattaattgaatagacgcagtatctgggtaattaatttccggtgattccttcgtatcccacagtaggtttgagatcggtgtagaggtggtgatagccctcaagtacactaaagtcctccatgtacgggtatgtagtagagtgacatttgggagtagcgagctggccagtgcctgaagtatcgcattaggattaaactgagctttctgtagacaccgtttctcactaggaaatcatctctaccctttgcatacattttctttgtgtccttggatgaacctgaagaggaactgaacacacacgttccctatggaaatagataccttggaatactgccagttgaagtgctgcatcggtatcttccgtgcacttgcagattttatctgtgacattaagaaataccaacactggcttaatgtgttcttttaaaagtaaatctcacttaaccctaggtactgtgatctaagttgcacaaaaccaaactattgatcattttactttgatctatccttttgagttctacaattacatcttaaattgataaatttatgagtttttttaatccatcatagaaattttacatggatgtaactaaatcattttaaaattttgaggagtatgtaaaattggttaatgatgtggtttcgtgaaaattggttaatgatgtggatttgtgtcgtgcaccaaaatccctatgattttgtgtaactgttgacagtcgttacagacaaattttgaccgtcaatataactaaaataatggagaattagctatgcttacaatgcatatttgttttcaaataatatagttccacttatacttggagaacaatatgttgcaggaatttatcaaataaaataaagagaaagtggagaaaacctcactcctaagcaagcttatggatgagagggctcagaagccaggtgtaaccgtcctggaaaccgccttaactacaaaaccgtcaataggacccacctgtcaaagactgtaccgaagctggaggcctgttgggctagcccaggtttcggccgaactggcggtgcccaatcagcctggccctccacgtgtacgatccggatgcactcttaatgacggttgtgagggtaaaatgcacaattcgcattggtacaaccgtcataccggccctataaaaggaggagctcattcactctctcaacacactcaagttagctcaaattcctcttcatactttagtattagtattttagtgctaagtggag

SEQ ID NO: 60375 - DNA, 1224 bp, Oryza sativa
catttttcagttgaggtagatgtgagaggcgacgtcttggatgagctagttgaagccctaaagcagcctggtttgagcacctgcaaacaaaaccacacctccagctgtcaatcaatcagcttccaaatttgccaaaattactataagaaaatcttgcaatggtcaagcacgtttaatacacgtctaataaaaccattttctatatacagacttagaacatattgtttttctcaattttatcaaaattatctaattgaatgttgtgatttgtcagatacacattaaaacaaaaccctgctgaaattatctgaacttcgcataccacctgctgaatcactgtaaaacaaaaacatttttttctctgaaccttgatgttcatcgccaaagttgggttaggcagtatccaacacatgggcctaaattgtccctttaggcaatatacatacatatgaggtagtgtaagagatacattacagaagaaatttggagagcagcaacatttacagtgctctcctgtctaaacaaatcgttccttgcttcaattatctttggacatgtggtctatatatactctgtacatttcaataatcttgagacatgttgtctatactcagtccattacaatgctctccagtccaaacaggtgaaatggattgaagccataactcctactacgagtatatgaaataagagtattaacaatgtatatatttcttaccaacaatattgtagatatgcagtgatccttgtggcagtgcaattcaaatatggtatctaaaatatgggtaattatcataacaggataaacaagctacaaaggatttatgccacatgtaaatttacttaattaacttgcaatgtcaactggctgaaataataatttttcgagatgattacagcactttaaaagcaatagcttcaaaggctaacaacaaaaacactatagctgataaaaaaggtacggtaaattatatttcttgccttcaatagtagaaaagaaatagaactgcattgacaaatgaaagatgtccagaaatctcaaaacttttttacatatctagctatcaaagtcacatatatgcccattccagtcaaatatatgattaaattaagaaatgcacaaattggaatacccagaaactgcatcacattagtttgagctaccatgtaataataatctactgccacatgggaatatgatattggggtaccgagctcgaattc

SEQ ID NO: 60376 - DNA, 1445 bp, Oryza sativa
cagtggcggcggcgagaattggagttatagctaggcgatggcgaggtcttgtagtaaacgatcgtcgggttcgtcacatcccaccaatcgtgctcccaattccgctgtgagttgggcaattcgattatcagccagcggtgatgtgccggtgtggtgcaaaagcggcgcagtggatctcctggagcatggacaacccaggccggtggtactacagatgcaacaatcagttgagtgtttgcgatttgttttgattgttttttttttgttggacctagcacattggttgggtgattttgtatgtcaagttttcagggcgccggttgcaatctttttgggtggtatgacccccaacaagcagctttttgagggagttgttgaatgatcttcctgaagccgtgttgtcgctaagaagggagaaggctgagttagagcgtgctgttgaagaactgaggccaaaggaagaagagcagtgcacagagctgagtgcagcaataaatcaagtggcaaatttgaggcttgtggcatcggagaatgatgcaaaaatggctgctatgagggcaattaacagtaggatagagaaacagagatttgtgcttgtaatgttattgctggcatgtgtgtttgtgatgttggttgtgttactagttcagacgtgaggtgcaatatgttttttttaattacatagtacaacgcagacactcacccctgtgaacgcatgcacgcaaaccctacccctatgagcatcttcaaagactgggccggcaaatccttgagattgacgaaatcactacaagcgcctcactgtcgacagtacatcgcccaccactgaagcacaatgccgttaaatcctagaacattcgctctcatggggaatcgaacccaggacctaaggtgctattgaggctcttgtaaccactaggctatagtccctttcgcatgaggtgcactatgttagcaccaattaggtcacaatggtggttgttctagtcctattgctgccatttgtgttaggtgttagttaataacttgatgtgtacaacaactgagctgtaatattctgaattatcaatgaatacatctaagatgcaatatggttgtctggaatttgagtgaatgcagctatggctgtctgaaatttcagtaattccagtgaatttcgatgaagatagctcacattgcacattgcacaatattttcatattacaaacatgatatagctcacaaacataagataccaaatagaacattttgaaatttcagcttagatcaggtcaacatatcagatcatacaaattcacaaacataatatcagctcagatcatcacaatgcacataacttcaacatttttacatgccatctcagatcagatcagtacaagccacataatttcagcaaattgaaacatagctcaaatcaaattatcaaatgtcactcagttcaaatg

SEQ ID NO: 60377 - DNA, 1619 bp, Oryza sativa
  unsure (1)..(1619): unsure at all n locations
nnnnnnnnnnnnnnnnnnnnnnnnnnnnnnnnnnnnnnnnnnnnnnnnnnnnnnnnnnnnnnntaagttgggtgcgtgagtcatgctggccacatgagacgcacatgtaataaaccaactctagcacctccattggtgttcgaaagataattctacacgttcactggtcctcgaaccagtacgtagcaatctctcgcaccgcaacttccattggtgttcgagaaataattctacttgttcgctggtccccaaaccagtacgtagcaatctctcgcaccgcaacctccattggtgttcgagagatgattctacacgttcgctggtcctcaaaccagtacgtagcaatccctcgcaccgcaacctcagatggtcgaggtacgactacagcaataacgcagcggtcctcgcaccacgacttcaaatgatcgagagacacctactcactggttcttaaccattcaatcgtagtgatctctcgtacatttacttctagtcgttgagttacgactactacctggttcttgactagaggtgtagcgattctcccattacctctacttcaacaaagttgatatcaggtacacaatatcgccaagcgttttacccagagatcccttaccacaaaaacacctagcattgaaacctatcctaatgtccttttacaccgtcttgacaaggcctccgaggaacctaagggaacttcggctagggacgcccagagcggataaggccttgtcggatcctgtagagacaaaagaccatgtaagatctggtcgtgtaagagttctcaccgtgcgtattaaccaagccgtgtaatcggaaattgggttttccaacttcacggctgggggctaggataagtgcttattcaaccgatgcaggtcaaaggtctaagagccttatttcccgagaacgattctccgacgacaaggctgggggctagggagagtgtataactcaaacaaattgactgatcgaagttggtaaaagagtagacgctcatatacaaaacattggtatgtaaatttaattcatttttagttttccatacatattataacatgtcaccctttgagcgttcactcgggggctatttctatctaatattcttttctaagtattgatttcaggaaaactctattcgacatcgttgaagactccatgtctctatggttctacaccaagatcgacaaaggcgagtacgacaaatgttgacaaggctccgtcgcagactctacgcctactcgattactcaagaacggttggtggatctcgacaaggaatacggaatgaagagatggtgtacctgtcgagataaaatttcttgacttcaatccaaattctcgattacagcaagacgggtaacttagtcatatgctctgtactttcttggttgactttgatgattgactcagacaaaccctttaggtgcccacacgaggctgataaaggaagtttaacgttatctctgaactcaccgagaacggtcacgtgagctcgataacagttcctctaaggtttgcggttgagaatatgaactcgttcatttgcattgaagtcggggactactgtcagggttatggataccacatacctaatagtagttgactaaatctcgg

SEQ ID NO: 60378 - DNA, 869 bp, Oryza sativa
  unsure (1)..(869): unsure at all n locations
nnnnnnnnnnnnnnnnnnnnnnnnnnnnnnnnnnnnnnnnnnnnnnnnnnnnnnnnnnnnnnaattaaattttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagctgacgtttgggaaagcgagcaaggcaagtcacatcatccttgagcatattgaatcccagtttataaaattattttgatttaaattaatgcattatcgctttatttaaattcccgcgttatcactgttttatttagccttgcctatttacctttgttatggccttattattattgctattgttattattaccttgttcactctagaataaacaaaaccccaactagtgggtactctattcatggttccactagtataaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggctacaggcttactttgtggct

SEQ ID NO: 60379 - DNA, 928 bp, Oryza sativa
cctctttttcttcttcccctaatgctatttgcaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtgctttgcatcggtgggtggtgatgtaaccatgctaggttgtttgcttaatcaacttgcagaataagtgaaacaaacaacacatcaacaagaagagttagttcctttaaggtcttatctctagttctggtctattctttcctagcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccgagcatgctgcttggttcacagctaccattggttggaagtcaagaccaaaatcagtatgtgtttgatcgagcatttgccacccaggtcgatgagcttccaatgccagaagaggatgtccccttttgtcacgattgtagagagcaaggacactatgccctgaattgtccatgggtatatgccaaagaagctccttcctttggtttagcagggcaggcatcgctaaaccagcctcctcgcaccaagtcaagcttgcagcctagtgtgccaagtagagagcccaatggagagaatccattgaatcccgagaattgctttcctcctagcctttcgtaccacgtggggtcacgtacta

SEQ ID NO: 60380 - DNA, 983 bp, Oryza sativa
  unsure (1)..(983): unsure at all n locations
ttcnnnnnnnnnnnnnnnnnnnnnnnnnnnnnnnnnnnnnnnnnnnnnnnnnnnnnnnnnnnttcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacgccagaggaggagctacaacagcctcaaatagataatgtgccagtacaggagactcatcaagagcctcaggtacaggatnnnnnnnnnnnnnnnnnnnnnnnnnnnnnnnnnnnnnnnnnnnnnnnnnnnnnnnnnnnnnnn

SEQ ID NO: 60381 - DNA, 772 bp, Oryza sativa
tgtgggtacagtggtacacctctggccagagtaaaactattcgaatagccgtgcccgtggttatgggcgggttgagcaatgtttttcgtgattagtctcacacctctcacaataattatggatgttatacctggtaataatttgtttagctcctggtttggagttagatctgtacagccgggtatggttgttcaggatggttgggcctgtgcagcatgggtgtgctgttcagtgttgattaaaatttctaattaattactccactgttttacttctcttaaatgttttgctaaatgctgcttttgcaaatgagcctatattatgccatcctttggtatccttgtgcactcgcatatttgctgtgtggcttgttgagtatgtcatatgctcattcttgcaataatcaatcaacctcagttgaagaaaaatgatccagaaggagaagatgtttggcttataccccagttaagctgcctgtgggagtggagctgaagccatcgctagaccgttattccgctgctgttttcttttcttttgtaagtgtaacgttattattatgatggatttgtatattaaattgtcagtttgtgtacctcggctgatttctggacgaggattttatgcacaaataagttcggaaattactagtgaatttccgggcgtgacacaccaccagtgacattcgaaaataaatgcatagttgaaattaatagagaattaaatataggatcaacatgctcaaaggaattgtgtttgggacctgtgtgacttg

SEQ ID NO: 60382 - DNA, 1310 bp, Oryza sativa
gcacagaagtagcttccagcaagaatctggttgagaagtgagaaagagagtaaagtgtaacaattgtcacaattatctgcttaagaaagttggccagttattaaaaaaaaaaaaagagtacctctagacgctggagatcaattactgctgaagcggtcttggcttctgtcaaattgtaaatatcaaacaggtcattccacctaggaaatgtcatgctcttagtaaggttgcttgctatagccccagggaagagaagggctttcacaacagatggtgggaatatctcatttgagaccaactgcgaagatgtaacttgaatgggcgttgtgcatgtgcctgctctacaagggaccctgaaatggcagaagaaggtaagcagaatctacttagtatatttatcgtcctactcagaaaagtacttccaagtattttagtttccaaaatcgaccttatcaatcatgacaaccttaagcaataaactaaaatgtaatttggtaaaataagcaagcatggttacagaagcaaagtaacatacaatttcctagaatccatgctcaggaggaaaaggcgagtccagataaaagcactagcacgtgtacaggtatgggaaaatcttgatatgaaattataggactcttatgaaacaatgtaatatatgaaaagataggagagaattccctctacgtagatccagtccaaaactgaaccacattgagcagtcaggaatggcaacaaaaaagtagcccatcaatctagcaatagcagggaagaagttgaactaccacattaatctgttactaccatacacacctatgcactaaaatcaaacctactggcaagtagtgatatgcatacaggatccattttgaggcaaccatagttgagagcgctacatggtttgctcatattggtaaatttatgacagaaaccgtagcaagaaactattcgattcaggacaaaaaagaacaagccgatccagggtttaaggggaaccaagatatggtctcatcaagtcacaacctgactcttaccgagttctatcagaatatagacacaatttcccacgtcagtacaaaactagattaatttgaaggcaaaatttgctacaggattccccgcaaaaaaaaaaattgctacaggacactcaaaaaatgtgtaattggctgagagacaccgtaaaaacgtgacacggctgatggacactacaaaaattgtgtaattagctataggacaccggagacaatattttataatttatgggtcaaaagcggtgagaaattttttgaaatggcgaaattgcccctggcgcc

SEQ ID NO: 60383 - DNA, 10119 bp, Oryza sativa
  unsure (1)..(10119): unsure at all n locations
gtcctgtggcaaattttgcctaatttgaactcgccttctaccaaattttgcaacctgaatcatgcttttcggcccgaggactgaaaccctgcacatcgagaaactatggctgcttttaaccgcttgaaactatggaggctttaacagcttcttgtccaacaagggtaactgacgagatgtgagtacaccgcctacctttccccatcaacacaacatttagggcagtaggctttgcatggaatcgaggaattcgatggaattctaccacaattatgcctatctaaggcccgtaccctgcatcccctacacgaatgtgtgctgcgtcccagccgttcttgatctggtaatcacgccccaagtcgccaagcagcaccagcgtccacgagattaatcaggcgttcttgagttagctaagattcagcgcacgatcgacacggaaacagaggtaaatcagaggggattgggggaggggagaagggggcgacctgaagagcgggatctggaggatgatgaggaggaagaaggcgcgggaggcgtagaacgatatccggcggctcgtccaccggcccccgcccaccggccgccgctgcacctggaccgccggcgccggggccggcgcaggagacggcttggaggtgctcgccctcgcctccgccgccctctctttcctcgacgacggcgccatggctggcttggctagggcgcgagatgctttgctttgctgtagcggcgcaggagtctctgctttctaaattcgtcgtcttgctgagctaagcactacggagtatagatttttttctttttgacttaagtgaaattaaaaggattaatgataaataaacctatccttccacctcatatactcgcgagtcgcgacctcaacttttctattgacaaataagaaatttgttccagctaggacgttgggtttattacggtgccgttacagcctgtttgttacagttccaactgctagatttagctttaagagttaggtctggagtggagttgtgaagctgtctaaatccagcttcataactctagtttattttgtgatagagctccactcagctccgctcccatttttggtagagctaaaactgtttggctgagctccagctccaggaggagaggagctgaagctggagctgtgccaaacagattaggaaatttttttatccgattacacaagacatacccaccgcattcatatattcagaagtgcgatttactaaatttatattgagagtaaattttataaaacatagtctattatgattcaacttacacaaaaccacttagattttgatgtggcacataatcatatgtattatagtcttaaagcttagcagttatgccgttaaccaaattgacatgctctattaaaatcttacatagatgtaacatttatatgatggataaataactcataaatttgagatatgattgtgagtttcgcagatcaaactcaaatgataaatagttgttgttttgcgaaattttgtgtcataatacctggggttatgagattttatgcaacttataccataatttttttttgaaacgggaaatttattaatcggaagataaatcctccctcacaacatgtgagatgagtttacaagagttacccacaaaaactttgagcttgcttcacaactaacataatttgctagcttgaaccttttttaatacaaattttttatttccgaccataaggaactcaacctcttttaaaaaaaaggcattggtcggtctaactccttagaaaaccgcatattgatcatcccactacaatatgtttccacaactataggaagcatcgtccattgcccattgcatggcatgatagattccctcaacacaagccataagttccgtcttcaaagcaccactttataaatcgatggaacgacatgctgaaaaaatcgaggatccataacaatctcaaaggatcatgccaattccgcatgtgccatctcggtctggtgtgcaacttatttgtgggtaccaagatttaaattctatgagtatactcatgtaacttcaccacacctgccaatggttcccgttcaaactcttgtttttaataccatagcatgttttggaaattttaggagagagcattaggagtttaggtagggaattagtagtgaggatatcatgattttctttttatcaatccattgtttggtagaagctgtgggagtttatattgtgataagattttatattaagataaagggttgtgtcgaggagtgaccttctatagcgggaggccgtgaggccctcctttgtgagttcgaccgggggcagcgggtgagattcaaggattcggtgagcaaagcagtgtgatcttgagggggtcaagcccctcaaagacgatgagaccaaaagggtttatacaggttcgggccgctaagaagcgtaataccctactcctgttctatgctccttgagtgaaggattacaagatcttcttgttggagtaaaatgtggtgttgatcatccggggctagagactgctctagagcgtcaaatggatcgtcccagatccatccccctttttactaggcctgaaccttcttttatacctcaaggggttaccacatgggcccaaaaacctagctccggtggagaagtgttttgcattaagtgtctgtcttgtctcttgacttggaaagcaagcgcacgtcatcttgatgatagggcctgtcaaatcttgccgcctgacacgaggggctcccatgtcagctgctattaatgggtggagacttctgggtcactgtttgcaccgggaaacggaatccccaattgaccagggcggatggaccaactctggccgggatgagaggttaagacctctcgtcatcatgaccgatgggacaagacaaggtgcacgccccctgacccatgcagtagtacgcctaacacctcgagtcccgtcggtcatttgaccagtcacagaccaatttagcgcgcggtacacgccatataaaatgcggcgtggcgcgcctgctcaagtcaccattaatgcgggtaggtgagcgctcgaaggtggccacctaacctaccgcacgtggtgacccgctaagggggtcgggggagcccgacccctagtcacatgagggagtggcctccgcctcacctcgggcctgactcccctcgggggagggccacgtggtattgggggcagcctcctccctctagtcttgagacccctaggcccatatcatcgataggttgatatttgattagacaatgcaaagaggaaatacctcaacttttaccccttaactgtattaaaagcaatagtttatcccttaatttttgatccccatccaactaaaactctgagttcttcctctcgcttttcgcgtacacactttttatctactaaatggtgtgtttttttacaaaaaatttctatacgaaagttgttttaaaaatatattaattcatttttcaagttatttttagctattaattaattaattaattatacattaataaaccaccacattttctgtgctctcccaaacacatatcaaacaaagaagttagcaatcccatctctttaaattcccaatctctcgttaaaatcagcacgagcctaaaagaatccgatgacaaaaaattttgtccgcagtatttgtgtggcacgccatagatatacaaaatcagtacttcgaatgattgtcactgctactagtacagcagactaacaaattagcttttaatagctttatcaggagacatttgacgacaaggacaaggttggttttgagatagggttgaaggaattcctatcaacagtcgacgttggcccattcgactggcgtggccaaaaaaatttatttttgaaaaggactatttttaaaatctaaaaattaaaaggtctaaaaaataaataatttctcttgcagtaatgagaaatgagggtggggagttcatggcggctgctgctcagttttttgccgggccggccaaagagtagggctgtgtgtttatttcttaaaaaaaagttggaagtttggggaaagttggaggtttggaaaaaaagttgaaagtttatgtatataggaaaattttggatgtgatatgatgtgatagaaagttggaagtttgggatagttgggggtgagctcgccgatggaggggggagagagctcgagctcgtcgtcctccgccacacggagctcgatatggccgctgacgccatcaagctcgtgctgccgagctcgagctcgccctgccgccccgctgccgccgtcgagctcgcgcccgccccgctcgcgtcttgctcgccgacgcctcccccctcacgcgcaaccgcggtcggcgacacctcccccgggccgcggccggtgacacccctccccccgcacgcacgcagcgctgtcgtcctcctcccccagtcatcgctgctcaagtcgagctcgccctgccaccctgccgctcacaccgagctcgtgtccgccccgctcacgccgagctcgccgatgcccccctcttcgcccccgctcccgcgtcgactggcggaggcacgggagaggagagaaagaaaaggaagggaggaaaaagaagaagggagaaaaaaatattaaaaaattccatgtcatcatccacgtggtatgccacgtaggtaagaccacggtcaaacgcggttttggaccgggatgatacaataaaccaagtttagggatctcgatgtgcgctttgcaagttcgtggacctaggtgaaacctcctgacaagtttaaggaccgctggtgcattttactcggaaaaaaagttgggagtttatgtatgtaggaaagttttggatgtgatatgatgtgatggaaagttaggagttggggagaagtttggtgtgaactacatagggccttggtatacctgtgtaatctgatgatcattttggaatggtgggtaaaatagaattttagctataaatatttttaattggtttctttatatttttacagcttatcactcaaccaatccgggcatcatatgcatccatggttgcacagccagaggagctgatggccatcacgtggtagaacaagtcttcttggcttgtaaacccagagcttggactaaccatggagcttggactagaacctggaaacagtgagcggtggtgatgacgagatccatcatccatccaggtattgtttactccactactacaagagctagacacaattgtcaaccagctacctcatcatcacagcgagaggtggtatttgatcaaccgtattagcccgtgattatctctactaatcaggaatctcacaacgtgatcctgacagcgattgttgtatagcctctgtcagagctgtccccaaggagaacaacaactactacacccaaacaacagttcatcatcacatcactttccaagtggtaattaattaatttacatatacaacctgctttcctattggtgcttagtattcatcagcaccatccaaccacagtacttgttcagctgcaacttgcaactcacggacaaaacaattatttgaggtggttttcttcccctgtttcttcactctcacagagctagactaattaattaccctttttttttctcatgatggaagtgtattgaccattgagacaagagatatgtcatggttggtccctatggagctcaagatgatgctaacactttcctgatcttggtcttgaacagcatcacgatgatcttatccatggagaagtagaggaaacagcctctcgcatgcgtcacgaaagagccgtagcttgtgccgacgatgcaatgccatgtaggtccataaactttatcaaactcctgttggatatcaaggacaagatgttagaagccaagccagattacattttccttcaaaaacaagtattaaaaagtgaagcagcaacactatttaggttctaatatatcagataatgattttactacgtgtttcagcattaaggctatgtgcattgcatgatacagaagatgctagaagtgcatctcataattgacaacataaatgataagtttctaaaatttgatttcacaaagaacccgtccaaaagacaaagggaaggagcgtatacaatgaacggaatcagtgcaatccctttcagaatacaaaacaaaagtaaacaaacaagcgaaagatcacaaattgaaagaaaaaaaaataagctcaccttcttcacatcatgggccagctgccttgagctgaacttgtccaagctatcatgggaccgcttagcacaccggaaagcatgcagctgcataaatggcgacatgtctgcagccatcaccttcacaccaagcacagagacgacctccttcatgttgatctccacctccggcatcgacttcctcccgggcacgatatcgatgatctccctgacctccttcatgttgatctccacctccggcattgacttcctcccgggcgcgatatcgatgatctccctctgtcccaggccaggaagatgaactctggacttctcaaggcagatgtcgccatccttctgaatggctgtaggaaatgttggagctggaggcttggcttcagaggcaacaggatgctttgtctccttcacagttctcctccatcttccaccgaatagccactgctctgcctttgtcttcctgctgctaccatggtgggctgccattgctacccaatgatctctcctccaatgaagcaatggtgactgcggatgttagctctgaatctgaatgtgtagctagtatctctcctctcccaaagatgattagttctgaatcagtatgggtcttcctaaagccatctatatagcagagttggagaatggcacaagcaaccagaatctctatagtctatagtccaacaccaattaactaaactgatggattatgagtttggattctctgcaatgagcgggtgaggcaaaggacaatttcctctactttaaaaagggagaataaacatatggagaaccgcagaccatgtgcaggtcgccttgttgtgcggcatggtgccctgtatgatggaaaaaagctagtgcaataggctagttggtgcattcaggccagatttgaaggatcccaatgaccaatctttatgaccaaaaggaagttctcaagtactcgaccacctcactgtgcagctcaggttctatattttggatgtcagtaggaccagcctatgtgagagttctgacaaatgttccattttccatgacaagctccttcagcccaggtaatggactggaaactttgtctaagtttgtaacaagcctggatgtgatgattgcttttgttacccacaggagttctcttaatcaacaggattggagataatgttaagacacttggcaacagtttcataccagtaggctgtagcactcaatttcatgtagtccagcctatcttttacaaagctcaatgataggactgtagtatatagaccaatgaacaatgagaacaaattattgaacccgtagcccctatatcataggacaaaatacataaaagaggcaaatattaaaaaataaaggcatctctttcttgtggcttgctgtgatggtaggtagactgaaatcataacactcctgtagattagttatttaacatgttaaaagtttcgtagttatatctaattctcacattattgtagttttcattgtttgaaggtatgtgtaacaaagaaaatctcaactgctacttcgtataaaactcaatcctttggttttgcacagttgcagtaggtgaatgctttgggagttgcctgtttcgaaattgaacgaatattgagggcatgaacactgattcaaacatgatttatgtgttaatttcatggctatgtctatgcctacagtatatgattgtcataccatctgaaaattctcctgttttatttttctttacagtggtctacaatttggtgcctctgaaacaagtgaaccttcatctcccagaatcagaaaattggtatcttcaaaacactgttccaaatgtatgcatgcctttaaagtcaagcattccattcttcagagcttggggctttaagtagactacaatatacttgggactacgaagatgtaacattttggtttcgaaggattaagttgatttctaatgtgtcatgtgtggccacttgattgcaacatttatgtcctccatctgcaccatgactcactttgtacttgtcatgattgttaaatgctgatgctcaagttataaggtccatgtgtgaagttcctcattattctgtcgtaactgatgaactctgtttccttcaggttcaatttatcttataagtacatacttgttagctttttgtctcataattccttcctacagtaggaagtaacagatgcactccattatccagacaactgattgtaagggtgttttaaaatattattttaagacacttggagaaatacttacatattaaatgatacatcataatgacaaactgttcatttattcttgtgaacttctattagtgctcatttttcttattctatctttgtacataatgttcacttccttgcgttcaaggctctttgcgaacttgcattttcaaaagggtttaaattatatatggcttaccttccaccacccatcaagctatcctaaaattaatacagaaaggtattgaatttaatatgttagaaggaatattatatcataatatactgcataaacaaactggttctgagacatgatcagacaacataatcatgttacacccatcatggatatgtttccttttgctactctagtttaggaaaacaacacatgctgctttgagagacagagacacaaccataccaccaaaagcaatttgtataatttaaccaaccacattagtttacataaacttggaagaatctcaactagcttcaaatctcaaaacagatgaaagaaaattcaagttgtacgaaatatagagaagttcaagaatatcagaaatatgataaaaataatcagtatacactattaagtgtatggtattgcaaattatgttgaagagacaaaaactggaggaaaaggtacagttctattgaagtgtaaaattcctgttctcccagagtccatggacaccatacaaaaaacattgagcgaacatcttacaaccaacaacgaatgttaccacatgatgtcaattcaacatacaaggcagtgattctccgcatgtgtatgaccacaacagacattgaaaaatcaattcatggaaaattggcaatcacagaaataagcagcaatgcaaatattatacttgggataaattttatgtatactatagagtgcaattatctctacttggaaattttaaaatgtggaatgctctccacctcagcgtgcacctattggagggcatccaacaggaagcggaagatccaagttatcaacaattctgaatgtcctagggaccatcgtgtcaacatacaatgtaccttcaagatgatcacattcgtgctgcaggatacgtgcctgccatcctgaagcttctaccttgatggggcgtccattcctgtccaaacctgaaacctcaacatccaggtgtcgctcgacaagtgccctgtatccatctacactgccatccccagaagacacatgagaacaagcacaatgtaatccagtacaatgcataatgagaaactagtaataacatcacaaagaagcattctagcgagtacctcaaacacccctcgaagaacaatgcagttcttttactcgtcgtcttaagcttaggattgatgataacctggtatccaagggacacaaggaaaataaaacggcatgagaaggcggcaatattgcctaatgataattgttggtgaaggcaactacataggacaaatgtactactactcacaagaagatcgaaaggacggcgatcctgcgcttcaatgtccttcttgggagcatagctgatgtattcttgggtatcctccaggacgataatctatgaaattttaacaggtcgagcaattcagccatgtgtcaatcaggaacaaacataagcaggtaattaaacagttgaacagtagacgacttagtggagtaatttggagnnnnnnnnnnnnnnnnnnnnnnnnnnnnnnnnnnnnnnnnnnnnnnnnnnnnnnnngc

SEQ ID NO: 60384 - DNA, 872 bp, Oryza sativa
  unsure (1)..(872): unsure at all n locations
ttttggtgaaaaggatgttgagtgcactgccaccatcgatgagggatctgcgaagcttgacgttgcgaaccactaggtctagtaccagggggtaccgccccgggtagaccactcggtcaggatgatcggagcgtcaaactcattgttgtctccgaccaccaaagaaattggggcgtatcgggctgagcagcgttgatctctcattcggtcagcttttgcttactcttagattcataagccaggggtccgccaaagatgtggttgagttccttgtgatggtcttgaaaaccagtcggggcatcatcgtcatcgtcttcttcttcgacgtgctttgatctccgtcgaggcctacgtggttcttacgtgcgttcttggcgtattgttctgcaaactgtttgtagatgaaacaatcttttgccacatgattggaattgggatgatgcggacattgggagttcatgatcttgtcaaaagtgttgacacgcgaacgttgtcagaaggatggtgttgtagttgtcacaagttcctcgggcttacgcttgcgatccttgtgattggcacttccactcccttctgtagtcggcgtatctttctttggcttctaagtggtgcccgactgcttggacgcgataatggcatcttcggctttggcatactcgttggctttttcaaacatctgtttgaccgtcttgggaggcttgcgcccgaacttgccgactagatcttcgtgacgaattcccttggtgaaggcggcgatgataacgtcgtcggtaatgtcggagatcttgttgcgttgctcagaaaagnnnnnnnnnnnnnnnnnnnnnnnnnnnnnnnnnnnnnnnnnnnnnnnnnnnnnnnnnnnnnnnnnn

SEQ ID NO: 60385 - DNA, 1373 bp, Oryza sativa
ccacgggttgtagaggtagttaacaggtggtgacagtattcgggtacatcatagagccatagccagagtctccttggcagaccaggggtaagccgatgcttgaagcaattgatagagttttatcttaacttgattaagataattaacccataggaatcctctctattcttggcctaccatatagttatttcccttggaagaatctcgttcttagattatacacatacgttgcctgtggatactatatcctggaatactcttggggtgaaggctacgactgtatttgtgcgcttgcggattattctgtcgtcgtaataaataataataggcggttgaactcgtgtaggtactctatagctatcttgtttccctaatgaagcgcatggaactccctcttattttgtgctacagtcccatcgggaacctatgccttcctgaagctacggcaaaattccgcccaagtgacatatgtcacagctgagcgggtgaccatgtagttgtcccaccaagcagaagcgggaccttgaagtttgtacgtggcaaagacaaccttctcctagtcgttccaccggaggaggttcatcttcttctcaatggcatgaagccagtcattggcttccattgggttgatggtgctggagaaagtgggtggcctgacatggagaaactaaagtagtttggactaatgtggtggtggtggaccaaactgctgattcagctgctgcagtgcctgatggtgcatcatctgctattgcatatattggtgttgtttttgcatctgctgcatatcattgtatgatatgcgtctaattggccaacacctgagcgattgttgaattctctagcggtggaggtggaccattgctagttgcaccactggtattggctcctccagtctattcctcactgctgctaccatcacctgttgcatggtcgccattccttgtgttcaccatctgaatggggatggacagaaaaagggggaaaggaaagaatatagactgctaaaaaacctaagctttattacattataatttagtgcaattgtctaatctgaattaaaacaactacaaagaaaacaattcaactcctaattaaggtagtcataccgcaaccactgttgacggtcgttgtcgatcagtttcgaccatcaatattaccaaattaagagagaactagtgatgcttgcaatgcatatgtttgttagaataataatattccactagtattaggtatattaatctttgtagagaatgacactaaagtggaggagaatcggcataacatagacgataaatcaatcggacaatgtcgagaaccagacttatgtatgaatgggaaaagaactcagaattgacacgatgaattaggcc

SEQ ID NO: 60386 - DNA, 947 bp, Oryza sativa
cgccatcgcaggcctcacgcgcggccgccgccatcgccagcctcgcgcgcggccgccaactgcctcgccatcgcaggcctcgcgcgcggccgccgccgtcgccggcctcgcgcgcagccgcctcctctacgcgctccacgccgccgcggcctcctcctgcctcgccgtcgacaaccttgcgcggcggctgctcccagctaattttgtgatttcaggtggaggaagatggcgccaagggcaatctcgccatttcgaaaaattgctcacctcttttgaccaaaaattataaaatattgtctctggtgtcctatagctaattacacaaattttttttgtagtgtccattagccgtgtcacgtttttgcggtgtctctcagccaattacacattttttgagtgtcctgtggcaaattttgcctaatttgaactcgccttctaccaaattttgcaacctgaatcatgcttttcggcccgaggactgaaaccctgcacatcgagaaactatggctgcttttaaccgcttgaaactatggaggctttaacagcttcttgtccaacaagggtaactgacgagatgtgagtacaccgcctacctttccccatcaacacaacatttagggcagtaggctttgcatggaatcgaggaattcgatggaattctaccacaattatgcctatctaaggcccgtaccctgcatcccctacacgaatgtgtgctgcgtcccagccgttcttgatctggtaatcacgccccaagtcgccaagcagcaccagcgtccacgagattaatcaggcgttcttgagttagctaagattcagcgcacgatcgacacggaaacagaggtaaatcaaaggggattgggggaggggagaagggggcgacctgaaaagcgggatctggaggatgatgaggaggaagaaagcgccggaggcgtaaaacgatatcc

SEQ ID NO: 60387 - DNA, 2617 bp, Oryza sativa
  unsure (1)..(2617): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtaagaatctgagagaggaagaggcagatattcccattactccaattgtacctgatagatgagtagttgcactatattgtccagttcttgaagcagaagaactcgcatccaaaatcttcggttcagagggatcgacgacactgttggtcttcaaaacatttggagatagtctttcactataggcaaagcatgaatactgggatctacatgaggcaaatcttctacttgtaccactcacacaatcaaatggcaaggataaggaacaaggaggtgaaatggttgcagccctgcaaacatttttgagtcattttgccatagctctcgaagtctgaatacactaaacaccagtaaatgctaaaattaatttcaagaagtaacagaagaacaactgacctctgtatagacatctgaaccatggaactgaagtctgaacagcagtctgtaggaaggcttgggaagaatgtgaactgcaaaagcagggctttttgacaaattaggctagcagaggctaatgtagtctaggtggaaggatagttttagatcttaagcaaccacttatactagtaaaaacaagaaccaaataggctcatgtataaccttgacaggctaaccatagcaatcattatgacagcaggaggaagtaacatagagagaagggatctcaattattgaagaggagcctatgcctgtttttatctcttgccaagagagaaatctgacaagaagagcattctagaagactatgatagctgacttgagaaaccacctaacatttcgaccgaatcagcttatctcttcagccccttctacatgacaaatccagtagctccgtggcattgtttgcttcttcagacttgttaatcagcttcaggctgcagtcgggtagataaaagagttcaggtctggtttcaccagaagggcaagcagcagagtgtacaaaaatacagacaggttaaaaggacaatgctcacatggggtttgggtggggctcagcctgtctcctttcctctgatctcatcatcaaccagacatcaacagagagcaagagataggagacgagccacttgcacatgcagccttgattcttgcccttctttacacaatacaagtatacaaatgctaggacagcagtactgccgctaatgatgtatcacttcatgatagagcaaattctgacagatacatgtgtcctgtcctcttcaactcccattttgttcgattcatcagctaacagttcagaaagtacttcttgtgtagaattccaaatgcagaataaaatagaaggacacatcgtccattgggccagtgtgagaatataggtgaaaacaaagttactgggaaacttaaatagttaaactaaaatggtaatcataaattcttgatttatcagaggattaaagcaagattgtactgacaaagaaaatgaatattgaacaagttatactgtgggaaaacttcccatgtatctgagaacttcagagctataggttatagcaagtaatagatggaatttacaaaaagataaaatatcatccttcaagaggaagggtgacatgatgccagtagtcttaacagtgtaaacagcatatacataaataaatacgagggaaattaaagtgaatatgcttgcaataaaagttatagatataagtctttgatacaaaggtgaaaactgaaggttacagtattcaaagtggtacacaagaaccacagtagtgttatcctttgggccagtcttcaacaataaatttgtggaaatgaactacaaggatgaaggggcaaatagacaatgaagtgtctacttcagtttcgacttggcagaactttgcagaggcttagtgattgaaacagactgactatttcttactgtcttctttacattgtaagttattgacaagaatgcacaaatcagtgcaattaaaatggtcggataaacatgaactgattgtgttggatcactgttcaccggtttcccaaagagcgcttctttcactagaccccagataaccaaaagggtaccaaacaaggtcatcctcccagggtttatgacaccaacaagtgctccagcagcacagaagtagcttccagcaagaatctggttgagaagtgagaaagagagtaaagtgtaacaattgtcacaattatctgcttaagaaagttgggccagttattaaaaaaaaaaaaagagtacctctagacgctggagatcaattactgctgaagcggtcttggcttctgtcaaattgtaaatatcaaacaggtcattccacctaggaaatgtcatgctcttagtaaggttgcttgctatagcccccagggaagagaagggctttcacaacagatggtgggaatatctcatttgagaccaactgcgaagatgtaacttgaatgggcgttgtgcatgtgcctgctctacaagggaccctgaaatggcagaagaaggtagcagaatctacttagtatattatcgtcctactcagaaaagtacttccaagattttagtt

SEQ ID NO: 60388 - DNA, 794 bp, Oryza sativa
tacagattcatcatactaataacgtaaatacttacaaaagaaaagagaaaatagcagcagaattatggtctagcgaagctccggctccactcccacaggcagctcaactggggtataagccaaacgtcttctccttcgcaacttgtcttcaactgaggtttgattgattattgcaaggtgagtacatggaatactccgcaagccacatagcaaatatgcaagtgcacaaggataccaaagaatggtataatatagggttcatttgtaaaagcagtatttagcaaatatttgagaatcgtaaaacagtagagtaattaatcatcaatattaatcaacactgaacaacacacccatgctgcacaggcccaaccatcctggacaaccatacccggctgtacagatctatctccaaaccaggaatatagcattccaaaccaggagctaaattaattaccatcaattaccacattattattaatgagtagcgtgggactaatcacgaaagacattgttagacccgcccatgaccacgtgcacggctattcgaatagttttactctggccagaagtgtaccactgtacccacaagacacagccccacgacatgtcaccatgcgcctcaataccaccacggtacctcggaaaggagctgtgacagtacccctcgcataacacaatccaccacagcgcaccgttcctagatcataatcaatcccttataaacaaggcatggactccccagcgacccccgtgggcttatctccgccacttctcagtctggtaccctgcaatga

SEQ ID NO: 60389 - DNA, 1209 bp, Oryza sativa
  unsure (1)..(1209): unsure at all n locations
ggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcgacggcagcgaaggtgagccaacggtgaggatgtagacgcccaacagcggcggcataataggccagccgtgtaggcggaggcaccactcggcggcgacggaggcaggccggcggtgaagtcgtagacacccaacagcggcggcataataggccagccgtgtaggcggaaacaccactcggcggcgacggaggcaggccggcggtgaagtcgtagacgcccaacagcggcggcataataggccagccgtgtaggcggaaacaccagtcgacggcagcgaaggtgagccaacggtgaggatgacgatgcccatcaacggtggtgtgaccaaccgaccgtataggcggggacaccagtcggcggtgacggaggcaggccggcgtgtagatgacgatgcccatcaacggtggtgtgaccaaccgaccgtataggcggggacaccagtcggcggcgacggaggcaggccggtggtgaagtcgtagacgcccaacggcggcggcataataggccagccgtgcagcgaaaacaccagtcggcggcggcgaaggccagccggtcggtgaagacatggacgcccatgaacggtggtgtgaccgaccaaccgtataggcgatgacaccggtcggcggcgacggaagcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaannnnnnnnnnnnnnnnnnnnnnnnnnnnnnnnnnnnnnnnnnnnnnnnnnnnnnn

SEQ ID NO: 60390 - DNA, 936 bp, Oryza sativa
  unsure (1)..(936): unsure at all n locations
cagccgattgcctttatattattatctacattggacatatagccgattgcttaaaccctatcgctatcggctggtatcggcatcggctattatcgctatcggctggaactactctatcggcttgtcagccgatcggctggtttgatatactatttgcatatcttgtcagttgcaagatcaaactgactggcacgctcgcatttcaccaagatttggacctgcactggagttaagcagatctcccaggccggtgtattcgattttttcgtcaacacctacccagattgtttgtcctgtatttgtaattgacacagttggctggattattgaaatatatgagtataatttatctagaaccataatatgttgatacgatatgcagcgatattaaaatgaatcgacatacctatatataactacaaattgattgatccaacaacgagctatatatctgttttagaggcaaccggaccagataaaggaaaagctaacgcatgcgtgggcacttcaaaggcaaaaattatagagtgatagcatataattaagtaattaaacatgctcaatcgccaacaaagtgatcgagctaacgttgcttaggacaacacgaaggctcgctagcaggagatgtcaacaagcgcttacagtggccggtgtgataaggcggccggtgtgataaggcagtaaggcacattgggttgctccagactgtggacgctgttaagaagtgcgtctcgagctggacatgtattataacagtgtccacacctgtacgctgatgacaatagcgtccttactactttggtaaatccctacagataattactacttatttaatttgtgaaggattagttattataaataaaaaaatcggtattctaattacttttcccaattaaattannnnnnnnnnnnnnnnnnnnnnnnnnnnnnnnnnnn

SEQ ID NO: 60391 - DNA, 845 bp, Oryza sativa
  unsure (1)..(845): unsure at all n locations
nnnnnnnnnnnnnnnnnnnnnnnnnnnnnnnnnnnnnnnnnnnnnnnnnnnnnnnnnnnnnngtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccaatgcttctgatcgctctttaattggataaatataaccatagcgggagtaatcatct

SEQ ID NO: 60392 - DNA, 969 bp, Oryza sativa
  unsure (1)..(969): unsure at all n locations
nnnnnnnnnnnnnnnnnnnnnnnnnnnnnnnnnnnnnnttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccatttccaaagcggcaatcatatccatcaaaatccaactttgatacacttattaagttcctttgcaaagaaggaacataaaagacatctcgaagtaaaagtatgaagccattcgagagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaaatcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggaaatggggccataaccagatggacca

SEQ ID NO: 60393 - DNA, 838 bp, Oryza sativa
agaatattagcaaatacttaattaatcacacgctaatggactgctctgttttccatgagcactgtgcaggctaggaacgtaggctaacgaacgcagccttagaagggattggaagtgtaaagggatgagattgttagctgctttgtttggtttgtagacatggggaattttggtggattggagggggaattaagagcatcaccaacatcttacttattttattccttatcatcaaatttaggaattttttgtcaaaaatcgtctccaagagaatccctatcctatctttcaatagattaggttcccaaatatagatatatcgtacctcacttctggggagtgaatttctatttccaatcgcgatcaactcactctcgctcactcacagcaaaaatgtttgcgcgctcctcctcctcgtcatgacatcattcctccgcaacagcgccatcttcagcgacgagctcttccttggcagaagttacggcggcctcttcctcggcagcagcggcagctgcggcggcctcttcatcagcaacggcgccggcgacatcttccttcacagcgacgctggcgacatcttcctcggcggcgcccttttcttcgcagcaaggttggtctcagtcgttgcttccgcttagttcctcagcaatggattggtaccacgacgcagtcttggtgcttggtattgaaaaggagagaataacttaagaaaaatatcttttttcttttcttaccaccgattctacgtgaaaaatgggttaatccaaaatgctcaattattttatatatattgtagaggtaacctcacctaactatatgagaaggtaaccacacttac

SEQ ID NO: 60394 - DNA, 787 bp, Oryza sativa
ttatttttgctgactagaatgcaacgtcagcgaaaccacccacctatactgccaagggacctcctgggaacggtttcaatgagtttaggggcgaacatctctggttttgtagttgagggaccttaaaaaaaactcgctgttaagttgagggacctccggtgaacttagtctcaaaaaacaatcgtaattagcaggccgccagcccagcccacctacttctcctacacggcccaactgccacgtcagctaaccacctcattcaatccactccactccacggagccaacccgagctcgcgagatggaagctcacctccggccgctctccgccgcggcgctcctcctttcccccgctgcgccgcttcccaccgccgttgctgcttctgcgaggagagcatcccccggtggcaggaggtggagcagcgtgagggccagcgcgggcggcgggggctggctgtcgggcctgctcggaggcaagggcggcggcggcgcgccgacggcgatgacggtgacgccggggaccgtgaaggcgggggaccccgtcctgcacgagccggctcaggacgttgcccccggggacatcccctcggagaaggtccagggcgtcatcgaccggatggtcgccgtcatgcgcaaggcccccggcgtcggcctcgccgccccgcagatcggcgtccccttgaaggtaacccgcaaccgaggacacgattcgtgcgatcgctcctgcattattccattgcattaattgctccaaattactccactaagtcgtctactgttcaactgtt

SEQ ID NO: 60395 - DNA, 820 bp, Oryza sativa
taaatatatacatatcccattgctttagtgtcctcgctaatctcatgcgatatggagtaaaatttgactgggtcgaggctcggacttgtcatacactgaatccgctcctgaaataggccccaaagcaactgtaatgtctacctaggagaaagaggaatcgcaatcttgaaagcataaaagaaatgaagcactaattgttggaacatccattagaatagaacaagccagttttgactatataaataagtaaaggataattgagggagtacgacacaaattactcatcaagttgttgagttattactataaatttaaatttaagataggaaaggaaaatagaactgctaatgctttatccatagtccaatccttggatcactttatggaagttctaatagtgattcccagatagccacctaggttgtagagagtaagggcctgtttggcacagctccagctgtggagctagagctcagctaaacagtttcagctccacctaaaatgggagctgagctgagcggagttctctcacaaaatgaaccaaagatgtggagctgggtttaggcagctccacaacttcactccggacccaactcctggagctaaatttaggagttagagctctaccaaataggtcctaaacgaagatgaaaaatgcagagaaattgaaactaatataaacttaggcttgatccaaatgcacaactcaagaaattatgcagagagtacaaagacatgatatattgtgggaacatgaaatctttgagaaaacaaactcagaagtcctttcatgatttggccttagggggacattctggag

SEQ ID NO: 60396 - DNA, 6771 bp, Oryza sativa
  unsure (1)..(6771): unsure at all n locations
nnnnnnnnnnnnnnnnnnnnnnnnnnnnnnnnnnnnnnnnnnnnnnnnnnnnnnnnnnntattaattaggatgttttatgtaatttccttagagatatgattgggcaaaagtctgccgcaaagacttatagtatcttagagtttgttagagatagtagtcgtgtccgttatagacatatcttgtaattctcgggtataaatagacccgagccctatgtaacttttaacacacgttcaatacaatgcgcatcgtcacctttttgctttagttttatttcgacgagttcttgctttcgggttgagctgcatcggtttcgatcttcaacaagaggtaaaacttgttatgacggcttgcattctcaggattagtgcttccatctttatgacactctaatcttgtttatgtaattcgtcgggttatcatatattttatataatctctggcaataccgctatctaatctacaatcggctaacatctgtcgaagagggcagccgattaggttagattttgacgttgactcagattatataagatatctaccactctatgaaacttccagcggcttgattgtctagatattgttcttcttttcatacttaatgttgtatcagttgagtttgatctattaagtcgtgcttagaatatcaatctctagcctgctttctggttgccgattagggtagcatcggagtttcagccgatcttatctgatttaactatatttgctctatatgctttattgacatgttaaatttgccctttatgccaagatattgctatatttgaatatattaggcttttgcttgatattctatacctgttttaatatcctgatataaagtagtatcggagtattagccgattcatgctagatctatctgatcggttatgctataaacatatatagtcctgttattaatatatatttcggtctaagtggtttatactgtctcggcatggcgaccgatctatcccaatcacttgatttaagtatatatcgatataaggagtatatatcgttaacatctacagccgatcaagtagatttagttctttcttacttattcaagattgccgatcgatacacatattacatcggctcagagataaatgatatgtcatcggcacttagccgatcggctatcatttatagatttaaccgcgatttctttgcttctacttcttgttggttacatgatcaaatcaactggcacgctagcacacccgtaggcgagctttggacctgcactggagttaagcagatctcccaggcctcgtgttttctgtcaacaggaaggaagacgactacattttttaaatagtagagataaaaatggtactgctaattaaaaaaaaatagacatacgtccccaagtcattttagattggattcatgataattaatcacatgtacagctttataacaaaagtatatttgtattattatgatttttatttactcataaatattgtactttggatattctcaatggccataacatgttcttagagataataattaaattgcaatccagtgcttcagttcattagtagtatcttttgcatatatataaatattaaataaatattgaaatcatgcttgggatttaaaactgaaggatcaaaatggggtgcatggatatagataatatcttaccatgcatacacaccctatattatatttatcaatttggctatggccccaattaattttgaacaaaggtgaccggatgtatatctcatatctatcgtttagatcccttctccaaaataatacgtaaatactttgcattctttacccttgcctttccttccactcccctcctctagtcgccgcctcttactcaacagacatccaccccttttataaagccacttcaattagcacatctcaccctctcgaggaaaataaagcatataatagtgatacccggatacagattctctgcagtactgcatgtacagtcgtagtaaactttactgatatgtgttctacagtgagctgcatataggatctcgacgcagtgataccctatagtcaatccgcccaaccatagtgcatttctgttaagcctgaacactatgcaatgtatgcatgataagttcaatattgtgcaaacaatatatcaacattacattattcctctcaagtcttccattctccaagcttctacatgtattttcattcttgagctcctttataagttaggtccaagtccaataacctatcataacccccttttattttggcaattggaaggtaagcaaatacaggtaagtgcaactgtatgttattcttgggtcccgaaatgaaatagggctagctaccgacaatttcatcacggccaccaagttgcgccagcttccactctatatgcatgactgcatgctttgctccagttagctacgtactagcacaaccattccattttgaatatctattatatactaactaaaagtccattgaattctctataaaagctctcaagctgtcacatggcgttctacaaattaacgctcctaagacgtcatacagtgcttaataaacgagaagaaaatttctaaaatttatggtaaagaaaacctaacgattgatattcctttaaataggtagagccaataattttcacccttaaatctccaaaaaaatcaggtatccccccccactctcctcccctattttctagctaacacataatatataaaaagataatagttagatagcaaaatgatcgtgattctcaagttacacatacttttcttaatttatttgatttgttgtgttatttataattaaatactccctccatccaaaagtctaagacccattctattatttggttttctctaaaaatctagtcctatttgtagtcactatgtgctaaattaaattattaatcggaaccaataagtcattttagtatttattggttgtatgtttattggttttgtcacatgatgaatgagttagttgctccttggtcttggacttttggatgaagggagtacataattcaagatccatatttctcatatttactatataaaaattagataatgcagccgttctaattacaaatatttgaacaaaatttgcactttgaaaacgatgaaagaattcaaatatgtgagtctaaagttcaggttcaatcaccaccaaggagcttagaaccatgatgcatattctaggcctgaacccgacggaggcggaactgcaagacattattggtgaggtggacaccgacggcagtagcggcagcttcgacttccacgagttcctgcgcctaatagtgcgctagatgattagatgaaggacaaggattgagaagaggggcggagagagacgttccacgtcttcgacaaggactagaaaacggctccagctctaccgccgagccacgccatatcatgtccaatgcatcaggagaggctcattgatgaggagatccacgaaataatccgtgaggccgatggtgataggcaaatcaactacaaggagtttataactaaattcagaattaaaaataaaacaagcaatttgattaaatacacattcaaaaagtaaaaaaaatattaaaactataaaaaaaataagaagatttcatgtagaatataaaatatcaagagttcatataaaagtatgagttataaatatattaaatttgaaataataaaataactattaaaaagatgagtccaaatactaaacgatacaatattaagtataatttaaatcactaaaatgacaatttagaataaaacaatagtttgatttgaatacagatttgaaattagaataactcgatcactaaatttaaaatataataaatatttttaaaagaacttttccatctttattgattcacatgcataacgaattgcatgtatatgaatttttaaagagagggcttgcagggtggtaaaaaaatacatttattaccaataaaagtttatcgagatttcttcagaaaaaaagatacgatgaacactcaattaaaaatagaaatcaccttactttaatttcaacttattttgttagaactattttcaaacaaactaataagcatgcctacgtgaatgcgtgggttatcttcctagttaagtttaaaatatatatggagttaacatgcatatatatgtccgatggattaactaattcaacatttttttgtactatctagctagatctagctagcttaatactagaattacaagcatatatatatgttctgctagtattagcaaagaaacaattgtcgttaattggtcatacaaaatattccatacttaaattatcaacacctggtggcttctgggaatttggggtgatagagaaagaaatatatagagtgcatactatgaaaatgtgtggtttttggctactgtgatatgtacatgcatggctaggatttaggattcagattggaaggcttccatttgacaacttgtcaccatcgttttgatcgatcatcagggtagataccctagccagctacaatattactgaattttgacaaaaaaatatatacttgtcgatctttttcgcgcgatacgtatataaaggttggaacagagacccatatatatataatttcatcgagatgtgtacataaaaaatcaacaaaatggaggacctggtgtaagaaggggaaaagaagaggcccctgtgcaaaaggtgtgggaggtcatggaattagaggaggagattcaaaagggaggctgccttttttctccatgcttatggtgtgggatctctctctctctctctctccaaaagatggagggatggcagccagaggaggaagacgatatgatccatcatgcatctatctagggatctcaacattagctgattgatcagatcgatccaactaactgaaatatatggacacaatatatgcttccatgtgcagtagtgtataggtactgttcatggtgtgcatgaagataccaattaatggttctctttgcaaagcaaggtcgttttcctagatgtggccattggctaagaaggtgcttatcttgatcatatgcaccatgctacctagcaaaggcttatcactgtttttgttggggcaaaattaaagagatcttttaaaccgcatcaaggaaaaaaaagttgagctgtagatcgagtgcgtaatgggacagaaagggatgtattccctcaaatgttcttctaaatattcgagagatgtatgtactactacctcagctccattcttctttacttgttattcccgacattagaatggacatctcaaacactttagaattatgataacttggtatgccttttttttcacaaaatctatatgcatatatttttttagataatggaatataatatcccggtatatgcatatatatcatctattccatgtacatatgaatatatactttgtttaccaatatgtggccaaattaagttgtttaattttccatgcacgctctatacagtgtgtaaatcgtttccattatctaaaaaatgcattatacagtgacttatgttaccatttagttaatagaggtgtttacaaatgattagggcgtgcgaatggacataaataacagaattcttacaagaaacatgttgaatttctaaagaataatgatcaaacaacacaaatgataaaactagaataactaaataataaaatatagttaatgagataatggtatgaaaaaaaatgataacaggaagaatcaccttagaagttagaaccctgccaccttctcgaagggcaattgtgcaaaacgagtttggtaggaagaagggtgtcaaatgtagataaccagaacatctaataaaacaaaaaactcaaaagttcaaaaaactttaaaatatgtatatcatggtgaaactctcatatctaggaagtgggaggacactacctagctagtccttattcaaaattcagttagcgatgtgaatttaacagaaaaaaaaataatttactccccctaactatttcattttatcacttaaccccctaaactatttttaagcttattttagctcttgaaatgttaaaaatagttcaattgactggttaattacatttatcttctttatttctctttatacaagtcatattttaagcttaaattttgtaaagtcatatatgacaccattatcgaagttccaaaatagtttaaaaatttttcatgactttttgcttgaaatttaaaacctctgttcttaaattagtctcagtgcttctaacctatataagcagcgatttaaaaactcaaaaaatattgagaggtaagttataatgcatatatcaatcctatcaaatttcattgcaaaatatgacctatatagagagagaaacgaaaaagacaaatattgttagagagtaaggtgtgaaccatttttaatagtgtgggggtgtcaaaattaaatgagtcgagaaattgtctaaggggttaagtgctccaagggaaaaagttagaaagagcaaaatggacttttttttcttattaagttataatagccttcttctgatttctctctttttagagccacaactgatcgacagcattgctcaataatacaacaaacgtatactaattgtatctgctaatgatctgcacctagcaagtgcatgtgaaaaattggaaaagttggacagaacaacaagatcaaccagtgatcccctgcctctgtctatcagtatttatatatctagttttgcattattgtgagatcactagtgggcatgagatgagggggcccatgcatatgtacccaaacagaatgca

SEQ ID NO: 60397 - DNA, 1371 bp, Oryza sativa
agagagaaacgaaaaagacaaatattgttagagagtaaggtgtgaaccatttttaatagtgtgggggtgtcaaaattaaatgagtcgagaaattgtctaaggggttaagtgctccaagggaaaaagttagaaagagcaaaatggacttttttttcttattaagttataatagccttcttctgatttctctctttttagagccacaactgatcgacagcattgctcaataatacaacaaacgtatactaattgtatctgctaatgatctgcacctagcaagtgcatgtgaaaaattggaaaagttggacagaacaacaagatcaaccagtgatcccctgcctctgtctatcagtatttatatatctagttttgcattattgtgagatcactagtgggcatgagatgagagggcccatgcatatgtacacaaacagaatgcagctgccgtagtagctgaagctcctggaacattccccactagagaggggaaaccccaacttcaattcctcaccaatctcatctcatctcatactagtactacactttatctcccccagttgatgctgctcacttttcttagtttccacgtcgcagtttctcttctctcctctgacccctttgtgaccgtccaacgacaacgcatggaggccgggttagcttagcttaattaagtgctcctacctgctgatctgatctgatcactttcttgtgtgtgcccttatgactgacagatcgatcatatagtctgaatatatataattaggattgttatatgcataggtttgcattattgtacccatttcctgcccccaccaccatttgcatgtgtgcagcagaaacatcctgcataaacagggattagaacgtagtgcaagtccctttcgacgctaattaatgatgagtggttaagttaatttgatggtgtttgtgcatgcccccgtcttggcgcctataaaagggtgagatcgcaagtccacgaggtcgtcgagcaaccaaggctttcactcgaccgacctcccagcttacaggagaccaggagtggacagaaatatatcgtagaattaatggttcgtgtgagatacaaatattaatttcttgttcaatcatttcatatatatatacatgtaggttatacaaattagtttcctagttaattaatttcattagcaactgcgtactctgtcatgttgtcgcatgcaatatgttatgcatggttagtaaaagacatggatatttgtgtgcatgcgtgcaggaggtggagaagaagacgtcggcgtggagcggcggcggcggcggcggggggaacatggtgcgggacgcggtggactaccggggatgcccggcggacaggtcggcgacgggggggtgggt

SEQ ID NO: 60398 - DNA, 6904 bp, Oryza sativa
cagttcgacgaccgcgacggccgggagcgcgccgccatgggcctcttcttcaaccgcttcttcttcttcatcagcctcggcacgctgctcgccgtcaccgtgctcgtctacgtccaggaccacgtcggccggagctgggcctacggcatctgctccgccgccatgctcgccgccatcgccgtcttcctctccgggaccaggaggtaccgctacaagcggagctccgggagccccatcgtccacatcctccaggtgctcgtcgccgcggcgcggaagcgcggggtcgtcaagcgcccgcccaccgcggcggagctctacgaggacgaccgccccgagcacgcccggatcgcgcacaccgcgcagttcccgtgcctggacatggcggcggtggtggccggcgaagaggacaacgaggtggccgggccgggcgggccggcggcgcccaacccgtggaagctctgctcggtgtcgcgcgtggaggaggtgaagatggtggcgaggctgatgccggtgtgggcgacgacgatcctcttctggaccatctacgcgcagatgatcaccttctccgtggagcaggccaccaccatggaccgccgcgtcggcgccggcttcgagatcccggccgcctcgctcaccgtcttcttcgtcggcgccatcatgctcaccctcgccgtctacgaccgcgtcttcatcccgctctgccgcgtactcaccggcaagcaaggcttcaccaacctggagaagatcggcatcggcctcgccctctccatcctcggcatggccgccgccgcgctctgcgagaagaagcgcctcgccgtcgccgtcgccgccaccaccgggaactccacgccgatcagcgtgttcctgctgacgccgcagttcctgctggtgggcgccggcgaggcgttcatctacacggggcagctggacttcttcatcacgaggtcgcccaaggggatgaagacgatgagcacggggctcttcctgacgacgctctcgctcggcttcttcttcagcagcgtgctcgtgtcgctcgtcaagggcgccaccacctggctcggcgacaccatcgaccgcagccgcctcgactacttctactggctcctcgccgtcctcagcgtcctcaacctcgccgcctacctcgtctgcgccaagtgggccgccaccgccgccgccacctcgcgggagcagcagcagcagcacaccgccgtcgccgacgccgacgagaaatgctagctatagaactcatcacacacacacacagttaattaattacacactcctataatgtataaggtttgcaccagtagtcattggctatatatcgttagttaattaattagtactactccagaggcttttctagattcagtgcgcgtgcagccctgatgtaagaaccaaggtcagttcagtgttcactccaggttatcatactgctgaaactaagaacgtctgagattaagttaataagatcgcttttcagttctcattgttgagattgggaatatccccgaaagaggttttcacttttccccaacaaccagaggactgtgaggagcatcatatttttccagcagaaaactattaaccaggtcaggtgattctagacgttggagaccttgctcacattgaagatggggcaagagtgaaacgatctaccaaattcaagtggcaaccatttatacatacaaacttaattaagttcgacatttcaagtctaggcaaatagagctagctgcctcactcccctaataatgcattggttcacatacatcagtgaacagagctagcattgaagatggggcaagcctgttttttttttttaaggagaacatcggcaggagatctgctagaatttaacattagagtagaaaaaaaaaacggagtacaggggttacaaccaagagaatacaaagaaaattacagctgcttgattggccaacactaaggggggggttaaaggccaaacagcgcatatcaatgtcaggggggcaagcctgattgaatgagatgatctaccaaattcaagtgacaaccattatacatacaaacttaattaagttcagcatttcaagtctaggcaaaagagaactagctgcctcattcccctaatgcattggatcacatcacatcagtgaaccatatgcgtatgtgatatgtctaggtgaactgtgaacagagctctctgcctgcattgtttcacatcagttaacaccatccaaatggacttggttgcagtgcacaaatgagcaagcaagaaagcagtacttactgtcatcaatgtttaccacggcgcagcagcggtggtgtggaaatcatactcggcagaaaggaatgactcctcaatttgatccatgtcgccttggagctttgcaatttccgaacagttcgctgctttcttctccacgagtgatgccttcttctctcggtactctaaaagtttcagctcaagctccttgatcattatgtcgagcagcttctggctttgctctacagaggcattgtccacctctctctcaagcatgaactgatccaatcttgctcttttcttcttgagttctgtctggtgattctttatgctcacgaggttttcaagccgctccttcagggccctaacatcaaatccgtcctcttccaattccgagaggcacctcagtttctcctcaaagacgttttcttcgtcctgaattcacatgttttgtatgctctctgctatatttgcgaaggatgccattagccccagagcctttccttcgcggagctcaggagggcaaccaatcaactttccgaaatgtggtaattgtggcagattctcaaaaacctctattttctcacaaggccccatcaacaagcttgaggcaaaagtagttggatgactgttaggtgctggcaatattgtgaataggttcattgttatgctcggatgcacaaatgaagattgccctgcagcactccaataatttggaacttgacattggcccaaaggatgctgctgtaatgacgcataactttcatagtgtgacgcatcaatgatcttcttggctgcagaaaaataatattcagatcagccagaccagtattaagtatcaatgcatcaaaaattactatcttaaagttgtggcaagacttacagtttggactaaagatctccaaattacagtgtgtttgctccttgggagagaagacaaccgaattggtattcatctccagctgtacaaatagcatcaagatgatcaagcatggatgggaaatacacatacatttaaacagaagataaaacaggggggaaaacgtagatggtcttacagcatcaggggccttcttatgtctcactggcacttccagtttgttccgagaaacaaattgaaacgtatgtctggtaacaagaggaagagtattaatagtaacattgttaggcactggcatgcatggcagatcggcctcaaacctttgttgctcagatgaatatggttctaatttactggaatttggtatctcagaatctcctgatcgtggccttcttgaattgtcttcaccactatcagtaattgtctgcattgctggtgatattttcgttctagttaagacaggttttacaattgaatgtaacacaaagtcgttataacaagtactcacagttgtttgaggtagtcagaccggtacctgcttctttcttgcggatatcagcgacccagctctccacctaagttgaggtgagttagcaacagatagacaatcaagaagggattaattttcatctcaaataaagataacagacgtatgtacctcaacttttataggcagagcatagttttggtctccggctgtacaatcatcaggtgccaagaactcagcttgtaaatgagcatgatttgtttctttcatttcattcatttcaggaagcactttaactggcaacttctctaataccggataacttggcagaggaattagctgcccagcattgttgttgaaatgagcctgtggtgtttccaatggcgacaagattgtgataacacatggttgcacgactctactttaggatgcctcattacatctagcaacgggtcacagttcaaaggacttcgtgctggtgacatattcagcctggattgtgattcttgaatcggataggaagtatgccgggaatggagttattcctctaggagattctgtcgccttctctttcttctagggttacagctcgaatcatcgctgatatgaataacatcatagccagagttgtcactgatttcgactacatcgacataactagatttgcccttgatttcaacagcatctttaggtgcagagatacatggaagatccaaacttgtacaagcaaattcctgaacaacaattatccaaatgacaacacagtttaggagagaactaaatcattagcataagatgatgtcattagcataagataatgtcattgcttggaggaagaaagcgtataccaaaaacatgatgtcattagcataagatgctgaagcacaatatttgatggtcaaaatatatattgataaaagcactatgacctgtgaaagcgccaagcgggcttttctgtatgaatgcgcggaaatttgcaatttaagacacaatttaagtttgcaatttaagaagaacggagtcaggacaacctttttcatgctgtgtctttgtttaccaccactccgtgtgcagcctaggttaggcagtttccttgaaactagcatgcgcgccttcccttttatgttcttgttctctagcttgttcaactttgttacctgcttgtccagagcacagggacaactaagctggcatactgacattaaaatgacaaacaccacatattccaagaaggcatacaagcacggcaagaaaacattgtaaacttttattcacagcagaaaaatgaacactgcagtagactggtagtaccaagaaagaagaggagaaaatacccaaatcacaagtaacaacatgactagttggagaaatacctttgctgtacaaggcatcaattcctgatcatcctgtttgcagtagggtctgagtaaagcacgcaacacaagcatgtagtcctcttcctctgagctatcatgtccttttagccttaccccatatccacagcttccaacatctgagatgacgcctagcgaccaggcaccacccagattcacttcaacctctgcagagggctccagttcatactcaaacttctttctgtcaaaggtaggttgtggtcgaatatagcagtaatctacgatgttaactgagccttccttatttttaagcctaacaacatagtttttactgctaaccatcttaatgacagtagcagttacccaggctgcacggtgctttcctgtatccaacatgacttccacattgctcccttcgtcatactgcggcacccttggaacctgcactcaaaataacaaaagcacaaacattagttatacaaagtaaatattgtgttgccgtgtctcattctctctcagtgaagcttacaccaaggatatcaggtttcatggagtttgttttgcctcgtgttcatgcaggaaaaaacggagttccttttgcctactccctccagtttcattttaattgacgttttggacaacgacacggtctacaaaatatatttttgaccttatttttctattataatatatataataaataaatgcatgtttacttttattatagtgctttgaaagacaaatctatatatgttattctagttcctttaaactaaatatttttaaagttattgatggtcaaagttataaaagtttgacatcaaccttgtctaaaacgtcaattaatatggaaccggagggagtacacatttagtcttccattttattcttttgacaattcagaatacgataaaattcattcagttagcataaaatttagcaggagttcttgcttgtttgacattgttttaaattctagatggcaattctttttgtttgtacaaccaatttttcaactgctactgttttggaagcacaattcttttgtatttgccttctcactggaactcattaacactaatttgcattctccaatccatcataatgtgtagtcaaggatgcaaccaatagcttagcatacatatactaaccagtggacgaagaatgacttactgctttgttgaattcaataaaatcccccacatgtaaatagaaactcagcacacgataattaggtcaaacaagtatggcatttgtcatcacttggtcttatcttgatatctcagattctgaactagtagcaaactagaggggacactcatatctacaatacaaagcacctagtctcgcctagtgttagaacagcacatgaattcattgattgttgtcgttgaggtcatcagttcaagtcaccactcacctacaggtaaaaaaaaaaaacgaagttcttctatatcttcagtggtttttttgttagaaataacaaattaccaaacactacctaaagttcctctaacatgtacatgcgacatcaccaccgattaaaattatgaacattccatcttgtccaattgagcattaaatcccatgtcaaatgtcaggtttacgcctcaataatccagccacgaataacgcaccgaagagggtttctcctgtccaccaccagcacaaaagggggaaaatacggagtacaacaatccgttcagcagaattgactcaccacgttgcgcgcgttcattcagcgcccgcgcacgaacgcccgccggcgccggacgagcgaggccgggagcttcgcctcttaccggcacgacgggaacgacacggtgtacatcgccgccgccgccttccgcccgtgagccggacatgccgaggacaccacgcccggccaccaccctttcctgtggtacgcctacaccatgtagaacacgttgagc

SEQ ID NO: 60399 - DNA, 988 bp, Oryza sativa
accccgtacagcggtgcgccgccgagctggccgccggagcccgccgcctcctccccatcatcctcccactccatgatcgatcgatggctgagacgctgggtggagatgatcgagggttttggaaatttcgaaagtcggaactcggaagagaggagagcaaccgttggaagaagaaaggacacaaacttggaaaaaaattctgtgcagaccggctgcaaaccccgcaccgtgcacacccgattcagattggcgacgcgtggacgagcgagtgatccgacagcgtgcccacacggctccatctgcaccaggagaaggcccagctcggcttgctcgcgtcgactcccacaaccagaactagaagcgcatggactggctccgcggctcactcgcgtcattttctttctgctgcggcgatccccacttccctttccaccgccgccgcgatctccttccccatcttgcctccatctgtcgggattgcctttccttggcgccatcggcttagcccacaatcccctccgttcaacaactgatgcggccacttctctcgcctgctaccgccgtcacggcctcccacctgggccctggccacgagcgccatcggtgacggcggcggcgatggctgggttggctaaggcgagcacgagccgtgttcccctcctcgtccctcctgaccacgggcatcggacgcctttggtggaggccgcagcggctgggttggcgagggcgagcaaaagccaaaaggcagtggaagaaccaggatctgcaacgcgccgccgaaagtcaatgcaagtggagcaccattcaagcaatgaagaaaaatcctggaagtgacatgtattttgtaattttgtagttgctacgtctgatcatttgcccgtgtctttctgtctttcgtcaaaatgctagctagggtgctggttggtttttctatagtttaaccagattagttcattagcctttgctaaaagtgatgcgatttatctct

SEQ ID NO: 60400 - DNA, 1535 bp, Oryza sativa
  unsure (1)..(1535): unsure at all n locations
nnnnnnnnnnnnnnnnnnnnnnnnnnnnnnnnnnnnnnnnnnaaaggcttacgactgggtattccaaaatctagtatgtgatggatcaatgtgtaaacaagattgtggtttgtctgtctggttcctttaaaaatgaaaaccggaaaattgttaatctgaaatcttgaatgtcaaatctgaaatatgatgtccagagaccagtcgttctcaaacaacatatagctgatcataagtgtaacacactgcaaatggaagtaaaacatagtactgtaacatagtaaaatagtatagttaagtaacatagtaaatggaataaaatcgaaatccattccaacttgaggaacgtgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccaccccccttttatatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagtgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaacactttctttaccaatttccagtgctctaggcctggattactctgaaatctggccagtaacccggtaacaaaatgccaa

SEQ ID NO: 60401 - DNA, 3204 bp, Oryza sativa
  unsure (1)..(3204): unsure at all n locations
nnnnnnnnnnnnnnnnnnnnnnnnnnnnnnnnnnnnnnnnnnnnnnnnnnnnnnntaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagtgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaacactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcattttattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgctactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggcgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccaatgcttctgatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccatttccaaagcggcaatcatatccatcaaaatccaactttgatacacttattaagttcctttgcaaagaaggaacataaaagacatctcgaagtaaaagtatgaagccattcgagagctctagaggaagatctccaacagcttcaactttttcttcaactccattggcaactctaatggtgctttctcttctttgcgtagtcc

SEQ ID NO: 60402 - DNA, 4316 bp, Oryza sativa
  unsure (1)..(4316): unsure at all n locations
nnnnnnnnnnnnnnnnnnnnnnnnnnnnnnntctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaaatcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctncattgtacctttctgtcacaagcttgttgatcagctgtgtagcataagtctttgaagagccagtaaactgactctttattctttaaaggtactctgagacagcgtcacactctgggatcgagcccaatatggtaggctcccccgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcgagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcaacgacggccggcgacgaggtaagaattagggttagggtttttggttcttttgatccgtgcggatcttgtgcttttctttctttggatttctttccccgaaacgatctaaacactagggttgctctgataccattgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccaccccccttttatatggcgcagtgtgacgggggcccaccagccattgggctgggcgcccccgatcagggcgcggtcaaggcccccttgagccgttgggctcaaggggagagagatctatctaacagaacgatcaaagcttgttcagctttatcattgacctgttgtgcaacttcatcatgcatgatcatggtcatcccctcgaagttctgtgtaatctataacatatatatggtcacagatcaaccagtatgaagaaatatgactatcaaataacaaggcgagcatacatatgttttctgcttctcatcggctctacaatccccggcgactacgtcgtccgcatgcacaggtgagacaaacggctgtctggccatgtgtcgttcactaaggcgggtgaagaaagtaccggaatcctggcggctgcggtgcgcatggcggcgatccaatctggcgaaggaagacgacgaagccggaaaaagatttcgcttttgctagagccgagtccgcgtacggcatccctgccgcggtgccgcctcgaagcgaagccggctgatcgcttgagcgggagccgacgcgagcgagccaagctgggccttctcctggtgcggatggagccatgcagacacgccgttggatcagtctctcgtccacgcgtcaccaatctggatcgggtatgcacggtgcggggtttgcagccggtctgcacagaatttttttcccacaaacttgggagccttccaggagaaggatcgaataaatactgtgtttttattttttttctttctcctctttggcacagtagctgtagaggacccgtttggtctggggagtttggctgtgcacgcttttcaaacggctaaacggtgttttttttataaaaaagttttcattcaaaaatttgcttgaaaaaaataatctatttttttttaaaaaaaaataactattacttaattcatcacgcaaaagttttcattcgaaaatttgcttgaaaaaaattaatccattttttttaaaaaattaactattacttaattcatcacgcactaatggaccgctctgttttccgtgcgaacggttccggatagaaaccaggaacagggctgtgttcaatgctcctagttcccaacccatattcgttttccgcgtgcacgctttttaaactgttaaatggtgtgtttttttgcaaaaagtttatatacgaaagttgctttaaaaaatcatgttgatccatttttgaaaaagaatattagcaaatacttaattaatcacacgctaatggactgctctgttttccatgagcactgtgcaggctaggaacgtaggctaacgaacgcagccttagaagggattggaagtgtaaagggatgagattgttagctgctttgtttggtttgtagacatgggaattttggtggattggagggggaattaagagcatcaccaacatcttacttattttattccttatcatcaaatttaggaattttttgtcaaaaatcgtctccaagagaatccctatcctatctttcaatagattaggttcccaaatatagatatatcgtacctcacttctggggagtgaatttctatttccaatcgcgatcaactcactctcgctcactcacagcaaaaatgtttgcgcgctcctcctcctcgtcatgacatcattcctccgcaacagcgccatcttcagcgacgagctcttccttggcagaagttacggcggcctcttcctcggcagcagcggcagctgcggcggcctcttcatcagcaacggcgccggcgacatcttccttcacagcgacgctggcgacatcttcctcggcggcgcccttt

SEQ ID NO: 60403 - DNA, 7163 bp, Oryza sativa
tcccaaaaataaataaatcgtacctcacttctgggaagtgaatttctatttccaatcacgatcaactcactctcgctcactcacagcaaaaatgttggcgcgctcctcctcctcgtcatgacatcattcctccgcaacagcgccatcttcagcgacaagctcttcctgggcagaagttacgcgggcctcttcctcggcaacaacggcagctgcggcggcctcttcatcagcaacggcgccggcgacatcttccttcacagcgacgctggcgacatcttcctcggcggcgcccttttcttcgcagcaaggttggtctcagtcgttgcttccgcttagttcctcagcaatggattggtaccacgacgcagtcttggtgcttggtattgaaaaggagagaataacttaagaaaaatatcttttttcttttcttaccaccgattctacgtgaaaaatgggttaatccaaaatgctcaattattttatatatattgtagaggtaacctcacctaactatatgagaaggtaaccacacttacatccatgcaaccaaccaaacaaaatctcttctcaattgtatctatcgtataggtaaccaaacaaaacctcatgctagcgtggctagaccaatgcaacaaccaatagctgtatatgtatcttcctagccaggtcaaacttaacctagatgagagagatgagctaggctaggggaatacgggcaaccaactagaactgttgtgagagcgtgaagtctactcttcccgatttgggctgtgtttagattcaacttttttcttcaaacatccaaaaattccgtcacatcaattatttggacacatgcatggagcattaaatgtggacggaaaaaacaattgcacagtttgcatgtaaattgtgagacgaatcttttgagcctaattacgctatgatttgacaatatggtgatacagtaaatatttgctaatgatggattaattaggcttaataaattcgtctcacagttgatagacggaatttataatttgttttgttattagtctatgtttaatacttaaaatgtgtgtccgtatacgtcaaaaaaaaattgggtatctaactaaacacggccttggtatgttatgctggcgacgtgttgtcagctagtacaatcaaaatcaagtgtaggtgttggcgacgtcggcgaggtgcccggcgagctccaccggcgcggagaacatggccatgtggtcggcgccggcgatctccctcacctcctctacggggcagccggcgatcatccgccgctggtaggcctccacgatggcctggtccttcccgcagaccacgtacaccttgcgcaccgcgccgtaccggtcctcgccgaacggcggctggcggcgcatgtcgtccacgtagtaggagctcacccgcaccaggctccgcgacagcgtgatgtcctcctccgggctcagctggtacagcttccgccgcatgaactccggcccgaacagcaccgacggcggtgcgtgctcctcgtccgtcgcgcagtccacccagtccgtcaatggaagcttccccggagaagaagaagaagaagaagaagaagaagaagaagaagaagaagaagaagaagaagattgcgtcagcttgatcgagtgagaacagaagaggagtgttcttggatgtgtgttttaccttctcgatgacgtcggggcgcgggctggcgcagtctggcatgagcgcggcgacgaacacggcggcggcgaccttgtccgggagcgtgtccgcggcgagcgcgacgctcatgccgccgaagctgtggcccacgagcacggcgcgctcgccgtccgggagcgcgcggacggcgtcgagcagcgggcgcgagtagtcgtcgaacgtgggcgcgtcgtcgtcgcgcagccggcgcgcgtcggcgcccgacgcggcgaggtcgggcgcgtggacgcggtggcccgcggcgcgcagcagcgtggcgaccctgtaccagcaccacccgccgtggcccgtgccgtgcaccaggatgatgcggctgctcgcctccgccgctgccgggacgacggccgtcgacgagggcatgatggcgccggctatagctagctaactgttgctcgtgcgaatctagtaattcagcgcaccgtggcaaactggcaattaatgtggcattgatataggctcatcatgcgggtatgagttccacgggagtcgggtagtgcgtcacggctgatgcaacgggaggggaggctgggaggtgcgccgggccgccactggcactgcctgctgttgcgagtctgtgacaaggataagtttctttttctttgttactaacatgtgagctagggatcattagacccacgtgacagtgacaaagttacatgactttaactgtagaggatcctgtccctatgatgagcgtgactcattttccaagattcgacaaaaaaaatatataaaaatttatagtccagtcaaataatgtggctattggtaggggacgtttacttatagttataaaatatttatctatttctagcagctatcatatcttaaaatggagctattttttcatatatatcctttaattttttcaattagtcacgactattatccatttaattttctcatatactttctcttctcgataaatcgcaatatttcttcaatcatttccatcaaccttcttaaaacccatgctcatcttaaaaatatctgataaaactagcaggatagtatttggctgcgccggttggtggcttaaaaaaaagaacaaatctatctatctattatatactaaaaatttattaaattgtttacaaacactcctgaaacgacacgtgtcttactataaacgctcctaaaccaccacgtggcgttttaataaatcctaaaattctgataaaaaagaaaaatatctaactgttgatttacattagatctaatttttttaaaaaaaaggactccaatttttaacccaatcaagaactgcatgatcgagagataattcaagactgcacttgatccacaaattaatgcaccaaaacaatcaaggactgcatgctcgagagattattcctccctccgtttcatatttcatagtgtacgaccctttgattttgtttcgttacctaaaaagtttaaccaaatttataaaaaaaatatagcaacatctacaacattaaattagtctgattatacgagatggggggagtagattattaaaccaacaaaattaaaattaaagattgtgcatgatccacataatactacatggataaattaatgtcagaatcaaaacaggaaacttaaaaattgaaacaccacatcagatttatttaattcactcttctcctctcccatttaattcgctattctattttctaactaacaacttaatataaaaaatcttagaaatcatgagaaaaaaaacacctaacgtttattcctaaaatggtgggcatgttattttaaccattaggatctgtttggcatagctctatatctttgatccattgtagatttgaaatttacatgttaaattatagttgtttaaaaaatttaagtttcatctaaaataggaacaaaatgatttattcgaatgctatcaatgtaatcgcggatataaataaatggatttgtgaaactagaaatacacggttttaataaatcttgtatccgaacctatggcaaaaacaaccaagatctatttttaaaaatagacaactcaaatggatgaccaattggatctatgtaaagaaaacaaactatcctcccctccccctgctgctttacatttatatgtttctccttccgcaccactctcccctcctctcctcctcccatttaattcacccctcctaattttgaactaatgacataataataaaataatctaatagttacatagctaaattatagttatatttgctttttaatttgtttgaactgttttacaaatggatagctaaataactcgagatttatattactcatataaaaaaaatcaaataagtcgtttcaacatatacccctattcttttgcatggaaaccaaataacattctaattttaatttttatatagttatataaattattgaaaatcttgaacatagcccctatcttttgcacctcaaccaaataacaataaagcattgaaaataatgatgataagttttatgtcatcttaaattattctacgtaataaagaaccattaaacatcctctataatgctcttaagtctccatgtgtcattgttttaaaactagaaaaaaaacttagaaattcaaattaaaaaagtaaaacatttgatcattggtttgtgcaggcaattagagattagtaatttgagagaccaattgctcagcatgtgtggaaggactttcaactccaagtatggatcagtcttccaattctaaccatataagtgatgctaaagaccatatatataagtcttgcaattttattattcccaaccactaaatctaccttttggaaaaccataagcacccacattgccccttcttaaaagttaggaaacatattagaaatccgaggagaaaaaaaatatgatcatcggtttcacttaaattatttagaaaaaattctagggtctttctacaaatttatggaatgcaacataattatcgcaactggattggcattgtaggcttcacataaagattatataatataaatgtacttaattcatgccaagtgtaggctggattaaaaagaaatacatagttacatgatttctagcattaaaatataaattttatagaaaaatattaaaattatggaagcaatcataatacatcacattgcaaaaatagtgatgtttgtgcagctatatttattcgtctgatcatgttaatactagctaggatgcattgagcctcgcacactccacattaaacatttccaatagatcgtctcccacacttccccaatcgcattggactctacaaatgcatacatttagtgtagcctcatatcccacacaatccatctgttaattaacaataggaacctatatcagtcttaacttggtgattatttttcaaagttgacttaaaataagattagtataaaataaacaaaaaatagaaaaaaaaatgtcaatagggactaaattgaaccaattggagaaaattttatagttttttggctcttaattctcatctacattgaaacacccatttgccataaccattgcattatttttaagtagttatatattaatggccttctctgtatcatatgccatgcatcatgaattttttcacatattattgcatatataagccacactaaggtagtagtacataattgatttaaaaattatatttaagttgactaggtatttttttttatatttaagttttaaaactaatgttgactaggttttttttaaaaaagaaacaccataggtcaccaatatcatagggaagtgagttctatgatatatattttttccctgtctttattgttcatatctaagtatttaacaaatcacatcaatgtgaaccaaataaaaggagggctagcctgatggtaaaaatagaatgcatttgagaggccgtaaacactaaagtaaaaaaagaaaaaaaatcttacttttaagtgttaaatttgtttcctaaaaaactaagtctacctttctttttctttttagatgataagaatattatagaaaattatttatagggatgtattaaatattgcatagtataaaagttaacaaaattacctaggcaattctgacaaagaaaatttacggagaaatcacactttgcagatgcaacctatgacacattgcagatgcaacctatgacacatgcaatgcgcgggctacttttttagttattaattaaagtgtaaattttatattgaaccgtctctttttatcatgttgtaatttggactaggattaacttacccttttcactctgaatcagatttttgctaaacgtttcaccttatacccgttcttgtcatctctgtactcctttcctttaggcatgcaaatctgagcttgtagttgccgccatgaacagggccaaacaagctcaagctggctcctcgccgatagcaaaaaatgagaaagaggtgaagaggtcaccatgctctgcttgcttgcttgctgccgggtaagaacaagaggacatcctgccctgagctcgagctccagcactttccacgtctaaagatcgagctccaattcatctgcgaactcaaccactgtgctgcacaggctcatccaccttcaccacttcatcccaaatccagcgcgctcaacctcatcatcgtttggtggagtggggaagaagaggatggatctttcttcggcatggtgagaagaggggactgccgtggggattaacaaggctggtgagtgacatgcaccacacgggctcagggaataccgaggaggaggaagaaaatcttgctcacttacatgtgagtcaccagtccaatatgcaagtttgggtaatactaaaacatagtgtaaatgaaaagaaatgatattacctagtgcaatatgtaacttagttaataaaaaggggtccaaagtacagtttactctcaattaaatattagctattgtaaatattgaaaatggatttattttttttaaaaaaactattgtacatattaaaaatattgtaaatatttacaatatgtgtttgtaatgtcatattttcaaatagacaaatttataatggctggatccaattaaccctacttagtactaatcctatacccaaatcaagtttcaccataatgtcatccaaaagaaaacaaattaactaattctccatcaatcgcattaattttagatgtatgtgttggcgacgtcggcgaggtgcccagccagctcctccggcgcggagagcatggccatgtggtcgccggcgtccatcaccctcacctccgccacctcggcgttggcgaccatccaccgctggtgctcctggacgatggccatgtcattctcgaccaccacatacacctttctcacggcgccgtacctgtcctccctgaacgccgcccgccgccgcagctcatccacgtacaaggagctcgctcgaaccaagctcttcgcaagcgtgtaatcctgtgctgattaggttatgaactgattagatcatggttaatttaatcaggagt

SEQ ID NO: 60404 - DNA, 13981 bp, Oryza sativa
aagcgtaattttgtcatcatggtatgagtttattcccccgtgtcgatggggtggaagggtgggttggcgcagtccggcaggaaggcggcgacgaacacggcggcggcgaccttgtccgggaacgtctccgcggcgagcgcgacgctcatgccgccgaagctgtggcccaccagcacggcgcgctcgccgtcggggagcgcgcggacggcgtcgagcagcgggcgcgcgtggtccgcgaacgacgacgccggcgcgccgcccacgcccaggcctcgctgaccggccgcgccgaggtccggcgcgtccacgcggtgccccgcggcgcggagcagcgcggcgaccttgtaccagcaccacccgccgtggcacgcgccgtgcgccaggatgatgcgccccgccgcgccggcggccggaagaggagccattgctttcaagaggaacagacaattacgagcagaggtcactaactcactatagtgaatcgattgaatgattgagcctagtgcatcatgaatagcggaagcagccagtgttgacaattatttgccttttgaggaaagatggctttgagcttagggtttagggagagcaggagtaacatggcaataccaccgaggtcctcgcgttggcgattgccggaggggatcaccattcaccaaccggtgtcccatggggtttacccatgcggatatcctcacggaagtggcacgcggcccaaaagcaaaggctcgtggcgcgaagctgcagcccgtgaaggaagtttcgacagaggaatggcccgagatcggcatcaatggcgacacaagaccactagctacagtgcccacccacagtgagatcgaagccccaagcggagcaaccgagggaaagtcatgacaaaactaaggtgaggattggattggaggatattttccccaatatctctcccattgtttcgcaagagtagatctaggtaaggcgaggtgagacccaaccacacctagggttcctggcgagaggtgatgagatatggcgatttggtgacacagcgcgccggatttggaaggtcctggagaggaagtgcgaccaccgttttcgtttgcccaagtggtgatggagcgccaactggcaaatcggtcggattggcaagtcaacaaacattgtacggtggagcacggtggaggttgggagggggggacaggatgcaagggaagaggaggagctccggcggcaactgcttgcccaaaaccccagggcaaaccaaggcgccatctaggggtggaggcagagcgaggggcgggagctcctaagatcaaattcttcaagtgtaccgcgaaggtcacaaccaggcaacttgtctaaatctctttctctgttattcacgtcgcaacactagcacatctctatacactgcccaatgaatttgatgaaaagaggtatcaaactatgtggatttggaatcctagggcaaggtttctatagcctgcaagttgatatgttagaaacagagttagctagggctctagtaagaggaattttgacagtaatccatggggagacagttgtgggaaggtggttattgaattgaaacacctgtttgtggggtagaattgggagtggaaagtgaaacaacttaatgagaaagaatttctcattaatttttcttctgataaggtgagagtaagatctcaacatgtaaaagctttgactttgagacatctatgatcaaggcaattgtggttgagacaaggataacataagaggcagaagatgaaccggtagttttatgggtgaaaatttatggtgtacccaaactagccagaatagaagattcagttaaagcaattataaaattggttggggaatttgaggctattgagggagctagcttgaggaaagataagcctgtgtgagactgagagttgtatgtaaggaccctagagaattacacttctccatacacatctacatcaacaaggtgggctacatgatcatatgataaccagatggctatccaccatatgaaaataggcaaaatccccttgatgatggagattgtaaggatgacaaggacaatgagggtcaggaagaagatatgaacatggatgatgagttcaaaaccaaaaatagtccaagagggagacaaactcagaggtgaagggagccaacaagggagcagatttggaacatattatgcacctcctacttacatagggaaaacacagatgactcatagtgggaaaaccctgaagaaattggcatcaaagaaagattcattgctgaagaaagtagaaaagacagaatgttgtactactatggtgctctgggggaagaaggaggaaaatctagtcatagaacaagagtctcaggagatggtgacaccggtcgagatgcaatctcaagatgagggaggtgaaatgacaaatgagaagctattaatgcatgaatgttccccaactgatgatgattttgagagatgtcagattcccactgattctgacattgaaagacttagagaggaagaagataatgaagaggacaatttccaagaggtgtctaacaaaaagaagaacagggctaagaaaacagaacttgcagtgacttcaaggatgaatctaagacaaagggagatggctgctaacccaataaccaaaagaactaagatactcacctagaagaagaacttggagcattaagctacaacaactaattaatccatttgctatatttcagttgttagattcgattgagttgaataatattactattgcctctaacttaaacttaggtagtacctctaaagagagaaaataatatagagactctaaaagcaaggaaattgttcaggctagactaggaaagctaaactggaaaaaagagatttaaaagacaaagacacaagaggaggtggtggagtcagagacagaagggtgagatgataacaagcaagaggaagaaaaagaggagataattatatgagaaatattgtaaaattgcatttttagatcagttatgctgatttaatgtatcacaataggagaaaaacaccttggtaggtctccgctgctgacatggttgttgtcagggttatggataccacataactaatagtagttgactaaatctcagcaggacccaccacataccatgtcctatacggaaacaacctgcggatataggaggagttccagataaggaaagacaaccagagttctatatggaaacgacaaagactactcggattgtatccatattggtttccctaattctacttgaacaaggggacacctatgggtataaatacaaggccccctaggaggagaggggagacgacgatacacacccacaatcaacagacacgggtaacatagacgtcacaaagctgtgagccaatacaagccaacatacgccaagacaagacgccggatatcgacttcagggattggcacggctagtcccctacggtgtctccggatactatcaggagagacgaaagcgctatctctgatctcgccgggcacgaactcgaggaggaagactaccctgttgtcgactacgagtcagatcttcagaccgccatgtcgacaacagttagataggctaccccaaacattgtactggtgtgattatggtgaataagagcaataccggctttggccaacaggatgtagggttattacctggcaattcaggggcccgaacctgtataaaaacccctgtctccgtctcttttacctcagtctcgcgtatatcctagtaccaacgatccccatactatgcaaataccggaatcgcgacatcaaacgtcgatagttgtcaatggtggtaaaaatttaataagtagtcccctctgaaactcatcatggtaacatatttgcatttagctcctctgctgtttatctctaacctaactcctctctactccatttattatcctctttggactcagagaagggaaagtggtagcgacataagagcatctctaacagcctctccattatactttccaagccaaaatttagccattcatgccaaaaaaaaacatgctccaacagcctctccaatccactagccaaatttggcaagccaaaagccactagccaaccatgggcccctcgcacattcctcctcccatctcctctccggctcctctctcgctaacgtcctgccatcaacgacgccacaaaggagagaggcgtcgtcgccagccgcgaccaccaccgtcctccacgaccgccgttgtcccccgcgccgtcggccgccgccatcctccgtgaccgccgctgtcctccgcgccgtccttcgtgaccgtcgccctcctgacgtcgcccaccgtgacctctgccacgaccaccgccgtccgaggtagagggcgtggggaggaggcagcagtacatgaggaagaagagagatgtatgggtggggaaaaatgtggtggaagagaaggaagaaggttagcagagactgacatgggtcccatttgtcatagacttataatggagatggtagatggagaggctgttggagcgagtaactagtttgactagctaaatcagatggagagttggttatatgggtgtttggagagtttgatatggagatgttgttggagatactctaaaagtacggtgagggtaggatgatgtgaagtacagtgagagtaaggtgtgtaggaaaaaaagagaggtgtgggtcatgtggcatcttttcgtcatcatcgccatggcaagtagatcgtcttttttttttttacttaatttcagttatgtttttcctacgtgggtattctctcttatatgttatgcaagtatgtttctatctcgtatcttctcttccaagcatgtatttcctccttcatattataagactttctagcattgcccacattcatatatatatatattaataaatctagatgtatatgtgtgcctagattcattaatatctatataaatgtgggaatgctagaaaatcttataacatgaaaggaaggtagtagtaaattactttcaatcctaattcatttgtacattgtgtgttagaaaaattacaatgcaaatattgttttatagcgtaagttttgaaatttactgtctaactataacactatacaacggcaggtaatttagagtctaaaacaatttgattattcttttagaaaaacatggatctataaatatatttataaaataatcatataataatgtattaggataggaggagaaaatgtactattctgttaagttgattgagaatggtaaattccatttccttctggtgagataatcccaaatttctactctgaaccccaaacgcagaagccggcgaggcggcgagccggagaaggatgaatccgccggagctgatggacgacctcgtcgacgagatcctcctccgcctcccccccgacgagcccgcctgcctcgcccgcgcctccgccgtctgcaagcgctggcgccgcctcctctccgaccgggccttcctcctccgccgccgacgccgcgcgccgcctcccctgctgggtttcctccacaacctcgacaacgccgaccaccccgaccgcttcgtccccaccaccgccctcccgatccccccgccgccacccgagctccactgcgggatggccctcgactgccgccatggctgcgccctcctcgacgcctacccctccaggatcgacctcgtcgtgtggcaccccatgacgggccacctgctgcggcggcttccccgccccgacgtcccgtacctcttgtactacaacgccgcggtgctctgcgccgccgccgccgccggctgcgaccacctcgactgccacgagggccccttccgcgtcgtcgtggtgggcaccgaggaggacaacgaggcgtgggcgaccgtgtactcgtcggagtccgacgagtggagcccaccgacctccgctcgcctcgcccgaggacccgagttctgcgtcgagggcaagcccgccaccctcatcggagattcgctctacttcgccctcgtgtttggtatcggagtcgtcaagttcgacatgaagcgccatcgcctctccctcatcgatccgccggctgagctcgacgatggcttcgtgctcatgccgctggacaacgatggcgtgcttgggctcgcggccgtggaggatcacagcctcctctctgtgtggtcaatggatgtgagcctggatcatggacatggtgtggcaaattgggagaagtgcagggtcattgagctagacagtctgctaccaaatcttgatcactctaccccagtgctaccaattggatttgtggagggtgccaatatcatcttcctgagaacagatgcgggtgtcttcacacttgagctcagatcaatgcgtgtcaccaaggtgtgcaagaatgggttcttctacgctgtcgtgccgtacacgagcttctacattcctggtgtccatctccagcagcagcacagcggacctcagatcagtaatggccgggcatggggatcgcaggctgctaacatgaggcgtggcagcagtgagcagccgagagagcgtgctccactgcatcagcagcgacgggcaggacggccggtgaacagccaacgtcctactggtgatatggtccgttcttcaggccgtgctagcagattggcatctcaagtgcggcctccatggagaccctaatgattcgcaaggtggcaatagctgacaataatgtttaatctatcgtgcaatttacaggtggtatattgctaatcgtcggttttagtcatttgtgcgatcaagaagaatatcttatggttttgaatgcattgtcagtacagaatatctaaacatggaaagagcagattaactgagaggagtgagagctctatctcgtatccgctaactgaatttccagttataacatccaatttgtttatgggctttcccattgtcatactgcaagtctggtgaatgtttatttcaagcattgcacacacttttctttcttgactaaaaatattacattctccttatgaatcgtgctgctcgaaagggctctgaattgatccaaaaaaacgcaggttttttatggatggttgtatggaaccatgcatttaaatatgcagaatatgacaggctgaaactaacttagggaatccagtccatgtagactactgcagccaataacctaataatatttttaatttctttatcatgtatctcttggtgccttttctctcttaagttaggcatgggtgtactcttatgtccttctgtcttctcttttatacattgttatcctttttactttttttttatataaacacaaagtatatgcgcatagttcagttggactggaaaggctaactcaaaatcacttcactatgtttctgatatcaggtccacctcatcagtttacacttgaacaaaatactacttctagttctacgattgaacaaagatttagtttacacttgctgtctcatttcttctttttttctaaaattctggcaggggaattgccttttcaattagatagggataatattgagtaaaatacagttaatcttatgcaggattgttcagtgctcacccatgttttagtcgatcattactcgtaccgggtatataaattaacatatagggagtacaacaaaagtactgctaaggagataaaagattggcataatatgtccaagtatttaggctgaagttccttgtgtttttgttcctaatatgatctgctgcacagttcgtgtttctgctattaggtatcacataggagtcgtgtttccttcttggtttggctaattggcaatgaagttgactcctgaagctgcatttcgtgcaacaatgggtaccattcaggactctgatatcatcattgtggtgtttcacaacatgaagccagaagattgcttgctctctagcatcctctgttttgttcaggcttctcaaggtaaatgaaaactagttctattctgagccttacaaattaggcacatttaactcctaggcaagaacatggacagatgtttgaaaaagaaacattatttaagcattatgtttttaaaagaaaaaacttcttctgttccttacgaactgtacatttatatcaacatggaaggaaatgaacagaatgttttcatcttgataaaaggagatgccagaaaacaaaacaggagttttcagtctcaattcatagaaatggtgggttttcttaggcgtttcttttggttgtcctaatcttcttttttgttacgctgcttgaaacctcggcagttgtcacttcattatcggatcatggtgaaaaacattctagttttaagatgaaatagagaagtagagttgcagacataaacatgatctgctcttacatcatcaccctgttaggacttaggagagcatagatttgtaccgcaaatactatcttattgagagctgcatagatggaacaaatgtgctcatgtacactgggtataggattgggcacaaatatatatggatatccttattgcatccttatcctataaggattagtaacaccttgacatgcattccgtgcaacttccaatgcatcccttcaggaaactctgatgatcatgatgatctgtcttgctggcacatgaagagctaccctcccaagtgacttgacagccaaggtacattgcttgctgtcctccatgttttgttcaggagacatcttgatctgaaatttttcccatgcatcagatgcacattatggagctggaaatcttattactaatagtcttgctcatttgaaggacaaaaacctccatgttctcatatgaagataactgactggacatagttaagaattgtgcagagtacaggtggttagcttaaattaagtactattgcactacagtacagctctgctctccaagagtaaaaacactctgttccaaaaggttagtatatagtttaataccaatgaaagggattggtgtgcatcctgtcaggactacatgctattatttgatgacttgttcagacacatgcgggcatacttaagcattccaagagtccgacaaattagctactctgtcacaccagatgctggaaatcatgacaaatatatggtagtccacatagagagatacggcagtaccagaagctatacatacgtattgattttttttaagtcatcttctatcattttcttcaaaattaaagatcaatgttctatattaaatgatcacatgtctttgtattagctagaacaagattatgctagcttacccatcatgcggcctgaacactcatggaaccggttggtacatccagcaaggctccattgctgtttgcatggcctatcatgcgaaggattattgtgaatacgacttacaatcaagtgcaaaaacatgctatttttttacaaaggcaaacatacctgcaggttgtcttgcaacgaaaaaacatgcgccgatgacaatgtagcacaggaggaggagaatccccttcaggtaatgtgatgttccatcctgtaaatcaagcccattaattagttgacacattgaattgcaacatgtcacttaagatgttatcctgttatctgagtaattttcggtgactaaattccatttccacctgttcaaagtaaaaatgcatgagtcacagtgtacctgcagggtgaaggccgtcaccagcaccgccatgaacagagagccggtctctagcagcttgaagtcaagatccatttggacccccatgatccaggccacgagcacactcagtggcacctgcaaccccatcatgatttggcaatccgttcaaccggatgagagcagaacaactacaggatctgtactgggtaagttaagcagcagcactcaccacgaacatggatatctgggtggccgatcccagagctaccccaagagtgatgtcctgaatcaaacaccagattatgttacattaattagcaagttaaacattgattttgttttcaggagagacgactctgatcgtttgcatgggatgcacattgtttgtttgaattaccagcttgttcttgagcgcgaagatgatggcgccggcgtgctcggcggcgttgccgacgatggggaggaggatgatgctgatgaagctgacggagaggccccatgactgcgaggtgggctcgatggtgccgacgacgtactcggagaggacggagatgacggcggtcatgagggcgagccagaagagcgcgctggcgaacccgagcgccggctcctcgtcgtcgtccccggcgtcgccgccgtccacctcctgcggctcgaacagctggcggtgcgtcttgagctggaagaagaggtaggcgacgtaggacgccagcatgacgaagctgcaggcgcgggagaggtcgagggacgccgcggccgaggtggcggagacggagtgctcgccagcggcgacggcgtagcggaggaggagcggggcggagtggcagaggacggcgaggaagaggagggcggtgctgacgtcggactggttgcggtcgtagggctggcgggcgccgaggttgacgacgccgccgcagaagagggaggtgccgaggacgaggaggaggttggagaggacggagcccagcagggagcacttgaccacctcgatcttccccttgagcagcgcgaacagcgcgatgatcagctccgtcgcgttcccgcacgtcgcgttcagcagcccgcccactgccccccatgcatacaccatcatcaacacaccacaacagcaagttcaattacttcatatacaatgcttaggctgtgtttggtagctcatttttttcttctccgtgctcatttttttcaaactgaaaaaattttgaaaaaaattgatttaagaaatcgtattaatccatcttttaagtttgttttagttaatatttaattaatcaagagctaatagatccatccgttttgcatgtggacaaatgtagcattaattatttttggtttctctagcaaaatatgagacatttttctctgatcttttataattttaaaaaaacatttgctacaacgaatagagaaacaagtgccattttttgatgttaagaaagatgattccatccacgaataatatgaagtcttaaattactttcagtttgggactgatcgttgtgacttaccggtgggaccggtgtagagtgcaatctgcctgcaaaatttcagtagcaaaatgcaaaatttcagcattcgaattataaacagaatttttaaaaactggacataaaaattgcttctgtaacgagtagcttactctgtgaggaagctgactctctcggcgagagggatgaggcccagtaaactaagagcgaacacccacacctgtcaagataaatatttgtttcccaatgtcaacacatattggattaatgtgcaatagtagttaaaagtataagatgaagacatatcgacaaaaaaaaagggaaagtactgtaaggtaacgcattattttattttatcactaatttactagcactggatcagcaaaaatacctgcatcacaattaaataattagatgccacgtggaaggaataaaacatgtctcttccaactaatcaggaataaaacatgtctcttccaactaatcaggaaatgtgacagactgttggcctcaaccactaaaatccaacacttccaacctttactggaagcagcttcactcatcatccatgcatgatgcatgcagcagagtgtgaacttatctccaaaccaaactaaatctgttttcctttcgaaactaaaaatcaagctaaatctattagcacaacacacaatcaaaccccctgattcaccaagctccaaaacacaacggagattgatcactttctggggtagaagtacactcaaccaagaggcaaagaattaaatgggttggattcgtcatcgtcccagccgcttgtaccggcagaatcctgtcgtctactcagcaagcagcaaaacggcatgacgccgctaatttggcggatcaaagaggaatcgagtgcaatttgcaagatgacaaattaagttcagtttttgctgcaaggagacagatgggttttcttcaaagctcagggctccacggcagaatatttgtgtcccgacgaggcaaactaactggcaaagctaataggctccaccagcaagcaatacaaactactccacaaaatatgttttgcgggggaatattctactatcacagaggagggaggaaatcacaagctaacagttcataacagaaaattaaaatactgaataatgaagtgctccacattttaactcctaggcctgtatttcaggttacatctgggccatctggcagacatggatgcttattgcgtcatcaagcctaggaattttgtggaaattgaactgatgtatgagaaatttctgtaatttattgacttctttaaaagaggccataaatgtatgtactaagggtgtgtttagataatgagaaatgtgaggtgggattgagatttggaaatgaacgaagggttaggattaaatgaaagagcgaaaatgaatggttatgatttaaagatgtattctagtgagtgggaaataatttccatgtcctattagcctaacagcgcctaattttcaagtggaatcaggaagtccaccggaacgtccatggccagtttaacactagtactagtggtacaagacaacattttttgtatgtatactttttaacactgttactagtaccactttagacattgatggctaattctactacagttacgaaaattaatcctacaccataaataaaagtgtcaaagagagagagagagagaaaagaaacaggagtgcaaggacacagccctcgtgcagccgtgcagttgcccatgtggccttaccagcaaaaagctacagtactatatctcggtttatactagttaaaaaaaaacttaaaataggcgccgcagcggcctgccacctggtcaccgccgcttgcaaacgccgaactcgaaaaaaaaaagatgaaaaaaaaaaagatgcaacgaacaccaagcagacaagaggatggtcaaagcgaacatggaatggaatggaatggggaattgaattaacctggtcgaagcggaagcactgggcggcgatggcgagcgggacggcggggaagaggacggcgagcttggtggcgaggaagacctcctggaggttggcgagcagcgggcggagcggcgccacggggaccttccgcaccagcgcggcgtccgacttcttccgcagcgacgacgacgacatgttgtgcgccgtcctgctccgcccgtgcgggtgccgcgccgccagcttccgccccgcctccatcgccgccgccgcctccatcaccactagatcaaattcgatccccccctatgcgcgcagcgcgccgccagaattgcgagagatagataggcagatggatggatgtgagaatcgattgatggcgccgtgcgcgcgcgcgacgcgagagtcgagtcgcgagagctcgccgccacgaggaggttctcgtgatggtgtgtagttttgtacaggacgaggagaagcggcagcagtggcgagctcatatatagggaggagccgaggaggagaaacaaaaccacaaatgcaattatgcggtttcgtcgtgagcgaattattggatcatcaatgtaatgcaatccttcgcatcatcaaacaccagcaaattattttttttatataaaaaaaaggaacaaacacgtactaccgatctaccatacatattttacggattcagttcattaattcattcgagggtatatatgtttagtttccgcttaatctcgatatttatcgcatgtataaatgaacaatactactccagcagcagaaagagacaaaagatgagatgggtggatggatatatagagataggcaatgcactggcagagtcgcagagggagggagggagggggaaaatgggaaaacgaaacggaaggctgcagacgcagacgtacggacggggcggggggtgattgatccgtggcggtttgattgcgtggggacggcgacgtgggtggggggggggggggg

SEQ ID NO: 60405 - DNA, 8816 bp, Oryza sativa
gcacgcagcagccaccagcaagccaagggcgggcaacgctgcttgctgtttgcggccttccgtttcggccttgctccgtccactccacctgcgccgcacgaatgtcgtttggtgagatttggtgtttttttgcccgctttgcgtttggctgtttttttttatgtgatccgtcggatccttttcagagattggtacggtaaattggtttagagtaaatctggaccgttcattgttaataattccatggtcgacaactcgagatcggccaagattttcctagtggtaatattgacacaataaaaacttttagggctcctttgaatcgtaggaagaaaaaaacgaaggaatagaaaaaacataggattctgacaggaatgcaagtataaaacagaggattacaaaacacaggaatgatcgtttgattggaccacatgaaaaacacaggaatcggatgagagagatagactcaaaggatttttaccaagagattagacctcttgctaaatttcctccaaaatctatatgcaacaagccattccataggaattttgttggatttagaaaactttaatcctttgaatcaaagagctacgtaggaaaatttcctataggatttcaatcctatgaaattcctccataattcctttgattcaaaggggccagttagatagagttgaagtgtgtgccataggaatcggatgagagagatgcgcggtaagaaacggcgtcgaggcatgtggtactgtcgaatatctggccaattattggaagaaggtgagaattttgttttggatacacaagatgggtccgacgacgaccagattgagttcatccctgattctgatgatgaaggcatcgagtactgcttctccttagatcaggagtttgtgcccgaaactgagttctaggattgtagggaagttgaggagaagggtggtgggattcaggattgtggggaggtgaacgagaagggtggtgggattcaagattgtggggaagcgaaggagaatggtggtgagattcaggattgcggggaagtggagaagggtggtgggatttgtggcggcagcaacatagtgcactcaaatgatgaatgcaaacagcctgcccagatgtggtgcgggcagcgggttcgaggcaagtggtttcatcgtgaatctggccgatgtttagaagaaggcaagaacgtgatctttgatacccaggatgggcccgatatggatgagtatgagttctggcctgatttggatgatgaaggaggcgacttcgtatttgaagattggttcattgacgttgtgcccaagaaaaagattcacgatggtgttgaaatggagaagaagcgaggcggtaaaattggcaagctgatgagctccaatgtgacttatggcatgggacgacccagttctaccattaccaaggcctccttttcgtcgaatgcttcttatccgcagggaggtgacctgtggcaggggacaatggccaaccacagtgctgaaccgagcaagcacttcgtggtggagtcctccaatatcagcgagcagagcaaggtgtgtgctattaatttatttgagtcaactttgcataaaaaattgaagatatattatttaataactatggaaacttacagataaactcccgaggagcctgctatgtataatatatccatatacttctagctagtaacaattaggtaaccatagatatttaatcactctaactttaatgcattatgtaatgtgcaaccaaagccacaagttagtaagcagtatagtgccatatagctggaagacttgatctgttcaatggagagtcatgcaccatctaatgttctagccgttaccacacaggatctttattgcattccatttaatattgttttgccatgataagagtcctgcaacgcataacatctgttcgtaaggtagcattgatttgttgtcatgctaattcagttatgtatttaattctatctttagctctatttaagttctagtgctgtacaagtaatttttttcaggtacttaatacagttcttgcttattttcagtagcaggtcaacaggaatattgtgtctgggactgggatctggagttaaggatgcttcacaattcaaatttcacaagtatgtgaccatctaagcatgattcaatatttcgcatcataaacacgtgatttgttgatgaatattaaatactaaaatttggcaagacgtgtgggttcttggcaataaattggttctttgtactagcaattaacaaaatcagttagtaaatattgacatcgttctgctcaccaataggttgtgcctgttaattcttccaacatgctgtggccatgaccaaagttacttcctccctaattcgatgttaggtaacaatgtgctatttacagttcatttgttttctctatcttctgtaaagtccagatgctctaggattctgaaaagaaatggttaaatgtgaactaaaatttcatactaggctctgaaatctaatctatttgtttgccaatgctttaatctatttgaaaccatagtgacatgtcttgagttttactctctatgattactacacctgttgtctagtttctaaagtgtcttctgatacatgataatggaactagaagaactaaactctgcaaaactgtcacagtagcaaccttttgttcttttcagatcgtgtgtgtgtgtgtgtgtgagagagagagagagagatagagcatgtgtgctgatgagggggtataatctgctgttgcatgtcatacaacaccataggtttttagagctagatttactaatgcaatcaacatgtactgagaaagaacccattttatgcattgagaaagattagatgaagtaaaaaacctggatgcagttgttcttgttcttctgttgcttccaagttgagatcaaaagctcccaagttgagatcaaaagaatgtacaacttgatcatttccatggcaagcaactcgagcaatgtcatctacctagataacatgccttccaggaacttcttcttctagattggcttgtgcttcattgaggtcaggtaaagcccctccatcttcctcttcttctgctaatatgtttagatctatagccattgtgatgggtaggtgtggagttggtttgtaggatgatggatgaagtgataaaaggcttgtagctgcctcgctgcttgaggattatggagggtacccttgggcggcaaagcaccatccatggagtttttgaatttgattagaccagttggattattttaagcccttatgttttggcgccatatcactcgaattaggtgtataacaccaatctgtagtgttgatactagtagtagcacccaacattaattggatgcttcaaatattccttttgtacagatgtggcagtgtacttgtcgtactcctactaagcattcaaatgattagccccaatcctataaattgagggcaaaatggtcattttcacacaacactattttttcctaactaacctagaacgtcctcctttctgggacggagggagtaatttgctacaaaacacactaagactattaaattattatttccattaggatcggagagagaatttaactaaaatgactttggtgccccggatttcttccaaccatccattcctctcacgcgtagtaaggctgtgttcgctccagcgtgttcccaaccggaacagtgcgtacggaaaacggaacggtctattagcgcatgattaattaattattagctttttttaaaaaaaaatggatcaatgtgattttttaagcaacttttgtgtagaaactttttgtaaaaaatacactgtttagcagtttgaaaagcgtcacgcgaaaaacgagagagatgttttaggaaacctgggggtaagaacacagcctgagggtgtacggtgcgaggaccggcgatgcgactgtatggtgtggcggtagcgactttgtagcgggtggctagcggtgtagcggtgaggactacatagtaggccaacacgatggcagcggccttgagggagagggtcacatgagtggactgtgacatggagcacagcagggagtgagcacgtgaggagcagcatcacgactaggtggtgcggcgggggtagcgcgctgcgtgaggagaagcggcagtgacctcacggtgggggtggctgcaacagtgatgatagcgtgactgcagcgaccttgctatgagacatgggtgcacagcgcttgtgctcacacgaacgtgagtagtggttgcatgactgcacgggcggcagcggcaaataactcggtgccggagaaaaactgaaagaagggagaagaagataagggcaaaattcatattttatgtggtttctctcgtattaattggatggataatatattttaatgcgtccgatgttttgtgacaaattaacatattatcaaacagattcacattcttgtggtgtctattagcaaataccatacttctcgagtgttctgcaataaattttgtcataaattaaccagttgtcgagactcgccttaattatcgaccgaatgccggataaatcctatttttttgtcaaatttcgatttcaataaaatctattgtttgcaatatgatttctcaaaaatcctccgaatttttcaccttttttagaggttcaaaattttcacttggaatccactttcgtctatggcgtcgaaattaaaccttgaaattccatgaatttattttatcagttttcattgaaaatgtgtgcttactaccatcggatgaaatcatgtgacgtttcggatagtgaaaatggcttacacatagtattttagctctcagaagcatcagataaacctaactagagggagtaaagggcttaccttggctccgggctgggctgcagcatcaacaccaacaaagacgccatctgatgctttgtccaaagaggatcgagatgcaaaggtccggttcaagctggcacagatggtggagctggcggcttctactgcttcaaggccgatggctagtcatccccggttgcagttggcggcgaggacgcagctggaaacttcgtcaggttctcgtttttcagttttgtagggtgtttctgaagatgaagatcatttacacttggagccggctacgaagccttggagtggtcctcttcctgcgcctcgtcgatcgccgccaagaacgattggaggtattatcaaagcagcgattcagggtaaagtttttttgtcgtttccttctacaattcagagtaatagatgttctccggtagtctcttccgttccggcgagatctcggtctcctccggcggtgagtccggttcctcgatccgatttggatgcgtttccaaaactttcgggtgattcatctatttcgaattgtgaggttttggatgagtttttgccgcaattgccacataggcccagtattccttttaggcccacacctggtcttgtctctctattcgcaaaaacggggacagtgcgccagaaggttaggtttacggatcgatctgtgccgcctccttcgtacgccgctgtagttcgtcgttcaatggagagaaagaaccagcgtcctgttcatggagggggaggacaaggcagctttgctgctcgtgcaaactttcatccaggtcatggcgagggaggttttcaaggtgctcgaggccggtttggcagaaatcgctttggagctcggaattttggtggaggccggcaggggcaaggtggaagaggttggaacggcaatggtgggcaaccaaatgctggttcccatggcggaggagatggctggtttggacaggaaaaatttagaaataccgaaggtggttttggtctgcaagctaggccaatttttgggcataatcctgggctaaggtttgggcaatctccaacctttagctttggattgcagccggtcccgttgccgtttggtcagtttcctccggtgccggctggtggtggcgacgcatctctattggctgccggcagtggcttggcacaatttggaggagcggctgcacagtttggtggcgggatgattgcgggtggtgttgcgcagggatcgacagcagctcaacatggtgccgggttgacgggcgccggtgcacagactagtagcaactctggaggcaatggttctgtactggctgggattgctccttttggtgataatgtgcatcttcctggcggggtagctggtgatcggcatttgaccgctgtaggagaatctggtgcctcggctggagtggttgcagtatagacgatggttgggacttcacaaccaaccgttacgccatctactcaagagaatgcaggtagaggtttaattatgggggacaagagctctggtaaagcaaaggtggataatcagctgagtgtgcatgtaggtggcaaaggtattaacaagaatccatattgttatagatgctatactaaaggccatacgttgcaggaatgtacatctaaattttactgtgaggtttgtgaaagtgaggaccatataggatccaggtgtcctatttttaggtctaataataaaccctcagctgagttgtgtgggtatgcagtggatggtcttggtttttttcatatccctctttcagctggccagagaataaaacatgattctaaggctgccctagttaaagtaactagaggacaaatgacggtgcagaccgttgtttctgaattggagagattgattcctggaaattggaagtgggtggtggaagataatggagataacacttttcgtactatttttccttctgctgcggaactgaaacgcatggtagaatggggaatagtacatactaaggttagtgatgcagaaatgaagataattgaaaggggagttagtaatgaggtgaaatatgtgttgccaaaggtatgggttcaatgcaaaggcttaccttctgagttaagggagtttttaattatttgggcggttggttcaatgttaggtattacaaaaatggttgatatgaattttactagaagatatgacattgctcgtttacaagttctggttttagatccctctcttatccctgatgtggtggatgtggttattggggataatttgtatgagctgtgttttaaggtggagccagaaaatgggcttgatgtgcctgaacccatggacatggataatagtggtgatagagaagatggtaaaaatatggatgggagtgatgtgcaagataagggtaagggatcagatggaagtaattttaaggatggttccctactgcaaggtggtggccagtttagtggttctgtttcaggaaaaggaacgtcttctgagccatctactcaggttttgtcacctattattaaaggattctcaggttttgtcacctattattaaaggattgacagtatctgatgaggagtttgatgggcttgtggaggaatctgttggggcaggatcagttaagtctcatgaaagtctagctgttaagttagcggcagtacctgacacgattctctcccctactagacaaagcaagagaagagcaagtgatagtgatcaactcactttgcagagggctgaaaagattaaagctgggaggaatttggaggttcagaatgttaaaggtaatttgcattttaatgattccttttttacatttgtcagataaagttatttcgtcctctctttctaaactgggttttatcgatgcaaacaatgatagtaattttgtgaatgctattaaggatataaggagtttggaagaagctaggttaagtgattgtattagtttgaaagacaagcataattctactgtttttcctgaaaatgaattgaccgacgatcagttggaggataattcagttttggaaaaactttgtagtgaaatcatggaggaggtaatggatacgggtggtgattatgattataatttgtatatcacctctgattctatgatatctccttcgataaaaaagagaagtgacaagaaagttaggtgtaagaaataattttacaatagtcttaatgaaaggagtttttttggaacagtgatgggttcaaggacccaaattatttctgatcttacaaaggaacaacaactagatttcattgctttatcggagactgttaagagagattttacatctagtgcccttaaaaatctttgtggcgggaaagattttttgtggcattgtaaacctcccagggggtgttctggtggtatgttattagggattaatttacaaacttttgatattggttcaattgatgagggcgatttttatattaagtttcatctttgtaacaaaattgagaagtttaaatgggctttagtcttggtgtatggacctgcacaaaatgatttaaaggaacattttctttctggattagttcatatgtgtagccatgaaaccttaccaattattgttggtggtgatttcaatattttacgaagcactatggaaaagaataatgacaattttgataatagatggccttttctttttaatgctatcatagacggtcttagcctcaaagaactctcaatgtctggaaagaattatacttgggctaataatctttcagtacctacttatgagaagttagacagagtattaatgtcgacggagtgggaacaaaaattcccactttccacgatatttgctcttaatcgagatatttctgatcatactcctctactcctgaatacaaactcatcttctgtatgtaatagtcaatataactttaaatttgagttaggttggctgttaagggatggttttgttgatatggtaaaggaaatttggttaagtgttgatgaaggaaatacttctctagagaggtggcaagcaa

SEQ ID NO: 60406 - DNA, 14288 bp, Oryza sativa
  unsure (1)..(14288): unsure at all n locations
tgattatgattataatttgtatatcacctctgattctatgatatctccttcgataaaaaagagaagtgacaagaaagttaggtgtaagaaataattttacaatagtcttaatgaaaggagtttttttggaacagtgatgggttcaaggacccaaattatttctgatcttacaaaggaacaacaactagatttcattgctttatcggagactgttaagagagattttacatctagtgcccttaaaaatctttgtggcgggaaagattttttgtggcattgtaaacctcccagggggtgttctggtggtatgttattagggattaatttacaaacttttgatattggttcaattgatgagggcgatttttatattaagtttcatctttgtaacaaaattgagaagtttaaatgggctttagtcttggtgtatggacctgcacaaaatgatttaaaggaacattttctttctggattagttcatatgtgtagccatgaaaccttaccaattattgttggtggtgatttcaatattttacgaagcactatggaaaagaataatgacaattttgataatagatggccttttctttttaatgctatcatagacggtcttagcctcaaagaactctcaatgtctggaaagaattatacttgggctaataatctttcagtacctacttatgagaagttagacagagtattaatgtcgacggagtgggaacaaaaattcccactttccacgatatttgctcttaatcgagatatttctgatcatactcctctactcctgaatacaaactcatcttctgtatgtaatagtcaatataactttaaatttgagttaggttggctgttaagggatggttttgttgatatggtaaaggaaatttggttaagtgttgatgaaggaaatacttctctagagaggtggcaagcaaagattcgcagactaagacaatttttaagaggttgggctaaacaaactagtggtacctataaaaaggagaagaaagccctgttagaaaaacttgatttacttgataaaaaagctgaatcaaccttgttaactcaggaagagcttaatgctaaacattatatgaggaataggttagcttgtttgcttagagaagaggaaattaaatggtatcagcgggctaagaccaaagatattttggaaggtgactcaaatactaagtattttcatttggtagcaaatggtaagcataggaaaacaagaatttatcaattacaagatggtgaccacatcataaatggtgatgcaaacttaaaagcacatattaccacatattataaaggtctatttggtccacctgatgagtcttctttaactttggatgaaagtcttataggtgatattccccaggtgtcttctctagaaaataatcgttagttgatgaatttactgagaaagaaattaaagatgcagtttttcagatggaacataataaagctccgggtccggatggatttccggttgagttttaccaagtgttctgggacgtaattaaaacagacctggttgagttatttaaagattttcatagtggaagcttaaatctttactctcttaactttggtactattattttgctgcctaagtgcaaagaggctataaagattcaacaatataggcctatttgtttacttaatgtcagttttaaaatttttactaaagttgctacaaatagaatcactggggtagctcagaaagtaattagtcccacacagacagcttttatacctgggaggaatattatggagggggttgtcattcttcatgaaactattcatgagttgcatcggaaaaaaaatgagtggtgtcatttttaagattgattttgagaaagcttatgataaagttaaatggtcttttgttcaacaatccttgagaatgaagggcttttcccaaaaatggtgtgattggattgcttcttttatctaaggtggtcatgttggcattaaagtgaatgatcaggtgggatcaaattttcaaacttacaagggtttaaggcaaggggatccattatctccaattctttttaatatagttgttgatatgttaactatattaattaagagagcaaaagatgatggtcagagatctctggcttggtcccacatttagtggacgatggtttatctattttacaatatgctgatgatactattatttttctagagcatgatttagagaaatcaaaaaatatgaagctgttattaactgcgtttgaaaaactttctggccttaagataaattttcataagagtgaattattttgctttggtcaagcaaaggagtgtcatgagcaatattcaaatatttttggatgtaagctaggtgattttactgttagatatctcggcattccaatgcattttagaaatcttagtaataaagattggataacaattgaagaaagaattgaaaaaaaactcagtagttggaagggtaaacatatgtctgttggtgggagattggttttgattaattctgttttgtcaagtctagctatgtttatgatatcgttttttgagattcctaaaggggttcttcaaaaaattgattattatagatcccgtttcttttggcaaggggatgaacataaaaaaaagtatagattgacaagatgggatattatttgtcaaccaaaagatcagggtggacttggagttcacaatttagaaatacaaaaccaatgtcttttaagtaaatggttatttaaattaataaatgagcaaggtgtgtggcaagatttactgaaacaaaaatatcttactggtaaatcaattactcaggttgagaggaaacaaggggattcccatttttggtcaggtctgatgaaggttaagaattcctttttaaatatgggttcctggattattaataatggtgaacaagtaagattctgggaggataagtggctagggaactattctttgaaggaaaagtacccctcgttgttttctatagttagaaggaaaaatgcctcaattgctaatgttatgggttctgttccgcttaatgtttcttttagaagagctttagttggtcagaatctaattagatggcataatttgtgtgcttccattgtgcatattaacttaacatacgaggatgacatttttagatggaattttcatcaaaatggccaattttctgttcgatctatgtacttagctttaattaataatggttacatagaaagaaataaaattatttggaaacttaaaatgcctcttaagattaagatttttatgtggtatctccttaaagggattgttttaactaaagataatttggctagaaggaattggaatggtagtttgagatgttgcttttgtatgaaaaatgaatcaattcaccatctattctttcagtgccatttttctaaatttctttggagagctatacaattctcttttggactttatcctccacatagtatatctcatatgtttgggaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaacgtattggcttcggggttgggctcagttgcaaaggcatgatgaagatatcaagctaataaatgatgaatgtcgtaaacttgagacgacaattatgcatctatttgccaacttcgggtggaggttctctattagaattcagtagttaggggatctttttcttttgttggtgtctattagtttgcttagctttgtttctgctatcgtgaactttctgtgtgagttccataataattggctgtaactcttagagtaaaggccggaatgttacattccattatctaaaaaaaactagagggagtaactgggaagatcaacagcataccgtacgcttaattactctacacgcatgtaacccagctggtatatagcttttccacatttccagttactcgattggaatgcaatgcttttgagtaaaggccggatattatatttcattatctaaaaaaaatttaattatgtctattcttaagctatgattgagcttgtcttacgggaatattttttcccatgaatagctaaatgattttatgataactatttatgtacgagtacaaataaaataaattaactattataagattttaaaaatagattaaaaaacaatattactaagtcgtatatatttttatgcgaaaatcacatcgtttaattaggagtcggaaaacacatgccatagtttttataattccatcattatatacagagatgcaaaattatatgaatcaaatggtcaatttttcgtctacggctattaaaaacctcgaacgaaagtcaaatcaagaaagaatggggatttatcattggttagaggatggggtgtcgattgaccgtgatggctgtccacaacagattgtcgtatatgtgcatgcttgcatactcgggcgtacggtacgggtaagctaaggctgcgtggaatcacgctgtacacacatacgtagtatagagtacgatttggatggccattttcatgaacaagtcgagagatatagatagatgtggcgaccattaattcattccttctgtggctttagcagtgtgcacggatcgcccttataagtgacactactttaaaaaatatatttttcatagcaccactcttttatttttttttcctcaagtttaataaacacacgcttgtaaagataattaagagggattccgatcaccaactgccagtgaaaattagttttcgttggttgtcgcttaagatatctgcttgcaaaaatagaggtatttttacaaacggttcctttaagcgacaaatttcgctagtagcggctaaggagtaccaactgaaaaaaaaagcaaaaaaaaaataagttctctatattaaaatttccactgatcttatatccccttctctcactcagactctccctcctagctcctccccccacctctccccttccctcccccacccctggctctcctcctctcggcaaccacggcaggctagcaacggctgacgcggagcacctgatgcagacttggcacctgacgtggggctgcattggctttcgatctccggcgaaggggtaagtcctacgttcggccggccctaccaattgtatcgactacattggtattgttcaaagctacatcgcttcgacctcttggatcgctctggtttggttggtatacttgcatacatatttatcatatatcttagttaatctagtttagcatcttaatttacttttgtatcagctgagattcgttttagggtttatgctgtatcggctaaattatcttgctaaattatattagctaagatatcaccaccctaaaaattagtcaaaatagactttatacttctttgcatactttgcgatgcatcatccatcgccaaagttgggcagagcaaggcgatcagtgtgtgttgggtcgtctcctatatatacagctaggcaggtgattgacaaatagctaatccttgttacatcgagaaagccagtccaattaagggggaaaaacacgaatattagagaaggatgtaatatcaaataaataaaatggatgaggcttcgaaaccaggctagctagcccaccatcttattaattaagctagccggaagacccctgcgtgtttctcaattaaggagagaaaaatgctacttcttcagttaactgtttttcctactctcttgcaaatttagtttataagccaactatttttctttttctctgttttctccgtgatcagagaatcattcaatcattcattttcgatgtgcatgttccattgttcctagatcttgatccacggatgaatgatccatactgttactgatcagtagggctttctgcatgtgtcgcgccctttcgaaccgtcgaaccgtccaattaatgtgctccaaggctgacaaatggtgtcttttgccgagctgcatagtctcgactggacacatatatattcatcagtatgttacatacatcattggattagtggtttcgggaatgtttttgcaaatacacatttcgccaaattctgatctgacgatccagcagcgcagatagatccacggatgcttccacaaaatattccattcctgcagtatatccagatctcaacaaaacgcaggtcgatcatcagtgtccactgaacaaaagcacatgccatgcatatacttgcttcatcgtaggcttagcagctcgctacagtgttgaccctacaatttttagaatcatgggttttcgcagcaacgttaattaagggcttcttggcagtagcagaggtagcaccgccgttgagtagaggtgataatagcattgtggagattatgggtaccccatacccacacggcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacagttggcgcgccaggtaggggttgcgtcgagtttcctatcaacaagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcttccgtcgccgccgaccggtgtcatcgcctatacggttggtcggtcacaccaccgttcatgggcgtccatgtcttcaccgaccggctggccttcgccgccgccgactggtgtttccgcctgcacggctggcctattatgccgccgccgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatcctcaccgttggctcaccttcgctgccgtcgactggtgtttccgcctacacggctggcctattatgccgccgctgttgggcgtctacgacttcaccgccggcctgcctccgtcgccgccgactggtgtttccgcctacacctcggtacccattatgccgccgctgttgggcgtctacgacttcaccgccggcctgcctccgtcgccgtcgagtggtgcctccgcctacacggctggcctattatgccgccgctgttgggcgtctacatcctcaccgttggctcaccttcgctaccgtcgactggtgtttccgcctacacggctggcctattatgccgccgctgttgggcgtctacgacttcaccgccggcctgcctccgtcgccgccgactggtgtttccgcctacacggctggcctattatgccgccgctgttgggcgtctacgacttcaccgccggcctgcctccgtcgccgccgagtggtgcctccgcctacacggctggcctattatgccgccgctgttgggcgtctatgacttcaccgccggcccgcctccgtcgccgccgagtggtgcctccgcctacacggctggcctattatgccgccgctgttgggtgtctacgacttcaccgccggcctgcctccgtcgccgccgagtggtgcctccgcctacacggctggcctattatgccgccgctgttgggcgtctacatcctcaccgttggctcaccttcgctgccgtcgactggtgtttccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcttgccttcgtcgccgccgactggtgtcctcgcctgcacggctggcctatcatgccgccgttgttgggcgtccacgtcttcgccgaccggctggccttcgccgctgccgactggtgtttttgcctatacggttgacggacttcgccgctgttaatgggcttcatcatctacaccactggcttggttccactggcgccgactggtgtttttgtcaccattgatggactgcttcgttcccacattggctacttctgccatcaccaaggggaatattacaaagctaagtcgtcatttattttattctttatatgatatttttccttttcctctgcctcactacaccaattggtcttccattgagtagtgagtcgggggctacagatgttatatcatattttttataatattcatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgaagaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttctcgcctgcacggttggcctattatgccgccgctgttgggcgcctacgtcttcaccgaccggctcgcctttgccgccgccgactggtgtcctcgcctgcacggctggcctattatgccgccgttgttgggcgcctacgtcttcaccgaccggctcgcctacttcgccgccgactggtgtccacgcctgcacggctggcctattatgccgccgctgttgggcgcctacgtcttcaccgaccggctcgccttcgtcgccgccgactggtgtccacgcctgcacggctggcctattatgccgccgctgttgggcgcctacgtcttcaccgaccggctcgcctttgccgccgccgactggtgtcctcgcctgcacggctggcctttatgccgccgttgttgggcgtctacgtcttcaccgaccggcttgccttcgccgctgccgattggtgcttccgcctgcacagctggcctattatgccgccgctgttgggcgcctacgtcttcaccgaccggctcgccttcgccgccgccgactggtgtttccgcctgcacggctggggcgcgtcttcaccgaccggcttgccttcgccgctaccgattggtgcttccgcctgcacggcagacttattatgctgccgttgttgggcgtctacgtcttcaccgaccggccgccgcatccgcagctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgctctcacctctacgtctggtttatacagttaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcaacttcatctttattatcttcggcactggcaaactctattgctgctacttcgcaagttttactacttcaccaaccacgacgtctttgtgagcctcgacatctcggcatgcgatgccatgttattttactacaacaagaggctctccaatattcaggatttctacttatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattcatcagccaatgagtcaactccaggagtcattatcttcatctttgcttcggaacagacattctacttcaaatatttcggtttgaacgagttggacaacaacatcaactctcctccaagtgaagcatctacaacagctataacattaatttgatggattattgtcactgacatcatcaccagcacctttgcttcatcgcccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcttcttcatcatgtcggttgcgtttgtcgccgccgactattttcttcatcttcatgattggtggatttcgtcatcgcctttgatgcgtgtctacatcttcaccgtcggcttgctttcgtcaccaccgaccggtatcctcgccttcatggatggcttattatgttgccactaatgggcatcttcatcttcttcaccaactgcatcgtctgtcaccgactgattatttcgctgccatggctacacaactttatcgctgggcgctttcatcttcattgctggctgacctgactgttgccgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagctattgccaatatacaattttgactatgacagaaggacaagctatatgctcaggggctcatcaactcaagcgtgaggattatatctccaatttggacttgttccggatacatcccacatggattcaaagtcatgagtctattttctatgctcaaagactggaccaattattattccccgtaagggctatcaaccgaatacttgcgccagtcgggattcaattattatatttattttagagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatatttttaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtgatcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttccttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttattttttcagccctccacagtcttctgatttagaaaaagtactcgggagatcatggcgaagatgattgaagcactcggctttggagtaatctagttcgagagaagattatctttctgactgtgaaggtctcaggggctactgtggagattatgggtaccccatacccacacggcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacaagcattttcggttaaataatttttattggcatctattgctgtcagtagtgaagacagcaacggtagagcctggccgcctgggcaatcgtccgacctacccggaagccggctccatcagttcttgggaatgcaggaaatttaaaaaactattttagcataatttatttcaaatatttcaaatttcctccaatcttaaagaggtctctaaatgtgtttataaaacttagggcatgtatctggttttctttgtttatacaaaactattaaaaaatattttcggttattggcaagaaccagttaatatattttggcaagggaaactcaagaaaaatcacaccaagccatttccacttattagatagagtttttaattagggattcattctaggttaacttaaacaatttcgtttggtgatttattaaatgcattaaggctaggaaagggaaacttcatggtgtgatagttaccgaatagaagcaggccacggttagctcatttaaatcaacacacatacaagatggaccaaaaacatggggagacaatgatttttttttccgaaattcagattacagggatctactctcattgagcagctccagagannnnnnnnnnnnnnnnnnnnnnnnnnnnnnnnnnnnnnnnnnnnnnnnnnnnnnnnnnnn

SEQ ID NO: 60407 - DNA, 1540 bp, Oryza sativa
aaaaaagatagggaccatgttatgtgaaactgaataataagaaaaacttagatggcacactcagttttcatcaagcaaataaaaaccagatacttacaaagatcatctctccatcatcctcgtcatcatcctcactaatgtcagctgcttcttgcaatggaacacttacagtatactgttttcctttgccagtcaaatttgcctcttcctctgcagcaagtgatgcggccagccttaaaacatgcaataaaaacatcaacttaatgatcttaacaaggaagaagtatgtggaagctatagggaggcacacacagttcatccagtttctcctggtcgattggtgctacaatccccccgctgttttctccatcgttgtttttcttttgctctccattaattttctcaatttctcccattttactgctctcaacttgcttgcctttattgtcatgcttagccctgtcactcttgatttgagctgccaattcttcaagcttcctagccttgagctggaaccacatgcccaaaaccataaagatattgattttgcctttccaacaaacttaaaatactagtaaaattaaaatgccataccatcattgctaaacgaatggtcatttgaattttttttttcaatatgatatagtatggtaatggagtgtggactactcgggaaaagaaactagaggaaattaagagaaaatatcagaacaaatttaatagcctagacaactcttgggaaaagaaactagaggaaattaagagaaaatatcagaacaaatttaatagcctagacaactctcctttatgtccactacaaacacttttgggtggttaggacacatttgggacctagggaaatctcccagttcctgaagaaactgaatagtggaattccagtggaaagagatcaatcaaataacaggatgatcacaagggtagagtccaatacaaaagaagctggtgggataaattgctccctttgcttgtaattttttttgtggggaatgtaaattaaccctgagaaacatgtttatgacacgttttttcccatagaaatgcaaggcatcatccttcagaaatcagtagtagtttttccccagagaagtaatacatgggccttgggtagatcattctcttgttcacatgatcatagcatatttggttgtcattgtagtgttgtactggtactaaaatagagtgtatagtgcaaattctctggtcatcactcactactagtactggattaggaataaaatttcctacaaatcagccatcatccctacagtatcaattgggaggatacctaaaatacgctgcgccaataagaggaatggggggagagaggccacgtacatgggagagcaggagcttctcggcggtcttccggaccttggcctgggcggcgtcgcggtggcggcggcgggcggcgagggtgcgccgcttgagggccggggtggcgccgtcgaagacgaagaccgggcgcgcgcggaggaagaggagcttgcagattcggcggaggaacccgaggaggtgggcg

SEQ ID NO: 60408 - DNA, 22536 bp, Oryza sativa
ttctcattttgtctttaggaaccgaataggttaggatttctggaaaaagggttttgtagggatgcaaatatccaacccatgttttcgagtacttatgataaaagagttcattttcttcagctaatggtcctgcacccttgttgaatgatatgcttttgtcctactagttggatctatgatagagcactttcttcttcaattatataagacggtctctcttttagttaacacatctttgctaatctaagatcgggtgatgttataattagctgactttgtgctagttaattagttgacttcgatgctagtagtgtcaattaacattgttttatgtatgttagtctgagtctctcagcctctcaggtgaggaatgattccttccaatagccaagggaagttctttcacggtgaaatttctatttggggatgtaccttttctatgaaacagtagctgttgcactatagagtatagtctagtgtttaatctgtatgagctaggttgagatgttgcatttctacattgtatttttcttgacactaatttacttcccacaggaacattttgttcaagtatggctgtgtatgtaaacttagtcttaacaatgtgtatctaaaattatattgtataggattattagccgaaatgtaaaaccaattggggccctgacaataagataagtatactggtccaaactccggtgtagggctgtcaacgagccgagctcgagcgagcttagatcctcaggctcgagctcggtatgaactcgagtcgagctcgagccgagcctggactaaccttcgagcttgcagtcaagctagcctcgagcctaatcgagctcgcatcaacgcaacacaagcatgtgtacatatttcaaaaagtagagaagctgacagaaagctgtagctgggcacgttgtgtagagatacggccatacgggagcactagtgtactgtactactagtactagcacaggagtagtctgctttgctactactactagctttgggagtagtgttcaagaattgattgcttctgtacttcacatagaccaatgttggagtagtagcagaccaaggaaaagcatcgatgattttttattggagaccaaggtaaagcatgagacatgacagttactaactaatactcgagtctttaccgagctattcgagctcggctcgttaaagtgcacgagcctcatttcaagctcgagctcggttcgttttaggctcaagccgagctcgagccgagcctataacgagtcgagttctagtagcttgcgagtctcgagcttttttgacaaccctactccggtgcggtgaaggccacgcgctactgatgtttggttggaggtatcagagttggcgggcgacggaccacagcgacggggtgaagagggtctcaggcgaaacctagcctagtgctttattgggccggcagcggctacgccttttggtgcagtaaccctcttgggggcgttgtcgaggaaccttcctccctcgacgaggatctctaggtgaaaaccgtgtccaatttctttggacgggcgacgacagcgtcttttagcgtcgcaaccttcgtgaaggcattgttttcggagtatcctttctatggtgttgttgtatacccggcggcgaccggtctcgcatagcggtggccggtttggcgttcagctctcctctctgtagcttgtgtctgtgtggttggcgtgtggtgtcggggcgtgtgctttgctgcacatcctttctcgacagctcgctgtcgatgaaaaactttcttgtaaacatttttttcctctatcttaattacatttgatgatctccttcggtaatcccgacaaaaaaaaagtatactggtccaaacagttcgatgttatagagtatatttctcttaagccaaacatttccccgggtggcaggactaacaatgtcaactattattcatttcaatgagaaagggaacaatacactagctgtatatctgcattcgtataatctgtatgaagattttaagtctgttttgaactgcttgagaatattgagatagctcatgtcttactttcttttctctttagcatccagcttgtttaaggttccggttgatttcttttgccagatcaacagtagactattcagttcaagacatcaaacagaactttaaagcgtgttgttctttcttgaccgagttactgaatatatctgtggaactggtgtaacgactcacagcttttcaagacatgatgctctacttatcttcctttttttttaactttgggcctgatatacatgcgttcaaaataagtatattgtctatcaatattttcccaacgcatttgattagctggtaactggtaagtacttttgctgaaagtgtttggttatgtagacttgaaatatgctaagttgatagtttgcaggatcataaaaacaatttgcagctaagctgttaccaccctggttagcaattccagttatttcaaactctaaactctatttagagcacatgtgtttcaaacgcacacttttttcatatgaaagttttcatataaaagttcttcgttgaatgtttttttatgaaaattttgagataaagtttttttggatgaaagttttgcagatgaaagtctttagaaaaaaactataagctaagaatgcaagtgcgctaaatagctgtaccccttgtattgtgttcttcccccagatttcctaactcacttctctcgttttccgcacgcacacttttcaaactgctttgcaaaaagtttctatataaatgttgttttaaaaaaacatattaattatttttttaaaaaaatagttaatacttaattaatcatgtaataatatgtattttgttttgcatgccgagaaagaggtttcccaacccctcatctcgaacgcaacctaaatagagtttagagtttgaaactcctgcaatgcattgcttggctgcacaaaatacctcaggctgtgtttagttcagcgtaaagtttggattttgattaaaattagagatggtgtgactgaaaaattgtatgtgtatgacaggttgatgagatgaaaaagggctgaagtttggacacaacctcagtcttcttactcaacagagtagctgtagacagtacaatggtctaaacagatttgatacggaaatcaaatttacgtgtcctccgcatgcaagttgatcaaaaaaaaggaagtcatggccggaacaattcactgaatattcgcactgggaagtagtatttttttttcgagaacgattgctgttgaagaagaagaatatcatgcgtggacacactgattggcctgacaaaacatagttagcaatttgcattaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttacggcaacatttggatatcgaattatgtccaaagagcgaaggtatctgttagctaatcatccgatcggactccttttctttaactcatattctcttaattattcctgtgttttgccggaatcctgactatcatttcactttctgctcaaatgcagtcgtcaaaagacatgtttaatttgctgttctagatccatcacttaactagtaatacttaactctttctcaaaaaaaaaaaaaacttaactccactaatgcaccactaactcacacgcttagcaattaatggaaagcataaactatatgtcatgtgtgttctcatcctgtggacacctgtcgatcgaccaagtgacaacaaaacttctatacgattgctaatcggttgtgactcttgtaatgaaaaagagtacgtgttcttgactggatatagaggtcgttttcttgcaagcaaatgatggtgattggtggcgtactggtttgagcatcggggtgcacatgatggtggtggcgtccaagtgcatgagcagtcaaccagacaacactgttgtctgtcatggaccgatggacgtagaccgatcgactaagcaggctcagggctcaacttcgtgcgccaagctgcacgatgagaaaatcaaaataccctaacgttatgcatgttaacttgttaagtacttaagtgcatcgtctcttattaggccctgttatttttaacttacggacttgtgaataggtgtaccacagatatcaaattacgatttctccaaaaaaaaaataatcatatcgacattactcgaataactagttctactatttttaaatttatattcactccgtgttcatattcatgccacatccactcaatatcgtttatagtatggtacagagggagtatagaataggtaactcacccctataaaaaaaatctaaatatgaaaagaggagtttccatataaatggtaataagaagggaggtgaatatatatatatatatatatatatatatatatatatatatatatatatatatatataaaagaataagagaggtgaacacatgcgacgacctctgatagggttcgaacgcaggtggacacacatacactccaacacactggtcatctgcattactctagcttaaattcatccttctaatcatacaaaaaatatccataatatatatgtcgaatcatctataaagaacatagccatagtaccactagtgaacaaagagtccacaatcctaggcaaccacttagggtttattcgattcacaggattttcaaatcataggaaaaacgtagaaataatgtaggaatgcacgtgcaaaataaaggattggaacataggaatttttcctacactgagctaaacaaaagaggatagagtagatattttcattcctatggaattagtacattttggaggatttttggaggattggcatagtattcctatggaaaattttcctttaaatcctacaaaccgaaggcatgaatagtgcttattccaaaggaattgagatttcctttagaaatccttccaaactaataaggcctaggttcccccacttcacctgtgtggttgtgcgtaataaaaagagtgagaggttgtttgggtagtggccgcagtttgctacaccaaaccttagacgcgccacaatttcttaggctagtggctggttgagtgccatagttgagttaagctacactttattagcacaatggtccacgcgtcatatttttattttctagccaaaatttaccatggttgtggccaacaaacactttgtatggcttgacacagttataggcttatggtaaataaagttatactgtggtaaagttagcctccatccaaatagcccctgaatacatgaatgagccataccgtattttagaacggatgaagtagttagtagggcttaaacaactaaagattcaaatcatatcacaaattctattacggttgtgtttagttccatgttaaaattggaagtttaaagaaattgaaacgatgtgacggaaaagttgaaagtttgtgtgtgtaggaaagtttgatgtgataaaaaaattgaaaatttgaaaaaaaaagttggaatctaaacaacaccagggtactacctgatacgtcgtgtgcaccagggtagaaaaatgtagcaaaggccgtggcacgcctagtagagtagtagtgctagcctgctaggctagtgtactacggccgtttgccatcgcagcagcatacgttcgctagctttcgatctggcggttctgcactcgtgtgcaagtgcaaccgagcatggtggagataattttcttttcggtactgtataccccatgggcggagctaccatgattcccgggtattcccgggaatacccaacttttttatcgaaaaacaagtatatttctaatatatacatatgtacacatattagtgcacctaaatcctcaattattcgatccaaacatagccctatacacatgtacatatattagtgcacctaaatcctcaattcttcgatccaaacacagcccaaccggcctatatgacccatcagacatcagttgatccacttagccaccactcttccagacggccccctctcgctctccctccatgacccatccctccctggctcggctccctcgcgccgctccccatttccaaaccctaggcggcggcgcggcgaggcggcaactggcggcgagaactggaccgcgctaccacggagggggaggctattgccgcggcgggcagcgggtggcgcccgccactccgccaagctcaggcagtcaggccggttgggtggccggcagccgcgaggggtagaagcggccaacggctcaacgcttagacgggaatacccaactttaaaatcctggctccgccactggtataccccgctagaatattaattattgatggaaggagaccaaacatatggcttcgattttctctctgattgtttttagttttggtttgttggacgtggttataacgtggctctaatttgaatatatctggtacggctctgttcatgtttcttctctctaactattctccatctctttcaacaaattaatcttttcttttttttctttgcaaggaacaaaataaaaaatatatatatttcggtttggggatgcaatgcgaatttgctgcaagttttttttcaaaaaataaaacttggctccgagcctacatatataaaattgtataaataatttaaaattagaaactcagcgactacaatgtgttttctaaggacatatagtctgaataactatatgaagtatacaatatctgacagcttagtttctgaagaaaatgaaaatatccccatatattttgttttcctttattcttgttttttaaaaggaatcggcacgaggttatgctatttcattaaatatagaaggagaaaaatacaacccctaggcgtaagaatgaaaaaaatctatacaaatctatccgaggttggaaggagctcctggagctttttttgctcctgctagggtccatgttcttgcttcctcctttattttcgccacgaggccaggtgtcgctatcttcttgtgctcgaagacttgccggttcctctctgtcgagatttctcagacaaccaacaagattaagctacgcatgcctttcttgggtacctcctttttgttagcaagtatctcccaacaggcttggacatcgaggcaaggctcccattggtttggatccaactgttgataggccacccaagaggctaggagtctccagactcttcctttattcttgttaagccctctatgaatgccttttgaagagaaaaaaaattgaagcttttggtccattaagagtctatttggttgaagggatgaaaatagatgaaagataatcatcccatttttacatgtttttgtttcatgggcgagagtggatgggatgggatggacactgaagagaatatatattctcttaagatgttggatgagcccccatctaaattgattgatgagaccatccacttttgtcaacgcaaatgattagacatagttagttttttcgttaattaataattttcatttcaagatctattatattattaaaacaactttgaaaggaggcaccacgttcgctgtggtgactaaaaattcccacattaatcggagaaaaagaaaaggagagtccaagcagaaatacaatttaaaaatagctgaaattcggaattaaaaataagcaatattgaaataagagtccatataagaacccaataggagattaatcaaaattcagaataaaaataaaataaaatatgaaattagaaaagaaaaaggagagtccaagtagaaatacaattttaaaataattaaaattcggaattaaaaataaggaatactgagagaagagtccatataagaatctaatacgagattaattaatattcaaaaataaaagtaaaatccaaaattagcaaaaagaaaagaagaattcaattaggaatacaatttaaaattaactgaaattcggaattaaaaaataagaaatattgaaagaagaattcacataagaaccctatacgagattaattaaaatttagaataaaaaataaaataatatccaaaattagacaaaattaaaagagagttcaagtagaaatacaattttaaaacaattgattttttttaaaaaaataaaaatattaaaagaacactatgcgatattaattaaaatttgaaaaaaataaattctgaaataagaaaatgaaaaaaagattttaattaggaatacaatttataaagaaaagaccatctaaaacacatgacaagatatattaagtaccaggcctataaaagagtagagtgttgacggctgatacgatatataaaaactgttaataaaacaccaaatagaatcctaataacgattaaaaggagggacgacatgcaggccgtgaagcaaatgggcagggcggttgttgggacttctagaaagttaaaaagtgaacctcattgataatcatattcgatttttaaaatctcaatgacaataaaaaggtgaagcagcgggcggggtgtataggagtatagctgcaaagccgccgacggttggcgggacttctagaaaataaaaaataaattccaacgatagttatgctcgatttttagaatcccaatgacaataaagagtaggcggcatatgggccgtagaggagtatagtggcatcgtttaacgggacttctaaaaattaaaaaaaaaatgaaacccaacgagacaataaactctaaaaactacgaggtccaatttttaaaggtttggaacttctaaaaagtaaaaaaaaaaccaataataactatgttcgattttaaaatctcaatgataataaagaatggaggcagcgggcgagccataaaggagtacaatggcaaagccgctaacggtttggcggaacccgaacgataattatgttcgatttttaaaatcccaatgacaataaagagaaaagacagtggacgggttgtagaggagtataatgacagtgtttgactggacttctagaaattataaaaacgaaacccaacgagacaataaactttaaaaattataagatccaatttttaaaggtttcaaagagaatgaataaaaatagtgataaatcgagtaagcaaataaagaaggatatgacagaagtaaggggtagcagctggtgtgacttttaaaagctatataattagaaatacgtggatgataaggttttgtctttcaaagtcttaagacaacgagatagctatttaataaattttaagtaaaatcagactggaaaatatatgattttgtttgggtgctagccgcgcaattgcgcgggccacccagctagttagtgtttattaggacaattaatctgttttattactaattattatgaaatacaataagattaatgataattactatattttgtaattagagtttcaacagagcaaattataagagtttctaaaaaaaacaatgcatgtactatttggagtttggaatgtaaggaatcaccaccaatatctattggcaacatgtaaatatacttctgcacgattttgtacactcttctctgttgtacttttatgaaagtgtagtgatatctccatgacaaacaatgtcattttgttttgtcatgacaaatcctaatacatttaatacattattttgttttgtcatatatattctctcgacgtttttttaacaactggaacaatacagtttcgctagcttcaaagatatcacttctcgccggcaggagaactgataatgcatcgacgtgatctaggcgactaacaagcgaatgcgcacggatcataagttaatccaaatatttttcaccaatcactagcaaaccagcttccctgtccctccgactttagcccacaaacaaaaaacacacaaaattattccttgttagttagcattatctgaagttcctatatagggaggcaaaagatcagaatccatgatttgaaacaaacacatttattttcactctgaaattataatgacatgacatgaaactcttccccacgatcttgccaactccttcacgaccatttttttttctcttatttcttttcttccaactacagtcctaccatccaacacaaatcactgacataataagaccagctctgctcattactctagtatgtaagtcacctaatcattagcttagtctctcactcattgcaccccaaattcaatcgccctcattgcacggacgaaatggtgttttttatgtgcgattcgcggccttgtgttttttctattcgtctttgcacgaatttcagcggtttttgttagctgtctggcatcgccaactgtgcagtagttttcccaaaatgtttcgaattaaattatgaatggtcagaattgtacgctcgaacattctgttcctgaactgatgaaaaaaaaaatagtgcccctgctatataaatactaggacaggtatggccatctacgagatcatattttgttacagatttcttcgccattggagatgatggagtcctcggaggcgagctggcactcgttcgatccgtcagtcgcaatggaggactcggaggcgatggcgcagctgctcggcgtgcagtacttcggcaatgaccaggagcagcagcagccggcggcggcggcgccgccggcgatgtactggccggcgcacgacgcggccgaccagtactacggctcggcgccatactgctacatgcagcagcagcagcattacgggtgctacgacggcggcgcgatggtggccggcggcgacttcttcgtgccggaggagcagctggtggccgacccgagcttcatggtggacctgaacctcgagttcgaggaccagcacggcggcgatgctggcggcgctgggagcagcgccgccgccgccgccgccgccaccaagatgacaccggcgtgcaagaggaaggttgaggatcacaaggatgagagctgcacggacaacgtcgcgaggaagaaggcgcgctccacggcagcaacagtaagtacaaaaaaaatgtacaattaatgaactgattaatctttcgtaataatcggattaagattcctgacgatgtgtgcatcaggtggtgcagaagaagggtaataagaacgcgcagtcaaagaaggcgcagaagggcgcgtgcagccggagcagcaaccagaaggagagcaatggcggcggcgacggcggcaatgtgcagagctcgagcaccaactacctctctgatgacgactcgctgtcgctggagatgacttcgtgcagcaacgtgagctcggcgtccaagaagtcgtcgttgtcatcgccggcgaccgggcacggcggcgcgaaggcgagggccgggcgcggggcggcgaccgatccgcaaagcctctatgccagggtaggtagaactatgcgcgagttgctgcacatttttgttgctcatctgaatctgaatttttttttaactgtcttgcttgaacagaagaggagagaaaggatcaatgaacggctaaagatactgcagaatcttatcccaaatggaaccaaggtaagttacttaaaaaccatctgattccaaaaccgcatcaatcacaatactccacaaaagcctccacgatactgaattgctctgatcatgcgaggacttgttatttttttcaggtggacatcagcacgatgcttgaagaagcagttcactacgtcaagttcttgcagctccaaatcaaggtaaccataagacccctgattcgaatccaagagcccaagttttgcttcaattcgcgcgttggtctctaatcttccataagctaaagcaatgggattcatcgttttgcgcagcttctgagctcggatgatatgtggatgttcgcgccgatcgcgtacaacggggtcaacgtcgggctcgacctcaagatctctccaccgcagcagcaatgatccacgtactccagccatggcgccacggacgctagctcaagctatggttctttgcagctggcgcagaaatacatatttttttttcttctacttctgttgatacagtacatttttccatcctgaatccatttgattcattcccaaaggatggccaaccttaattatatacctcattgatcgagttcttttttaccatttcgctccttgcctcctcgtacagcagatcctgccatggaagaacttatttttgggcaacggaatgtgaaaactactgagaaattggcagaacaccttcgctagtcggtttactattcttaaaagaaaagcaacgagagagatgaaaggaaaaagtgagcgtgaggtctcttatcttgtcatcaagtttcaaaatcatccctaaaccgaaatactagacataacacatatctaatcttgtaaaatcagatcacattaggtcccaaggcaatattactcctcggttttgatgatgtggcggctgagtcttattccatttatcttctctctcttcccatctcaacccaaacctctggggcatccgacaacaggaggggagaagagtagcggccgttgggcggcgacgccaagtagaagcctgacggtgacggccggcaatgggtgggagaaggctggcgaccggcgagaagcttgacggtggcgggtggcgggaagaagggcggaagcgttgaggatgacgcgaccacagcgtggagtaaatggagttgacctcgaagatgatgcagtggagctgtgcgtgcgcctccgcgggggagagacaaagctcgaggacacctaaacaaatcggcttttgagcagctcagtggagatggctctgagtttggggaataagagcttgggcagcatgacgtggcggaagccccagcccctgtgtgtgcaggtgaatacattgcaattgcagttgggtgcgcagtcaggtacatgacacgagcactcccggctattgggagccacactagccggcagtctccgccgtcgagcttgtccccgccggctggcacccttctccccacccgttgtcggctgccctagaggtttgggttgatatgagaagagagtcgagagaggtggaagaaaattgatggctgacatgtggcgctcacgtgggccccacactgattcaaccgccatgtcaccaaaatcatagagtaatactgccttgggaccaaatgtgacatacattgtatcttggtatttcagttcaggaacggttttaaaactcgacgtcaagaaaagggaccttaggtgaactttttccgagatgaaaaatttcttctttccagcctcatgggcctgtgcatatgacccacaggcaggcggtagcagagcgctgcacggccccgccccacaatcgacctcctgcctgtcttgacttttgagcacggtgagccagagctccaacgccgccgccccgctccgcgccgtcgtgcacctgctccgcctcgcctcatcgtgtccgcggccggcgagcagatcggcggcgcggtgagcacggtcccctcttcttcctgaactcgccctagcctgcttcaggcttccaccccgtgcggcctcctcgcgcgcacggccggcctccatcgctgctcgaatcgaactaaggtattattggttcttctctcgtatccctcctccctcctcggcgcccacttcatgagtcagcgtcgcgtagataggagatcgattttttttcccccagtttccctccaattagcccatccccttcatacgccgattcctgttatttagggttcatctcaaccccattgcccccatgttagtcccgccattgcccctgcagattgtattgcaactgtgcctataggatattttggacgcatgatattctcaaaataatactatactactatgatttatgaacagtggtgttaataactcgtgatgtgtccatgcccccacgaaaatttactgggcccgtgtagtatgtaaactgttctctagcacctcaacgagctttgtgttccgttgaaatatagccatgtcaaatagcagcctgccatgtccatttgattacatgttgttttttttttcatcttagctatttcttagttcttttaaatttccaataaagagagaacaaaatgtgtcttgattctagaaaaccagaatgacaagatgacatcggactatatgtgcaatgtttttagatgtcaaatcaaataatcatgtcattcatgtgtcgttcattgctgaattgagccttgcatcctagggtaccagggcagctctcctatgcgtaagaaacaaatacaattgcatatatttgtttcatttttttttgaatgagatcataatgtagcagtacgattccatcctcactgcaccctcaaggcgtgaactcagaattcctcaattaatataaaataacggtcaactttctagcttgcttttaaatgatttttaaaatgtaaagcaatttgcaggaactggtatcaggctgttggtgagaatggaaccaaagcattcagctgaaatgtccaagtaagaatttcttttccgtcccttaattcttgaggattttagttcattacactacttacaagggatctgcaggcatttggacaagcaaaatcaagccctaatggaaacttaccgagcaatgtcccacgagttgcataaagttcaggtgagctttatatggagagtattggagtatgaggcgtcactatgtcttggaagtaactttttagatagtaatactttgaaaatgttggtctgtacaggtggaagaagaaacaatcatgcgcaagttatatgagctgatgtctgcagaaggacttcttccgaaggtatgccgctcaccgacatgctaatactttgaaaatgaaatgttacacttctgatgctattttcccctaaatattctcttggagctgctgacctcatcattattcttccattaagtgatctgttgatatttcaccatgaaccaaatgctgtagttcattatagatgcaagagaaaaaaagaactaattgaaagatgatgggagattaatctgtcttgttattgagtgctgaatctcttgctgttattaactggttgcagttattaatgtctctattgcttaaaattcttgtacctttcttttttggttgatacatgactggcagaatagcagttctttgtaagagtttgtcatgttttactaatgataagcatttactaatattgaggagatatctaaattcatccattagattgctgatattgaggagatggcgacagcggtagataggtttccactgtgtgcctgtgacttcaagaactaaaccacagttttttaaaccagaattaatcatatatatatatttgataaaacagcacctgaggcccttttagctctctgtgctgcatgaactgaatccatgggatcttttattaaattattggcagaattggttctagagcatcgtaagtttacatgtttttgttttatagcaccgaaagttacaggttcactttaatagcaccgaaaagttccctccgttcccactcttagcactcccgtttcttttcttgcatgtgacgtcagttttgaccgaaattgactcattcaagcacctgaaattccaaccctatcctcctttcaactgaaatagccgaacacatcttcagatcaactaaatcaagcagctggaaccccatctctcacccaaagaaacgggagtgctaagagcgggaatggagggaacttttcagtgctattaaagtgaacattaactttcggtgctttaaaattaaaacacatgaactttggatgctctagaaccaattttgccattgttatttgtttatgtggcttatgttctccgcttttctaacttctgcacatagagcttaggctagatcaaattacctcaattgagttctgctttgcctcatattttttttctctctaataatcgatgcagcgcaagaaagaaagtcaagcacagaaaactgggaaatcaactcaggaaaacaaagagcttgaaccgtaggatgtaaactgtgaatattgatacgatactcatcttgatgcaattaacgagttgagctgaagaatcagatggttactatctccacgacatcctatatccccacaccttggaatttccaagtgatggatttacagtagataatgtgttctaactatagatgttaagtgtgctccagaggccagagcaatgcaaaacgaacaattgaacccttgaatcgaattgttatgtgaggagccaacagctggctagaatcagaagtgtatttttcatctgagatttctatattttcatagtattagttttgctgtagtgctagttgttcccgatgttttgctatctgagttataaattacgcggacttgtattcttatgaagtctgactttttgtataaaaaaatgcttaacataccaaagcactgtaatatcgtccttgtactttttcgcttttcttcgagcatttatgggagatatatagcattcgattgttacacatcgcaggctgtgctcagttgacaaacggaaaaaatctgagatagaaagttcttatattatatctgaataccgaatgattagtgaagttattatactgagaatgatgagttagtgttcgagaatgtataatgagttagtgttcgagaatggataatggatgagttagtgttcgagaatggatgagttagtgttcttatacctaataatgaatgagttagggagtgtttgaggagaaggggattgaggagattgggaagatacgcaaaacgaggtgagccattagctcatgattaattgagtattaactattttaaaatttaaaaatggattaatatgattttttaaagcaactttcctatagaaattttttgcaaaaaacacaccgtttagtagtttgaaaagtgtgcgcgcggaaaacgagagccaatctcccctatcacccctaaacgaacgatgccttagtgttcttagccgaatgattagttatagagcattgtttaaattagaaacgtttaacatcctaaacaacaccatcagagtggcgcagcggaagcgtggtgggcccataacccacaggtcccaggatcgaaacctggctctgataattaatttttgacttcttaatcgtctaattttattttatttattcatcttttttgaatcgtctaaatttattttatttattcatcttttttgaattattgcttcttaatcttctacgctagctctatgcaaccacaatctcaccaaatggcgaagtaatattagtgtctttttttgataattaatttttgctgatttatcattcatttatcgaatttgttcttaatgcatacgtacttaacctatctcatgagcacctctaaaaaaattggtccgtatatcttgagctcgatgaaaacatcacagacatataagctcactcttatataatacacacgtgtacatttggttctaatgaatacttttgaagattgagttagtaatatgttaagattgacgaggttaccggtcaccactggtgtctgtatatacctacaaattttgagttcgacgaagtcaccacaagtaatatggtacgttgtccaccactaaaaataattagctataaatacaagcacatcatagactcgctgtcaacatgtatatcgctaccagtgaaaataattactccttccggacatgtctcatgtccagattcatagtcttagatgggtctcatcccatcatagtttgctatattttgaaacggaggtagtagctgtaaatacaagtattcgtgctaaaattagaacttaaacttagattagcaggttccatcataagaaaccttactagtagctaaggtatcctcaattcgccataaatatcaggcaaaaaaggatcctcaaagtttatggtatttgttgtatgacatccaaagaatgtgtatttattacatgacaccactaaaaacatggtaattagctggtggatgctgaacgtattattttattatatcggatctaaatggagagagaaactttcaaaaaagacaactttttacctatggtgcatgtttctttttaacccaaccagatctagttcggatcagacctacaccaagagaaaagttacaattttgcccttgtgtcaatcggcttgtaagataactttgtttgaaccaaaccagacctagtccattctcactccctcgatagaagagtccaacaaagcgaaaagtacaaatttgtaatgcaataaatacacgttttttgggtgttctacgacaaaggctataaaatttgagtgtcttagagcacattttgcctaaataatagtagtactgctcctactaatattcagatatgcactctttcataaaacatggcttagtattttgattttctacccgacagggtgaacagacaaaatacaaactataaaccaaatcatatgaagagcttgagacgaaaaaaaaaacaaaaatgatcgaaatacgccccttccaatttttacaatttttaaaggtggaaattgtcacatggcaatttaaatattgtacattgtcacaagaaaccttgggtctccccaaaattccgggaaacccctccggaatctacaaagcctactcctctccctgtcctgaaacgccgtgacggcttctccttctccctcctccccccgatccagccatgtcgtccgcgccgccgccgcagcaatccaaaccctcctacaaccaccgccgccacaacaacgccgccccgaggcaccaccacggccagcagcagcagcagccgcagccgcagccgcagccgcagcagcgctacgtccccaagcccgccgcacctaaaccctcgcccccgccgacgctcaccaccgccctccgatcatcggcttccccgtctgcatctggcgccggcagggtgggcggagaggccgatgggttcgtggcgtacctgccgcacgacgaggtggtcgcggccgggctcggcgggcccgacgcccaggagtcgcaggccgtcgtcgacctcctcaacgatgccctcgccgcgctcctccgcgctaagccccgcgagttctggcgccagggtaaccgaaacgctcgcttgtgcattactgtgctcatgaaaccgtgtagctggaaggcgtgaattgttattttgggattgggaaatcagagctgaaagcttggaagcgataactagttaaccacttaatgttcggtgtttactgcttgtttgcttcaattgtgtttgttgaatgcatcttctgatgcttcggtctctgtgattatctaaggctacggattatgtgtaaaattctagtgtatgcttgttcaaatgtcagtttgcacttttaagcgcaagataaaatgcgtgcagttaaatttattactacatttgcagttgaagtggctagtagttgcataagcaaagcaaagcctatgcaatcatattcttatcactatcatgacctatgatcctttgaaatagttttaatgggaaggaattaatcctagtcccttcagattgacaggaacttcagattgacaggaataactaccctacaatcagaggaatttggcattttttcttatgcaaactaagcctgaacaataattgagcgagtagatgagtcaacataaaagcttgagttgaggacacgcctagatctgtgattatccattgtttcactcctagaatttaacttatgaataaatccgcgtgcatttgaactttaccaatggtttcctaatgcttatcgttaccttttcccagtggcacagaatacttccctgcatgagttcctggacagttacctacaattcaggcatcggtggtatgacttgcctcatcgtgcacccaaagggacagttgctggcttagttgtcggggagcttgagctttgccgtcgagtctttatggtcctgtaccgcatgtgagatttataccatttcgctatctttcttgtatacatatttttcataagataatgcacactgttcagattcacatgagatttgtcatgatatggctcttgtttgggtggtagatcttcaaacaaggatcctggagcattcaggggtgaatcccttagcatgaaggagcatgcaggtgagattagaactactcatatgatcactgtttgagtttacctttttttagagcagaatggatagtgaccattggttcaaatatactatattcacgttgttcggttgtagccctcctgcaggagaaaagattgcttgatttacccaagttgttggacatttgtgctatttatgggcatgacaattgcaaattgacaagttcactggttggttcctgaagtgtttattattgttgttgtttttctccttttcattttgcagacagatgctaacttaaatgcaaattctaattcattcccttagtctcagataacctttttctattcattggcatgaatacttttataattttattaataacaagtgcacattttctgtatctgtaggttgaaaacgctatcaatgtccagccaaatattctggatggcattaatattgtccttccccaattcctgggcattttccacacaatgcaggagaggtgcatgaaatcattacaggttattttgtgatcttcttcataaatcactgcacatagctgttataggattctgtattcctttatctggtatgaacatccatatgatatcattataacagctgttttcactttagtctgtagtcccaatcgcatatgctaaaacttttatcgttttctgcaaaggattcaggttattcatttgtgctattgacgaatatacttgttattacttgttatatctgttattgtttcaaatactttcttcccagttcctttcaacaaccatgatacattgcttggtaggttagatagaaagtgacgattatgatgtttactattaatttgtctctgtttcttttttatcctaaattgagattgaagtatgttttctcaccacgattaaaagttgaggacctatgatattgatataaacttgatcttgtagtttcacaccttcctgatctgatgacagtttagtagtttacagaagatcttggagaactatgcataaaaagaacttaaccataataaattcattttaggcgctcacttcatctggaccgaatgatagtggatatacccaacttcagaaagatttctcagaggcaagttttacctatactgcatagtttatgatatgtctgctgtcctttcatctgatttttctatattgttgtaaatccaacttccttcaggtgttggattttgtaaacgatgcaattgtcactctggatgcctttgtcgatgcttatcaacctgctgctttattattttgtacctcttttgagacgaggtgcgcttctactcatccaacacaatatttgttcgctgttcccttaataggcaatgatgcttatctaccacttaatttgcagctatggagttgaggaactactgaacactcttccaagattgtatgactcattgttgccatctttgcttcatgggtttcaagttatgtccagttcccaaagcaatggagagactgcatctgacattatactgagtgacatagttcttggtataaggatgctgtcaaggagaactgtcagtttcggatggagattattggagttctgctatttgaacaatcaacttgtggagcgtgatgttgaagcttgtacaaagatgtttccagctaaagtcgaagatcctatgatcaggggtgacatcataattcaaacactcaaggatatcaatagagaagccacattttcacaagatcatcctggaaagacattcctccaagctcttgaaaaggagttcaagttgatgaaccggattggagatattcgaaagaaaggtaaatgataaaaaatctcaattaaatgcttggttattttcatgtttgtaaaattccacacaaccttagtatcccactattattatttcagccaaaattgtctctttagtttttcatccataaacaacatatacgatctaggaactttattcagaagttgtcatacaattattctacatatatgtactgaattgcctatgattctatattctgttactatgcctgctctcgccatctatgcatgagtggttcttagaaagcttaaaacttccagcttgatccagcatattgatctcaatgaatggaaagagaaagagccaaaacagaatcttatctatatttatatctatactacttaaaatgtatacgtggtggtgtctgttctgccacaccatccttaccactgacatttgg

SEQ ID NO: 60409 - DNA, 12477 bp, Oryza sativa
cccgtattaccctacatttgattttatttctgctcgcgtttgatcattctggcacttttgagttgtgttcataagacatcactttttctgttttggctagattctgttgtgaagactgaaagagtttgctaaactgtcagcattattctgttgacatatatgctgtattttcttgttatctcaagtttattgattgtgtcatagttttatattgatgccaaaacctttggttgatgtattcaatatgttcctccaatcgtaaacaggatggatacacatggatgatgagcagttccagttcattgcacgcttgtgtggatctactctgacatcttggaatagtgtgcctgatttgcctgtctcttcctatggtggtgaactacaacataagaatgaggatactgccatcactgagtccaagattactcaaataagggacctctttcctgattatgggaagggtttcctcgctgcatgcctggaagcctacaaccagaacccagaggaagttatccaaaggattttagatggaaccctccatcaagatcttctagctctggatacttcattagaagagatgccgcagctaaagcctgcagccactgttgggaaagataagggcaaaggaatacttgtggagactgagcctcaaattatgaacaaaccccataaggttaatactgagatgcatcgctatgttgaacattcttcatcttcttcagttccatcagcatcccagggaccatcctcatctgtaccatcagtcccgcaaggtagatttacaaggaagaccaatgacgacgtgcctgactctgcaactctagactcacagaaagcaaaagatgctgttagatcagctgtgcttgaatcccagtatgaatatgatgatgagtatgatgactcgttcgatgatcttggcttcagtgtggtagaatcaagttatgaggaaactgatggtgccaatgatgccgagagttcctcacagggcccacggtggagctcacaaaagaagacacagttttatgttaaggacgggaagaactacagctacaaggttgctggttcagttgctgtatctagtgcccgagaagcggctgtcctgcgcaatgttcagaaagataccattcatggtcttggccgtggtggaaatgtacctcttggagttcccaacaggcaacaacacagagacatggaggaagaggagggtagcaatgcaaacaacttcggcagaggaggctccaacataggcagaggaggctcatatccccgtggcgatcatggcagaagaggtggaagggatcacggcgacccaccgccggagggcgagaacccaaacgggccaccaggatttggccgtggtggaagaagagggggcagaaatcacggcaaccagccagaggcaaacgagaacccgaatggccaacgtggatttggccgtggcgcaacaagaggaggcaggaaccatgaccatccagcggaggaccatgaagatccagatgcagcacagggcttcgctcgaggagggcctgcacctcgtggaggcagaggtggaaggagaggtggtggccgggataaccatcaccggagagaccgtgcgatgaagaagcatatgcaaggattgacagggctttagttgatggttttcaccatcgtttttcattgcgggaactgtaaatgtgacagtatttttttttgacgtggtctagactcggccaaagcatacgatgccttgaagcatccttatgattactactcgtatattttacccatagcatgtggaatcaaactattgatgatcatatttcttgtagcttcggacagaatacaaagtttgaatctcataaatgaaagttaaatctgtgttgctctagtttcttgtggtgaagaatagttataaatcattaatcatttgcgtcagctaagaggcccggtgctaaaggtactcgaagccatgtgactaatgctgtgctaatgatccagatgggccagcctatatagctacgcggtaccccagacgccgcagaagcagtgcgacgttctgccggaaaaaccctccgctaaggtcgccgcgcaccgtgtgcccgcatccgccatatagacggacagtgcatcggttttctgggtgtacggtgtaccccacgtgttaggtgacgtgacgtatcggttttcaatagcggccgcgcgcggccagggcaatcgaatcgggtatcggccggcatcggtcaccggagggatctcagccaaagaagtacgcacattgtcgtcggtaccagctgcagctagcccaaatcctaaacctcatttcaacgtcgtcgtcggcgtcgccacctccagcggccacttcaacaccgatggagcagctgtgagccggtgaatagcgacctttcaggttcaaacgtgaaagggagaaaaattagtggctgtgatgagccggcgccattgtgtctgaatatatctgatgacacaggagagttacgttctaacaaatcgtccactgtttttcatctcttagaacaccatcatcactcagggctctgaaaataagtccaaagtaatggtggcatgatgcatgcatcggcttggaaatcctgttgccatgaatcatggctgatcacatgtttgcagcacatacaagtatagtgccaacagcaatcagcgtatcaaaatctctccacactcttcactttaccactagcaataattcaatatcgttgcaaactagctagtactaatataatcacgtgacggatttttctggtatgcataaatcaatttaaattcaaccgcaacgatcacgcaaaatatcacagggaacaaactaatgggccgggacctgttcaaaggccggaccacaggccggcccaatagcaagagtatatatatagtaagacctcgtctcctcgaagtgctggcccgtgtgagaacagagagcagtagtgtactggtgtcccgacagcgccgcctccattcctctaaagtctaaacctaaaatctccgcggcgcccgctgccgctgccgtcgtccacctccggagtcgcgatggggcggtgggcgagcccaaagacccggtaagaaggcctcgcgcgcgcgctctagatctcatctggtttcgcaggcttctaacccttgtttcgtttcgattcgtttcagtggcgtcggagggaagccgtaccggaatgacagctcgcaaaaggacgcgacgcggatcaaggccgggatcccaagcgacgatgagggcgacgtggatcgcgaggacgtccccttctcagagaaggaagaggccgccatgaacaggatccacgcgagagccatggccaagaaggctgccgcctccgccgcgatcgcccccgcccccgccgtcgtccccgccgcgatcgcccccgtccccgccgacgtccccgccgcgatcgcccccgtccccaccgacgcccccgacgcgatcgcccccggcccgtgaccccgtcgacggcctcgcccgcgactccatgaccaccgccatcgccactgcgtgaatccccatctccactgatgcgatcagctattgtctaattttgcttagggatgctagtcttatgttgcttaggagctaccgttgcttaggaactaccgtactaactatcccaggttatcgatccatggatgctgcgaagtacaatttgcgatgaatttcctatctatgacagatatctggttgtgatgatgttgccaagtgatatacctgattgtgatgctgatgttgccaagtatctgatatatctgttttgtgatgcatttcctgtctatatcagatttctgattgtgatatagtatctggtttcatgcatttccaatatatgtcagatttctgattgtgatatagtatctggtttcgcgatgcatttccaatctatatcagattgatttctgatcgttaggttgccaagtacctatctgattgttatgttgatgttgcgatttgcgaagttgcatatctggttgtgatgttgtaaagtatttgcatagtatctgcttgtgatttggcaaaaccaggatggtatatacagattctgaacgatgctcacaattatataatttattgaaagggatctgcaacttggtatcattgtacatcagggagatcggctaatgaactactactacgtgagaagttcatcggctaatgaactactatcacgaccagttcagcactgaagaacagtagaacatgctcagtggtctatgccaatgataactttaccaatcaagctaggtatctgactagcccattacgcataacgaaaaaaaaaatcatcatttttacaggaacacaatagcatagaaatacattctttgttagcagaaaattatttcaacagggcgattcatcccggctttgagttgcttcacaattgtgatcttttcatcattattctgtggaaacatggatattgaaggataaattgggttgtccattgcttcacagtcttcacagggatctgtcttctaaaataactgactttaagtttggagcacgctcaatgatagctcttatgaaatccaagtgttctcttattatttggttgaatccaccaaattctaacctctctagttgcaaataatgtatcgagccatccaactgtgcagcatcccacaaatcatttctttcatacaattgttttctattctcagtaccctcgtcacatgcatggttccacacctacattcagatataagaaaacatttgacatcatgcgtactaatcatcagaaagacttgaatgagaacatagctgaaaccaaatcatgataaaaaaacaagaaaaaatgacagcataaccttgacaccaaaaaccttaacggatggtgcggattcaaggagaaccaatgtccataggagatcaaatttcacatagatcccatgcagaaataactttgttatcttgttcaaggcggagcgtagcttttttccttcaggtgtaatccaaatctaggtaaaattaacaaaataaacaaggaattatttctatgcacaaaaagctcttaatcaggccaacacttgtgtactcaataaccctggtgccaatagtaaccctggtgtactctaaaagataatctgagtatttgagatttggtcggggaaaaaaaggatcaaacagtacctgccattaagatcaaatcacacacaaaaaaaaaaaagcttttaaaatgctctttcagtttcagtgcaaatttcatagcaacatgtagccaacagccaccaccatatgacattaataaagatgactttccatgtaattaaattagtaaattacttaccacctctccttggaaatccaaagcaatatcctgtacatttgcagtaccatgaagaagatcagtcaatttgaaccccgactggatacgtgacgtcgcaaacaaggcgtagttcctcaaggcaaggaactacaccaaaagataggggagcccctgataagcgccatgagtcacagtatagctgctctagtttaggtaggcagagaaactctacggtcttgacatagcacgagttgagttcaacgaagcggagttttgaattcggcatatccagcttcaatgttgatgaatcccgaagttcacaataatagagagttagatgctgcagctgatcacagctgattattagttgatgcagatcttgttcagaaaaccttgccgtacacaggaggagtttcgtgaggcaacatgacagactacgagatatattaaaaaattccactaagctctttgcatgcagcagcatatcactagacgtgcaatctacactccgcttctcagttgtgatcgcaagctccacgctctttactttaccactgtcaatagcattgcaaactagctcaccgatgttaaacaaataatctaatgatgtctccaaatcagtgagcaagcagaacctgaggtttagctttttaatgatagattcgctccgaggagaaccaaataaactgctcatcaatttaactagaacagccatcgcttcatcggccgacattgaggaattttggtggatgaattcatctgcatctaagtcgacatcagagagcaaaagaggcaggtgcttccaccgtgtcgacaggacactggtccttagaactgtgcgcatatcaactctttctaggatagagagtaagatatgatccggcaattggttgaatctaccttggtcctacaccaataaagtgctcaatcatttaaactgaagtttaaaatgttctcttaattttacaagaaatactaaacatataaaggatggtattaggtttatttacactggaaaaactactaacaaaaattactaacagagagagggaaagagacttacatagctttggatgctattggactgcatgactactgacaatggggcttttccactcggatggtatgcaaatatgagatcagtgttattgtcgagcttatttataaagggaatttcaccagcctcagagcctgattcgaattagggcacttacttgtatatgctcgaattggattcatactgaaattgaaaaaccgacttggtaattaacttatgtcgaatcggtttatccttggaaaaacaaggaaatttaccctcagaaaccaagaaaacaagggatattccattgatttctatcacttcgatcacagaagaagatcaatgcttcttttctcctgtattttcttgagaacccgcagagagcatcgatgcatattctgaaaagtgaaaaccagcagcaaaagatgaatttaaaacacgcccaggaaaggacgataaaaatacgaactacctgtccgcaaagccactagatcatcgatcctacgaacgaggaaacaggagagagaggacggcgacggcggcggcggcggctagggcaaccggcatcgaacaccggacaccggagttgctgctgaaataggttgcagtcgcacccatccggggatagttttgggccgtggcctaaacggagttaaagcccgtgcgaatattacggttggaaaaagtacaccaaaggtccctcaacttgtcatcgggataaaaaacgtcctcaaactgtaaaacagatatacggggtcccttaactatacaaaaccggtaacccgaggtcctttggtggttttgaccccggttttagtctacgtgacggctgagtcagcggaggacccacaaatcagttctccacgtcaccctctctctttccctttcttttttttttctcttctttttcctctcctctttgcggggctgagcggcggccggcttgcgagcgcgtggcggccggcgaggcggcttgcgagcggaggcgcggaggaggaggcgggaaaggaggagggctctgcgccggcgtcctgctcggcgtcaccatcatcgtctacctccaggagaaggtcggctggggcgctgccgccgtcgtggccgtctccctcgccgtcttcctcgccggctggcgccactaccggtacagggtccccgagggcagcccactcacgccgctcgtccgcgtcacctcgcacggcggccgcgccgccggctggttcggcaaggacctgaacaacagcaggctggacctcttctactggcttctcgcatgcatcggcatcgccaacctcgtcttctacgtggtcgtcgccaccagatactcgtacaagaccgtcatggccggcggcaaggtcgtcgacgacaaggccggcgacattgagtgcgccgccgccgcagctgctgcctactgatcaatcaagcagctgatcgattagctagctagctagaaaatcatggtaagaaagaaaatggcatcatcatgtaggagtatatatggtatgcttcgtggtacgtgacaaccaaaaaaactgtaatgattaagtcgttcgtccatgtatatgcttaatctgcttgtgattgccatctgatcgtgtgctctactgctagctgatgttgccaagtcctaaactgttaacttatgcgtgtcagcgtgtgcttagtgcaagaggcggcttgcaagcagaggcgcggaggagggcggcgcctgcatcacactggtagcggccatccacgtgcgtgacccgtcgcggcgctacgaggcgttgggcgcgccgatggtcgccgtcgtgcagtcggcgaggctgctcggcgcagggggaacagcgacgggaggttcaaggtaaggagcgcagaccgccggaggaggcctcgggcttgaaggcgaagagcgcatggaggccgtgcttcgcttggatggctccgacctggaggcggtcgtggcgagggcccaccagggccgaccgaaagacggccaccgggctagcgccttgccggtagagctcgactccggcgaagccgaggataaggccgggccggcttagactggagcgtcggcctccatggaacggccgccgccacgtagaagaggaggaggaggacgccggccaccgcgccgcggcgtgatctggcggggacgagagggacgacgacgccaacgaagaggagaggagacgagggggaagacaacggcgccgcccgcacgccgcctccccactgccgccgccgctggcggccgctgtcgcggcgccgccctcctcctttcccgcctcctcctccgcgcctccgctcgcaagccgccgctcagccccgcaaagaggagaggaaaaagaagagaaaaaaaagaaaggggaaagagagagggtgacgtggacacctgatatatgggtcccacgtgggtctcttgctgactcagccgtcacatagaacaaaaccggggtcaaaaccaccgaagaatttcgggtgaccggttttgtatagttaagggaccccgcatatctggttttgcatttcgaggacgttttttatctcgatgacaagttgagggatcttcggtgtacttttttctattacggtttaattgtagtataatgggctgggccggatagtttgctagtttactgaagtatttcttacgtcttatacgtttgatgtgcgacagtgcgagttaggggtgggaaaaaaagctcggacttgtgagcttggttgacttggctcggctcgtaagccaaacgagccaagtctaagtctccttttcagctcgttggtgaaacgagccgagcccgagctggctcgcgagccgtttgatttggctcgcgagcttaggccatcatgtgtttatatcgattatttatttttttatggagttattatttgccaacttgaaatttttctttaagattttgaagaattgaatatataaacttatttaaattttacaagttgatgatttgttcttgtttttttaatagttacaaaatatatatgaagaggtgtttcaacaggaagacttgcatgccagctcgagctggctcgagccaggaaacaagccaagccgagctcaagttttagcttgtttccctaaccgagccgagccaagccaagccaagcctagttttgttgcgaaccactgcaagccgagccgtcgtttccacccctagtgcgagtattactgaaagtatatacttcaaatataaatatacgtaaggacagtattgggtttatttactcgggcaacaaacaaacaaacacccataatattttaaagaatattgattgccgacaggtagttttgtggagcatcaatatctaatcacattttaatcacggatgttttgtggaactgctgaaacctccgatcatttatttttcagttctcaattatctacatactaatgggatttgaatacttgagtggaccatttacaattcacttctcccttatctacgtactccagctgttacaattctggaggggcaagtagtagtgttcggagacttggagtagctgctctgcaatggtgcttgcgcactacacccatctctgtgatagtgcaagtgttagtgtgacctttaaggatagtcgattttgttcaaaaaccaggatggttataagtaatttttctcagggatacgtaaatctgttaaagcttaggaatacggatgcggataactcgatcctttattactccctccgttacattttaagtgcagccacggttttccgcatccaactttgaccgtgtgttttatttgaaaattttttaaaaaaatttaaaaacataagtcacaagtaaatattattcatattttatcatcccataacaacaaaaatacttaaataagacggacgattaaagttggacatggaaacttatgattgcacttatgggacggagggagtacaacgggaggagaaagatggttactcgccggagtcgatcctcggggaagcagatgtcgccggcgaactcgtggttgggctgcttttctatcgcctcatgggcccaaaatttgggcctagtgtggcccatacgaacatttccagcccagggtttatgggccggcccaatacgatggctatatatactacctcgagttgctggtccgagcagggagacacggagagcagtgagcagtgtccaagtcccgaccgcgccgcctccattcttccgccgccgccgccgccggagtcgcgatggagtggtcccggagcgccgagagtcggtaagaaggcttcgcgcgcgcgcgcgcgagcgctctagatctcatctggtttcgcgggctgctaacccttgttgcgtttcgatcgtttcagtggcgtccagggaaaaccgcatcgcaagatcatccgcgatgacaagaagaagcgcatccaggccgggatcgcgagcgacgacgagggcgatgatgaggtcgtcgtgttctccgagaaggaggaggctgcgatggctaagatcttcgacaaggtcaaggcgaagatgcccgccgacacgccagccgccgacgacgccccgccgccgcccgcccctgcgacgatcggcgccgccctcgccccatcgaccgcccccgcccccgccgcgtcgacgacctcgcccgcgactccatgaccgtgtccgcgccgatgacccccaccgccactacgtcaacggccaactccactgatcactgatgcctatagtcaatgtttgcttagggatgctattatgctatctatcgtctagtgttgcttaattagaaggtaccgaggcttagatcgtactactaactgtctcaggctaccaatggatgaatgttgcgaagtatttgcgatgaaccttcgtgatgcatttcctatctactggatatatgattgtgcttgtgatttgggaaaagtttgatctttggtctctgattatgcttgtgatctggcaaaagtttgatctttggactctgattgtgcttctgatttggcaaaagttttgatcttttgtctggatatctgattgtgcttgttatttggcaaaatcaggatgacatggatagattgaacaatgctcacaattatataattgattgtcttcattgattagctgattgaagtcattgaacgtggtctgcagctggtctccatttcagctaaaatgtaggtcgtgtcgtagaaacaaatggagagtggaaaccataccatttgttttagcttttagctgatcaatggaggctgccatattgtccagagctattcagacatgcaatgggaagaattgggaaaaagttaggtgcgtttcagagctgttcagacatacaatgggatgcattggttctattagtgcattggttctatttggcatactttgtccttactctttatcatagtatttctactatcttttagctgtcatattttttgtttttcttcaactttgttgcggttgttttttgtatgctggaaaatataaacaaaatagccttctaaagtccaattcatatatcattttactgattttttttgagagatgaaataacatagggggagcaccttcaaaagtgtgacctttggtatctatatcactgcattttatatagcctaccatgcatatgttggactcccttggattttttttttaatttttacacattagctttgtgattacatacagttatatgtcaatacatgtcaggttgtaacaggagtaatatttcacaatattatacttgatatataatacatttttaccatattgttctcaagcccaccttgcgctacaattgtttagtacttcagtgcagtaggatatcttaagccacgcaagcatttttttcccctctttgatgctatcacaactcatgtacagtaaagcattgtgctgtttcattagcttacactctagtcatgcttctctggcattctttttcctaccctgttgatgaggttcctgtatattgttaaaaatccaagctttgacagaggaccttctaattttccagcttgcgaatagaaccgatgtacaatgcttgcacaggtggcaattaaaaggttctacaccctgaattggtcaaagggccatggtccaaagaagtaagcatgctagtccatttattttcatttcttatataatattggttagtcatcttatactcacaatgacatgttccccttttcaggaagatgagatcattgttcagatg

SEQ ID NO: 60410 - DNA, 13468 bp, Oryza sativa
caagcttggcctggacgtataggaaagcaatgtcgggaacagtaatgccatgaaaattacttatttgtatttaattttagtccatctagcttgcaccgaaaagaaaatgatataacaagaatttttaaggggctcaatagagtagcttctttgtgctagcaactactacttacttctagtcctttttttctgcagatgaatgcaagagttgaacgccgttctgcaacaaaagtagctactacttatgatgatctgtcaggcaatttagtaattacttccagtttctgatgatatttagcttgtttgtagtaccataattcattgaggataaaaggtagcaacacctttataatttatgagatggatcagttggaagcaggtgtaagtccagtaaatttagcattacatcctaaactaaaccaagttaatgccctgagtgtctgagtgtagcaagtgccttttaaccatgttggcatctatgaaatatgggggatgggcagactggggcaaaatggcaaataagttttgccgatgatcttgttcttatctataatgttgtttgttgcagcaacctgcaagtattcttattgagcacatcggtgatgatctcgtttccccagattatggctaaattgccatgaatcagaagctgaacacatatatggaatctttgtcatcagtgtgtaaggaaggaatgtgtgctaaatcaaagcccgcagaactcatcatggaaaaatcttcacactgcataaatgtgcattatgaatatgtgagcatgtaagacttcacactatcacatattcttttgttgttttgcatcagattcttttgtttggtaatcttcacatttctcagattacgtgaaaattaaatcacattaattttatggaaactgatctctagtgagtgatgagttcctccttttcttgatattagcaagcatcaatgcattgaattcgtactcctgcatgcttctgaagagttgtgaagtctgctaaaccaaaacttaaactgggacttgcaggttcagtggtggcatacttcactttactgatatctacttagatacctaatccaatacaaaacttacgaagttaatgcccattcttatctatgatatcaaaatattccttcaagagcttccatctttagtcagaaactagaaaacactttcttatcagatgaattatcataagccttttaaacactattttactggaattagcacctgaaatgttgaatagaatcctagtgatgaagaatacattagggaattaaacccacttgtttccaactagtgaagcctgaagagattgttatttgatccttgttccttcggttaatttgtcattctgaaattctgaaccgtggctcttgttagattggctgataccccaggtatcagcacaggctagaatctcctttagcatggaagccccttggttcgtcgatatgcaatttcaggtacatttagctctttttcaattatttttcatgttcatgtatttggtggaatatattttgtgcccgagatttttttattattaatccctcatgctgtcacacatttgggaccttgctgaatgttattttatttggttaggttctcgtgcccatatgttcctcccaggttcatactttgtcagcccagctgatagaacttaagatgctctaggattggtccagactactgctgctttggcagaggcccgtgaggtgctgcaggcagtggccaatgtgacaacataagctctgatgaagaaaacatggagaatccagatgccaagaatgacccagcaaccaaattgcaaacaaaaatcatttgtacgcggtagtaaactgccctcgcgttaatattcttagctatgtagctcttgcgacttgcgagtcttggtttgtgagtgccaaaacgcagcagtttgagttcgagaagaaagaggagagaagaggggggggggggggggggattgcggtcgtctctctgtaactgagcatacattaacatcatcagtaatgtgtcattgtttgactgtattatcactattgatcataattcttgtgaaatgcaaagtacgaagtagataagtacttttattgagtgtactagctagatttcagtttgctatggtggcaagcttagttgtgatacaaatttgcggacgttacccctcagaagtttggaactttggattgtgcatagcttgaaagcatggcatattgacatgaaaccaggggcggatccaacgtggtcccccctgcacccataaaatctatggatacccccggaacactcccccctcgattttttcaccgtgaatgataaagtaaaggttcttaaatggctagagattgaagatactatgtaactgagcccctccaatttttttgttcctggatccgccctgcatgaaactatgaccgcatgaatcttgtagtgacaaaggtagtcttagctgaaattttgccacaatgatccttataaaaagttatttttaataatgaaccgtgccattcagtgcctatatttgtagcgctaaaacgttatagttaagcaccatcaagacaacgattcatttcttcaattagtttttggcacgattcatttttttaaaatacaattcttttaaaagggttagtttgtcaaaattttgggtaatcatagtcctggaaaatattgtgccatggcttaaacaaggtgcctcgacgtcgattttgggaatataatgcatggacatatctgtgcagagtctcaagacacgagttttttggcatatgtagtatcacaaaaaatctgtacagaacctcaagataagctctctctcaagccaaatttaaactgtaaacgaagtgcaagtttataaggtaaatcaaggcaacatgtgccctgtttgattcagattatcaagcagattattgcggtggatgcaggtagaccagctaatgggctatgagagaaacaagagtcatgtttgattcagatcatcgatcagattattgctgtggattcaggaagaccggctaatgggctaccggggaaataagttcagacacaagtcaaaatttataattattatggcctgtgaccaatcatcaatgtagtagacaagcacatgaaacatcatagaaataaaaaccatcattttaaagggtgcgaggatatgttttacaagtactccgtaggggactcctagcacgcagcccgtcacactcctagaacccacacaatcgcctatgcccatgttcattgtgcacaccaagcccaccatgaaactctatatatatctaatatagaactagattagaacttctagtgataaatactctacataaaaaacactgttatatggaattaaaaagtttacactgtaatactatgcatgaataaaaaaattccacccagaatcattatgcaaaactaaaaaaatcaacttaaaaatttatacacaaacttttcatatagaaactttatacacaaactttccatataaaaactttatacacataaaatttttgcatagaaactttatacacataaacatttggtatacaaaaatgaaaaactataagttgaaaaaatgaaaaactatttttgttgcacccaaaatcggtccagcccagagtggccgcgcttgctcacgcagtcatgcatgtcgttcaagtgcatcatgggaaagtataaagcattttcgtactccgtaccctataacaaataatccatgttttattagcaaaagattatttcaacagggcgagaggtcccagctttgagttgcttcgccactgtgcttttctcatcttcattttgtggaaacatggatattgttgaaggataaattgggttgtccattgcttcacagcctttacagggttctctatcttccaaaaaaactgactttaatttgggagcacgctcaatgacagttcttaccaaatccaagtgttcttttattgttggattgaacccaccaaaatttaacttccctagctgattataatgtaccgagctatccaactgtgcaacatcccacaaatcatttcttctttcagaaaatatttctctgtccacagtatcctggtcacatgaatggttccacacctaaattcaagacatgagaagaattaaatatttgacgtcatgcatacttatcatcaaaaagactttaatgagaacatagctgaaatcaaatcatgataaataaacaatgaaaaaagatataaggtaccttgacaccaaaaatcttaacagatggtgcagattcaagtagaaccaatgtccataggagattaaatttcacatagattttttttttctcatgaatgaatgtcccgtgagggaactctctcctggcccccgcgtcgccccccgcgtcgggcgactcgggcggcggaaccctagccgccgccgccgccgcccttccccgccccttcctctgccttgccgtcgcctgagcgagcggccggcaaagccggcggctcgcgaggacggcggcggctgggctcgcggcggccatctcccgagctcctggcgcgggtggacgcaaaggcggtggccgaccggagcggcgccggcgtcgaggcgcatggcggcggatccggcgtcgccaccaccggatctggcgcgctcgcagctggatccggtcacggaggcgcgggcacggcgtcggcgaggcgtgggcgctggcggccgcgacaggcggtggcatacgcgacggtggcgcaggcacgggcggccgggcggcggcgtcaggcgtgacggcggagcaagcacgggcagcagcggcaggctcggaggcgcagctgctgtgcccggtgggctcggaaagcctgcggcgacggcagcggggccccagatcggtgcctctcggctggatctggaggatgggagcagtcggcgacggcgacgacggtgtggcgacggcagcggcggtagttggccgatggcagttggcgacggcggtggcggctgtggtggctgccgtgtcatctggcaacggcggcggaagacatggcgtcgggctgctagctgttcggtggtggagggcgacggcggagcagcgatttgcagaggcggcggttggcgtcggtggcagcggcgacggcggtatgactctggaggcagtggcgacgtcggcggcggggaaggagtcgggggcgaggtggctgggtgttcggcaaccaaggctgtggtggtggtgaccgtgtttgcggtcaccggaggcatggcggcctcggttgactaaccgagggcatgggagacggctgtagctggccggcgcggcatcgttcggtgaaggggtcggagaccggcttggcgcagagaagtgcagccgatggcagcggaggccggctcggcgcgagaggcgcgggcggcggagatggaggccggctgggcgcgagaggcgcggccgatggagggaggccggattggcacgagaggcgcgtccgttggaggaggccggcttggcgcagagaggcgcggccggcggtggaggaggcgacctaggtatgaggaggagctgccggtgggtgcggcgcggtcttcggcgcacgaagcctggccagcgggggacgccggtgcaggggtcccacatatcagcaaagcttgtgcggtggtggagcatcggtgcgccagccgtgcctttgttggtctactagcggtcggccacgcttagcggcggccgatccggtactagccttctcctgggcgtgtgtgttggcgatgtcgtcatgtgggtggtggtatttttttcttttcctgcttacgactctccagggttgtaatcttatacttttttttcctgctctatcaatagaacttcgcaccgtctcgtgtgagtcgttcaaaaaatttcacatagatgccatgcagaagcaactttgttatcttgttcaaggcggtgcgtagttcttttccttgaaatttaatccaaatctatgcaaaattaacaaaataaacaaggaattaattgtaagcacaaaaatctcttaatcagtccaatcattatgtactcaataaccctagtcgcgatagtaataacacaaatatactctaaaagataatctgagagcatgtattacatatttgaaatttgatcaagagaaagaagttaaacagtagttgccatcaacatctaatcacataaaaggtgcttttaaaatgctctttcagtttcagtctaaattgcatataaacatgtggctatcagccaccaccacatgacagtaaatacgatgattttgcatgtaataaaataacttgcctcctctccttggaaatccaaagtaagatcctttacatttgaagcaccgcacataagatcagtcaatttgaaccctgattgattactatacgcagcacaaacaagctttaacccctcaagacatggaatcacaccaaaagataaaggggcaactgaaaagaaccaagattcacataatagatgctctagtttagggaggcagagaaactctacagtcttgatactgcacgaatagagttcaacgaggcggagttttgaatttggcatatccaacttcagctttgacgaatcccgaagtttacaaagatgcagaattagttgctgcaactggtcacagctgattagtagttgacacagatctgcttcaaaaaacattgtcgtagatagaaagagttttgtgaggcaacatgacagactacgagatatattaaagaaatccactaagctctttgcatgcagtcgcttatgaaaacctatgaaatttatcctcggaaaccaagaaaagaagggagattccattgacttctatcgctttgaatcacagaagaagatcgttgcttcttctctcttgtgttttcttgcagaactcgcagagagcatcgatgcatatattctaaaaaatgaaaaccagcagcaaaagatgaatttaaaacacgcccaggaaaggacaaaaaaaaaacgaactaatacctgtccgctaagccgctagagcatcgatccggcgaacgtagagccaggatggagagggaaattacagcgggcgacggcggcggcggctagggcaaccggcatcgatcgccggagttgctgctgaaatgggtggtagtcgcacccaccaggggatatgtttgggccgtggcccaaacagcgttaaagcccgtgcgagtattacggtttggaataagttaactttcgatccctcaacttgtccccgagttcgaaatccatccctggaattgcggtctaatgggctgggccggatagtttgctagtggctgtcgccctcgctaaattactcctcgatcaaggcctaacacaatggtccataaacactgtaaacttgggtaataagtcaggttattagtgacaaaaaacgagacaaaaatatcgcaaagttaacactactgggcttacaatactccttatatctgattgtgatgttgatgatgcaaactactccctccgtattttaatgtatgacgccgttgactttttaacaaacatttaacatttcgtcttatttaaaaaatttatgtaattatcatttattttattgtgatttgatttatcatgaaatattctttaagcatgacataagcatttttgtatttgcataaaaattttaaataagacgaatggtcaaacgttagttaaaaagtcaacggtgtcatacattaaaatacggagggagtatctgatatcacctggctgtgatgttgcaaagtatttgcaataaattcaggacgcgttgtgcttgtgatttggcaaaaccaggatgatgatctaacgagttctgctaaaacgtaggtggtatatcatggtgcatcagggagatcggctaatgttcagaaagtcagatttcagaattacgacaaatcagcagtgaagaacatgttgggtgacgtctatgccaatgataactgtacccaatcaaggtaccagactagcccattacacatcgaatgaaaaataaaaatcatcatttttacagggtgcgagaatctgttttacagtgtacccaatagcaaagaatccattctttgttagcggaaaattatttcaacagggcgattgatcccagctttgcgttgcttcaccattgtgcttttctcatcattattcccgagacatagattttcacatcattgtgcttcaaatacaagtttatagacaaatatagtaatatttataatattaaattagttttattaaattaatatttttttaattacatggtacaacgcagatactcacaacacacacgcaaaccatacccctatgagcatcttgccatcttcgaagactgggctggcaaatctatcctggagattaatgaagtcaccacagacgcctcgctgtagacaggtacgtcacttaccactgaaagcacaaagctattaaatcctggaaaattcgctcccattttcttaataaatttgtcttgggttgaaaatgctattatttttgtacaaacttagtcaaacttgaagcagtttgattttaaccaaagtcaaaacgtcttataacctgaaacggaggtagtaaaagataaattggattgtccattgcttcacaatccttatagggatctctgtcttctaaaataacttacactcgtcctccgcctccacttcttccccttcgcgtcatagtccggcaaccaatccacgatgcggttcagcgtctccgccatgggcacgtacgtcctcctcgccgctgtgcgtggcatgggctttgccatctccttagttcggccgccaccgagcacgccataggaggagactaggaggccttccaatccgccgtggaagccgctcctctccctgttggtcgcggtcctttccactccgccgcgggaagagcgagcgacgtcgatgctcggtttgcatgcggcgtgcctccgccgactgttgagcctccttcgccgccgtcgttaggcacgccgcacaccggccgccatctcctcaccccgcacgccgccgccacatctgtcgccgccgagactcgagacccgaaggatggggagagaaataagaagaatactatattgtttcactgacatacaaatctcacatgggtttttatttttcttatagcgccacgtcatccaaagtcaccttaatattgtcttgggacccaatataacctgattttataagattatggatgtgttatatctggtattctggttcagggacgattttaaaactcgataacaagataagaatcctcaagtgaacttattcctattatgtttagctgcggtgttatgggttgggtcggatagtttgttagtggctatagcccttactaaattactcctcacggcctaacacatagatcaaattaaatattgtaaagttaaaatataacttaaatcgatatttaataaatttaaataaaaaaaatcatgccatttagtaactcgagaaccgagtgaatttatccaccattctaatcctttgaaaagaacacaccaagtaatcaaatactcaagcatcaaactactttcctcaatgagcgcaagtatgtaaatcccctccaatccattacacccacatatacaactaaaatattactacttcaaagggtaggttatcatggcaccaccattcgaaatggacccatcaagccttctttttcccattgcccattgcttccctatgttgcagaatggcatgcttcctttgttttctctcccagatgtagagcctctgttcatctgcagacaagaatacgagagggactcatcaaagtcgatcatgagtcctggaatcattctcacgagaagaggggaaaaatggtcagatggatactttctccgtagctatgctggatggatgctgacccacattgctttctttacctctacgcaaagatggcatgctcgattcatcacttattatctactatctcctgtacattgcagagcaaaggccgtgacagcgacgaagaaggctgggcgctggcgatggagcagattatgatggtcgctttgctggcagttattattcactcgactgctactttacatccatcacaaacatagtgatggtttactttttcttttttacctttgctttgctagaagatatctggaaggatggccattgcagcccatgttatgcagtacttgtgatgttgatgtaaggcattcatccactgagtattgtcgaaaaatgagagagatttgctattgtcccaggctcccagcatatggccaacaaatctgaaagagggaagtgcagagaaggcctgaatataagttgcttcatttttttaagacaacaacagattatgggcacagactaaagattaccatctgtgaatggtctccaggttatagttactagttggcaaactagatgaatataataattacataagaagattgcagttatcttgcaagcaactgcaagatactactgaagtgagactcttttctcagcctgctgattgcaaattactcaacaaaaagagctttgttataattattattcttttgtacaaaagaatttccacatgatccaagtgtataaacccctgatctctcctaaacatggtgttccccacggtacacatgtgcttcctttgtcatcgtcattgtagcagcaatgtagcatttgctgcatctgctataagctgtaaaagtttgtgcgtctatgttcattccaaaattcagtatgttccttatccttcttaccctatgacgatgaactatcatcatcggagttgttttctctccgttgtccatagagacttagaactggcaatgaggatgttgctgagatgcggaatgacctagccgatccaccaatgactgttctgtcctgctgcatccggccaacctccctgcaaacttgatccaacgttgacaggaagtccctcaccaccatgaatatcctcagaggatgcgcttcctctttcgcggtgtcgccatggaagtactcagtgatgtccttcactctccccaaagctctcctctcctcacctctgactctctctatctccctttcagcttccttcagaaagtcttgcattgacataaagaatcgctggccttgagtgcattttttctcgagttgcaagactgacttgatcttttcaagacctgtttctagcttattgacataaccatgaagcacatcgaagtccatggtagccgctttcttgacgtttccaagctcgctgctgagcccagatacaaccttgagaccatgcttacggtcatctttagagctactaatcatggcactttctttttcagattttgcgtcttctgaccgaataatttcttggacgacaaaatggagcaatgtggttttaccatcagtgcccttgacatctgctagtttcaggagagtatcaagcttgaaggctttagcctcacccctatttgtcccaacattcatccggtttccggttctcagcactgcttcaaggagttttaggaacaacctactgcctctaagatcttcacaagcagcctaaaaagtaaaaacatgacaagaaatgtcagctaattgtaggtttaatagttgaaaatggtgatgatattcaacatggaaaactaaaagacttagcatacctccagagtttcaaaagagtttcttaggtaatttatttcagtctcaaaattggctcggtatagcattgcatcaactcttttgaaggcaaaaggtatatccaacacagcctttagaaagcgctcggcagaaccaagtttcgataagtcaccactgtagtctcgtagtttcagttcttcctctttagtaggagccatcttgactaatgtttccaaaagttcactccccaggcattcagcattgcctgctcaaaagaacaatagaaattacacatattcactggacaccctcatgtagagatggcatactaaattacagatttacagtatgccgcaatgaaaaaaactactacctccgtttcacaatgtaagtcattatagcatttcccacattcatattgatgttaatgaatctagatagatatatatgtctagattcattggcatcaatatgaatgtgggaaatgctagaatgacttacattgtgaaacggagggagtagttcatatattgttctgacttctgaggatgaggaagattttggttcagacagtgtagtttttaagaatgtgattgttagaaaagatgaaatatgataacaatgagaaaaacaccgatggcttgagagaacttaggattcacgaaacacaacaagtttagttttccaatttgttttgtttccaaaggaaaagttgtgcaattcgaatttaaaacaggcacaaccaagataactgatagttttctagctgccgttgatgttgtcaatattattaactcgataaattttgcagctgtatactgtatagagagtagtattactattacctcgacaacgacataaagaaaaataatgttcaatgtaacatatgatggatgtttcaaacttccaagtcactgtaagttctgttgaggtctttattatcaagacctgactttttctgttaattcaacagctcctaagtacctagcactatcaaacgggcatgccaccaagaaaacaaaacaaaatatcatcgaaagtacggaccgagcaacaaaatctgaataaaacatcctaccaaagcaacaaatgtgctaaacaaacacaactaagtactattaccaaatactatatcaaatcagatagcgactactattaccaacaaaaatgaaatgatgattctatcgtggtacgctgaattaacaatgcaatgtcaaaagcagtaaactgaactaagtactcaccatccaacagtgcatccgagacctcctcacgcgtgacattcaacgcgcgcagcaggatggcgatgttctgcgccttcttggggtcgagcaccctctcctcctgccggaacgacggcactccggcggctttcctcccgacctctctcggcggcgcggccggcgtcgagttgttcatgaacaacgcctcgatcatgtcctcgtccaacctgaaaggaacgcctcaacgtcacacgcgtaattcaaagaccaaacctgtagcaatcacggcattcagtagtgtggaccaaatctcaactggaatgagcttgacttcagctggtcccagaccatggcgcggtcggaggtcgcccgcaccttgtcccagtgcagcggcttcagcttcggccggggctcgccgctgcccccgtcgtcggcggcggcgttgtccccttcccgcattgacgtgctcccgttgttgtccaccgtcgtcgccgcggtgatcggcatcggcatggcaatgcgcggcccttcgggtggcagaggcttgagcaaccggcgcctcgatgtcggcacggccggcggctccgccggctttgggagattgttgtttgacggcacggatggtggtggtggtggtggtggaggtggtttcgccgctgtattcaacttccgccggtggcggtggtggtgggggaggtgg

SEQ ID NO: 60411 - DNA, 2345 bp, Oryza sativa
cggccggtgatcaggaacgcgcaggcgaagccgagcagcgcgacggcggcagccgcgcccgccccggcagcgactatggtcgccttcgtagggccgcctccgtggtgtcccgagccggaccccgacggagttttcgagacgtcggcggcgacggtggtcggggagggagtcgttccggggctcgtcggcgtcgtcgtggtcggtggcgccggagggaagaagtcgccggaaggcgcgtcaggcgccggcggagtgctggggtcggaggtaaaatccggtgcaggcggcggcggcggcgatggtggaggagtccactcaatggggaagaggggctgatgcagcaccctcctcgcactgccgccgccgacaccgccggactcagcggccaccgcgacatggccacacagcaacaccgccgcgatcgcgacgaatcgcgcgatggcggggggcattgacagcagaagaaaagaaaaacaaaaaattaaaatcgagccaaccaaggcagctgcagcagctgctgctgctttctagagtgagagagagtgagcgaaggggagggaggggagagagaggaagaaagccgccatttttcggtttcggagttgtaccatatgcaatccatcggtggagatcaacggtctccctcacacgtggcatcagaatctgctttccgttttgcttcttttccctcttttcccctctctttcgcagcatttcctcctctttttatttgtaggtacccactcagtcactcactcaccaagaaaccatactttagattagatggacctttatttttcttctttaaaaaaaactcaacattatgtagctggtagtgtaaaaaacttagatggtataaagatatcatgtagtcctgttgcctctggagaaattaatgagttaaacaattaggttgtggtaggttggtgctcagcgaaggaaagaaaatattccacacaagacacattctgaactggaatcctatactttgcgtaccaaccatccagttgatgtgaacatcagtgtcgccgaacagcattccggtggcttaaactaatcaggttgcgttcactgacatgtggggcttcccggttaaagcctgggcctttcctaccgtgtttgggtcgcgcgcgcaatgtactgatttattactagtacatttttatttaaagaggatgtactgattgacaatgcacaaagcaatccgtcgttggatgctgccctggggttgcttagtgcctgcttcttttctctctttacagaaccattaacaatctgtatctttctcttgctgggattggatcttcaaataccaatctttattttttttcctcctttgttagtgctcgattagctttagtcgaaagcgttttactgtgggggctgcatgtctcctgcgtatcgtatgtactgaatcatcacgcagtactacattaggaagaggagaatataatttcatagaggagtattttgttttcccatgttgggtcccacgtgtagcatggtctgctggtcgcttggccttcggcttctcttttgtccgctttccagtcctcttgcgggtagatggatggaatggatggatggttttgtatactctaatccgcacgtcaagcatctgctttgccttggctcgcgccgtcacgtgcaaagcggccccgatcccggagcggcgctcggtcgtcccgcgcgcaccgcggctacgccacggcacgaccggtttggttgccggcgcagcgcgcgcaggttgtgtaggagtacttccttccacttgcgtggtggtggtggtggtgagaatgtgagtgagatcgtgcagggggatttaccggtagaattagaaaacggagggggatttttcaggcgtggaaacgtgggcaatgacacgctgcgcggcaggtcccgcgtggtggtggtctcgtgctctctctcctctccgcggtccgcgggccatcgatcgggcgcaattggtcgcgcgtgtctggctaggcgaataggtgtgcgtgctgaggaggagacacgggtaggtccggttaatcccgcttctgtactagtctagctagtgataaacttgggaaatgcgtttagcaagcaccggctggctgctaccctggaccctgaacaatgtcctcaattggaaagttggcatgagttaattggtagcccgaacttatggacatgtatataaatatcaacgtgtacaccgtttctcacgatggtaccgcagaacaaaagggggtggagttcacataaacaaaccattcacaaaacttggtccagtgtgttttaaaaattttggctacaggtgaaacacaaccatctttttgtcaaaaattagggctgcagga

SEQ ID NO: 60412 - DNA, 5062 bp, Oryza sativa
tattttataaaaaaaacttctgctaaaccgagtagtttgtgtcctcgagctggaccaagaaatctagttctcatgaaaaccaacaggttctcgttagttttgtaaatccttgtagggagatatgtgatcggagatcttaggactcatttggattgaagtgatttcaacacaagtttggtggatctcaattgtttgggaaaaaaatcctatcattttatttgaaatgaaggaatatgattaagccattccctaatatccacgtcttttttttctttgaaacgaaggaatatgattgacaaaaaaaactaacaatttgcttctcataccaaactaaacgaattcatacttcatgcttttatttttatatgagaagccccatgcattctctctcgcgcacacactcataaaaaaacaatttcttctaaatttctatatttcatttcctacatatcttccaaacacaaactctttaattcatgtgttttataaaccacacttcaagggagatctaattaattaatgtctttatagtccattggttctcaacccttccaaattccagtatattggcagtaaaattttgcactaccaaatcgttgataggggtaaagttttgttgtcaatgtttggtttgttaacaatattgagccaaatcttataatagagtgaataaagttctaagaccctgtttagatgggactaaaacttttaagaccctatcacatcagatgtttggacactaattaaaaatattaaacgtagattattaataaaacccatccataatcttggactaatttgcgagacgaatctattgagcctaattaatccatgattagcctatgtgatgctacagtaaacattatctaattatgaattaattaggcttaaaaaatttgtctcgcgaattagctttcatttatgtaattagttttgtaagtagtctatatttaatactctaaattagtatctaaatatagagactaaagttaagtccctagattcaaacaccacctaaaaattgtgtcaaataaagcataggcattaccaaataggagtagttgacatcaaaccaaactatcacatttatgatctgagctaccgataaatttatagggtatgttttggcatcaatctaaaacggtcatctgactgactgaacccattttgaaatgtgattttctttccaagtctttcttttttacaaaattcgtgtgattcaaaagaatcctagttttgttggttcatccgatgtactccggagtactaaagaggtggttaggagcaatatgcattatttctgcctacacgaaataccagctagtagatgccaattccacaattcccatttgcattagtcccagaaagggacagtgcagaaatgtcggtggccaggagtactactacttgtactatcaacagtgcagcatgactgacgataccgtggcactgtggcagcctatgcctgcagctcgatcctgtggatcggccgtgctactagtatgactactgtatatacgtcgcaatctcgctaattccacgcgtttattatgccatccaagaaccgacctgacgctctgacacatttatgcgtatgtggacagtagatcggtgagcctcaacggagtaatcgctgcttgatgccatgtcgtattgtctttctggtccttgcatttaagccacgtgtttcgatgcgttgcttggtgttcatgcagtagtatgagtatgtgggatggatgatgcctcaggttatcttcaggtacgatgctttgaggcaatcttttcatttctgaactttctatcagtatgcctttgcttcgaaattctgctcctattaaccagtttatgcgcccaaacatactccaaagcgtgccccccaatgagaatgacgtcctgaagctccagctccttgtcctcgttgtcgtttagtactattttttagatcagtccagcaaattcaacagacgagaagtttgggccatctgattgtgtagaataactttgtcttggttggcccttggcccttcggcaggttgttaccaaattgtaaaggaataagttcgttttgggtctctctatttgtcgcccagtccgatattcgtcccttagaccgcaaaaccgggtatgacccatccccaacttacgaaaaccgggtagacgaggtccctcggcggttttggctgacgtggcgcctacgtgacttgtttgactagttctccgtctcacgtggcattaacgtggcgcttacgtagcaattatatcttaaaaaaaccgtggacccacctgtcagctacacacaaaagaataatttaaaaatagcaaggcccacgtgggcccacatgtcagtctaactcaccctcctcttctgcttcctctctccccttctcccctcttcatctttcttgcgctggaggatgcggccaacgatgacgacggcggtggagatggagaagagtggtcgccggtaggccagggagctcgcctagccatcagccgcccttctccccgatggccgtcggcgggagaagagggagcggtgcgcgacggcgtcggcggcgggagaggagggagcagcacaagctctccgccgcaacccgcctccaccaccgtcgtcgtgtgcgctcgtggcggaggacggcgagagcggtggccgtggcactcacggcggaggccggcaaggacgtagaagctggagcccttgtgcgcgacggcagcggcgaggtcggtcccctcctcgagggggacacgacgaagacgacgggcagcacggcgggtgcctgctctagctccccgtggctcctctacggcgggtgcctgctcaccgtgatgctggccggtcctggcagcggccgcgtgctggtgctggagcggggcggcgcgcccacggagttcccgccggcgccgctctgggagagctagtaggaaagggaatgatatgtgggcccacgtgggtctcactatttttaattttttttgtgtgtagctgataggtgggcccatggtttttattttttttttaagatataattgccacgtaagcgccacgtcaatgccacgtgggacggagacctagtcaaataaaccacgtaggcgacacgtcagccaaaactaccttcaaaatcactgaaggatctcgtgtgcccggttttcgtaagttgggggacgggtcgtacccggttttgcggtctagcgacgaaaaatcgaactgggcgataaatagagggatctcatgtgaacttattccaaatgtaaatgcaaagcccaacccattcgtttcacaaaattagaagaaactgggccgaggcggactcgccaagcaatgatgggctgggcctttctcctggtagtgcacgatactgcacatgattgcatcgatatggactaatcggcgcaatcagaacgcgtgaacgctgaacacccaatcgcgagaatcactacttcactagtacagtacccatttaagcctggcagtgacatgttttctactacctccgtcccattataagtgcagccatagttttccgcgtccaactttgaccgtccatcttatttgaaaaatttttgaaaaaatttaaaaacataagtcacgagtataagtcacgagtaaagtactatttatgttttatcatctcataacaataaaaatactaattataaaaaaatttcaaataaaacgaacgattaaaattggacgcagaaacttatggttgcacttataatgggacggagggagtactttctacgacatgtacatagcattgccttctggccattgtcgtatccgttaatgtaatgggcagctcgtgtggctcaagtaagcgcgtacgcgcactgcatattctctcctcttctgtactctcgccatcctcatgcacctcatcttcaaactgtactgaaaccttcattcaactcacgcacatgtactggctggctggtaaaacgtggtacaaaaaccagagaaaaacttgacattgtccgtgagaaaacaccgatctgtcgaacacgtacacgatccggccggcccgtctcgcggcggcgcgcgcacgacacgagatacgtatccgtcgctaacttccacacgcgcacgcagccgctccacgtacaggcgtacagtacgcacaaaaccaacaggtagatacccttgactatactaccttgggggtgcatgcaccggtgtagcgaccgtacgtacgtacatgcaggcgatcggagaagcaaccgcatgtgttgacgcctgcacggcacactcttcctcggctataattactcgtgttgtaccttggttgcctggccttaatcgggctttggccttaattggggttgctagtttcatcggatcctgctacagtatacgtaggcagtacacatctgacgtccctagctagaataaagaaacaatcttaattgacagcaagcgagaagccagcagcggcattgttcagatcgattaggtccaaatcgtgtagtacctgttgaaccaagcagcgacgagacgacattgatcgtccaaatccaactctgtccgcctgccaattgccacaaagtccccaatccgccaaagacccagatcatcacgaccctgttggcgcgtcgactagcacaagctcacacaactcatcacacagccaagttcgcgaatcaatcagcagccatctctggcctctggcggcatcgcacgagcctcctatcctaccacgtaccagaaaacgccgcgcgcatatgctaagctccgagcattattcttcggaatcgctccccgcgccgcgcgcgacaagagaaagctttggctttggctcgagcccgcgcgcgtcgcgtcgcgtcatgtcgcgcacgtacacgtacttcttccctcgcgaacaccgcggttggcggcgtggtgaccgactagctccggcgtgcgtgcgcggtgcgcctctcggctaggcgcgcgcgcgccacctgtgaccccgtgaatcatccggaccagtcgtcgcagctggtcacgctggtgccgtacgcgaagaaatgcgtagccagccacggccgctacgaggggggggcggtggccggggggggggggggg

SEQ ID NO: 60413 - DNA, 10795 bp, Oryza sativa
ggggggggggggggtctagctgctagctatccctggcagtgacgctgcagtactgggtgccccggccggagtgatctgtcgtccagtgcaggtacacgacgagttccaactaagacgcaggtggctcgagatgtacacagtaacacactggtacgtcgtaccacctatccatcggtagcgagcacgtctccgcgccgcgcggtgctgcatgcatgtgtctccatctgcagccttgcaggtttttcgttcagatcaatcagggggggctgctctcccgttttccttcagggtgattgatcacactggccgtcgatttccaaaggttttcacaaagcgcgtattactattaccacgtgccgattggatcgagtgaacactagaagtaaaaactgctgtccaagtagggagttaagtaacacatcgcgagatccaatgacccaacaaaaccttgcagaggtttttgcagttgcatgcatgagtggcaattggctcttcggtttggtttgcatttactactatattcgcatcatcaaggattgacttcagactttctgatgagttgcaggtgcgtgcgtgttcatatacgtttattactgtcagttgattttctttgagatgtactggtctggttggttggaggaatatcgagtgcacttgatcgatagataagatagattggaggaatatcaagtgcactagacggatagataagatagattactggttacatcttcacagcttgtgcaagcctctgaacagagaagacgatatatggagttagaattatggaaaccagtcttaccggaaccatatgcgctttatgcagtgcacttaagttttaggatggaaaaatgggggagggaactggccgtagtaatgcatggtccctagttactgacaggatggtcataggatgcatatactactgtaaccgtttggtgcttggattgatccatgatacatcagtgagggcaggtagcagatcgatcagtgcatgccggactgaacaatgactgcaagtctctgcaactagcaagcagtacagtcgtacttcagtttcttttgtaattgaattaaccatcacataatatagcaagccccatttgcaattaaacactgaaatagtaaaacacgtgattttaatagaaatgtatatgcaaaacagaaaattataaaacacaacaagataacataggaataagaaataaccgtttaaatagaatatagaaaaaaaatataggaaccggaagagaataacagactagaatgaaagtttctaataggttgaacctctactgagatatttctgaggaatttcataggatttaggaagcttcaaccctatgtttcaaatgactaggtagaaaatttttctataggattaaaactctacaaagttagtacacattgtttccaaaatagaccgatagtgtattctgtagggtaggatctgattgacagattagataatgcatgcggtacagcacttacattgcaaatttgcaattagggccctatttagattccaatttttttcttcaaacttctaacttttccgtcgcattgaactttcctacacacataaactttcaacttttctattacatcgttccaatttcttcaaacctctaattttggtgtggaactaaacacagcctagctctaactctctgtgcgctcttcttaatcttaattaagtagccatagcagcgtggttgctagaatcgccaacaacatttatagaaaacatagaaacatgaaaaatacggaattttaatatgaatatataagtggaaaacataggaaaatctatgagcgactttttgaatagtccgcataaaaaacaaaaagaaaaaaaatcagataacatagatagactaaatttttttttcaaaaaatgaagctcttgctaactttcttcaaaatttataggcattaagtcatttcttaggaattttgtaggatatacatgaaaaatacggaattttaatatgaatatataagtggaaaacatcggaaaatctatgaacgaccatttgaatagtccgcataaaaaacaaaaagaaaaaaaaatcagataacatagatggactcaaatattttttttcaaaaaataaagctcttgctaactttcttcaaaatttataggcattaagtcatttcttaggaattttataggatataaaagcccaaatcctttgtttcaaagagctaaatagagaaaaaaaaccattaaaatttgaatcctataaaatttatatgtaaatccattgtttagagggggtcttaatcgatatatactaaggctgtattcggcacccctttttcccaacaactctccctcgttttctacgcgcacgcttttcaaattgctaaacggtgtgtttttttgcaaaaaatttctatacgaaagttactttaaaaaaatcaaattaaccctttctaaaaatagctaatacttaattaatcacgtgctaatggaccgtgccgttttctatgattactgttccggatgggagcaagaatgcccgaacacagcctaattgctctagtctagtgagatacagtatatatataactagataagcttggaacagatcttgtttgcaatttggagcaagtgagatatgcaactattcactaactgaattgtggtcctagcgagctcgggggtaaaccacaaagaaatcagaaaccacgcgaagttctatccaggcagcaaatggcgtgcatgtaatggcgatctggccagtggacagtggtcctctccaagatttctctattatatactgcacatcgatacaaatatttccttactcattgaattatttctgtaacaccggactgcgcacgatcacatgagtgacaattttgtaggctccctcgtagtgggatggcaagatcggatcagtaagacagtaatgattccaaacatagcaagtaaggcatggcattttcttgtagagaagtggtagtagggattttattagatttttttttgaaattattatttattttatttgtgacttactttattatatatataactttaagcacaacttttcgttttttatatttgcaaaaaaaaattgaataagacgagtggtcaaacattgcaatcaaaaacttaaaatcccttatattatgggacggaaggagtagtttttttaaaaggtacgaattaccctcttgaactatagtagtcgaccgaattaccctaaactcgtaaactcgaataccagccatttacaccctcgactattaataccggatgaataactccatgaacactgttttggacagttttgacttgagtttgcgtacataggcgttaacatggcaatccaatcaacaatgaaattattaaaaaaaacaatgtcatctctcccatagcctaatccctcccccctactctccctctccctctcctccctccgacccggtggccggcacgccatcccagcccctaacctcccattttagatagttatgccttgagtttgcgtacatgggcaccaacatggcaatccaatcagcaataaaattattaaaaaaacaatgtcatctctcccacagcctaatccttcccccctactatccctctccctctcctccctccgctcggtggccggcacgccatcccagcccctaacctccaccttgctgccccctcccccaacctccgccacactgcaccgtgctgcccccatccccaacctctgcctcgctgctctctcttcccttcacccgatggtcggtgccatccccgtcctcaacctccgcctcaccgcgttgccccaccccgtcccccaacatccgctgtgccatcccttcctccaatctctaccgcaccatccccacccccaatatctagtgcgccgtccccatccccaacctccgcctcaccgtgtggccctgcccttgcccccaacctctgtcgtgtcgcccttgcccccaatctccaccgtgccatccctgcccccaatctccagtgcgccattcctgtcccccaacctctgccccacccatgtgcccaatcttcaccacgctatccccccccccaatctccactacgccatccccacctctgatctccagtgtgccatcctcgtccccaacctttgcctcgttgttgccatcccaaccaccgtgaccgcgacacgtgagggtgtagcggatggtggccgtttcgagctcaacctccgcatagctctagcttcgctttggcccaccacctccgagagccagcttcgcgtgcccaggcgagcttgcgttgatccgcctcctttcgagcaaggtccctctctgtcctacttctctagccaaaggtgcacagagagagagagcccattgatttgcacctgaaatggggagtggggaggattggcttgaggaaagatatacaagtgggcccattgattttttttaaaaataattttattgctgacttgattgccacgttaccggctatttatgcaaactcaagtcaaaactactcaatacagtgctcagggggttatttgtccggtatcaatagttaagggtgtaaaatgtctggtattcaagtttaggaggtaatttgatcgaccgctatagtttaggaggataattcatattttttttcttttttttccattacacaaaagacgtgtatgcaccagcacaattataactatacatggtagtaaatgtttccactaacaaacgtttaaaaaaaaaggtgaaggccaaactacatgtccttgttctaactaaactttattaataatacaccgcatgtattccaatgactctacacactaccggtgctttccccttgacaagctaatttctgaaacaatgagataagggtttcgggatctcgtgaaatttggtcatatgattcaggaaaaaaaaagttgtttcccacaagaaactttaacatgaattttgatttttgagttctacagtccaaaagctattcgcatgtaaattttctataggaacttgttggagaatatgtgacacaacccagccttagcaaaagttggtacgtgattccattttaatcacgcctaaagtacttgtacataaagtttgataataagaataatcactaccttggaacccttatatcctcttaatgagatttttaaaaatcacacctacgtcgaaattatttgattaataccaatataatggttcattgcaaattaaacaatcgatttacctattaactattaaggtttaaatcgatggacaagattcacgcatttattcttagtctttgtctctttgtcatataaacgtgtattaaagagtgtgtatttgtggacatgtggccaccatgatatgcacatatatgtgttttgtccgattgaccaaataggtaaaaaacttttatgtatgtagtttgcatgaccttggtcatgtatatatcacacgttggtagtatggctatatctacgaattagaggcccggccggtgccttaaatattgtaaaaataaaattaaaagtacagttcaccgctgtacgttgctctttatactcgatgcctattatgggtggtgtgccatgtatccgcatcagaaaagtagctagcgattaatctaatgttcttctctttagctataccttgttattagacgaacatatttcaggcttttagcataatcgccgaaggagaaaggacagcttaaaagaaattgagtgaggaagttctaaaacttgaacaaattggtttggtgtggacctaaacaaaaattttagaagccctcactcattctgcacaccatactgtacaggcttgtttggtagcaacagacgcgcgtcgtggattacttgactagcgaagctagcagcatcagggacaaggttacaatacaagcgtcaaggttaagcaaacccgagaattttttttaataaaccttatgactaagctactcgacataatagaagataacatcataattcaaagtatatgtatcaattttaaacttctaaacttctcacatatgacggttgatctcagagtagagtggaactatggaccgaaacacagaagacacgtgcatacgtacaaagtaagacgagaggagagaagagcgagacctagcttgtcacacagcacgagcactaccaccagtagtatgctattacgcacgggagcatgcaactaggccagcggagcagcgcagagacgctactcgtgtgttactaaaataccttagagtatatttattaattttggacatctaaacttgtcacacggcggttgatcttatagtagtgtggagcatggagtaaaacacatataaaatgtgtacaaacgtatgaagtatgtgcggtaagacgagacgagaggagagcagatcctgcaagtcacacgacacgagcgttaccaccagtagtacattgctacacacgcgagcagacggctaggccaacgcagaggagaggcgccactcgcgtgtcgttccctataggaaaaccctctttatcaattttggacctctaaactttcacatatatcagtttatcttacagtagaaatagaccgtgaagcgaaacacacaagatgcatgcatacgtacagagtactcccctgtcccaagctataagggattttaagtttttcctacaacgtttgatcattcgtcttattcaattttttttaaattattatttattttatttatgacttattttattatctataactttaaacacaacttttcgttttttatatttgtaaaaaaaatttgaataagacgagtggtcaaaagttaccagaaaaatttaaaatttcttatactgtgggaacggagggagtacatgtggtgagacgagacgagagaagagccgagtcctagcagccatcacacgagacgagctttaccacgagtagtatgctactactactacgcacgcgagcacgcacgcagccagccaggcaggccagccgagcaccgcagagagcaggcaggcgccaactcgcgcgcgcgcgtcgccttctccatccaccaccatccaacccccccacgcggccactcctccacgcacacacctctctctctctctctctctctctctctctctattccaatccagtcctgaatcagtccacccctttccttcgctctctctctctaactgcagatttccctcccctttcaacgcgcgcgcgggtggtggggggaggcacggcacgaggcggaggcggcggaggaggtggtgggaatcgatccctttctgttccggccgcctcgatcgcccgctacccgcacgccgccttttcgtcccggtggatttctgcctcccttttctcgattctttcctttttcttcttcttctgcatgcgcggcgggctgtgacgccgaccatgggggacgcctcggcatccacctccgcgcccgcgacgcccacgtccacgctcatctgccgggaggatggcaacgacctcttctccgccgaccccgccgacgacgatggcggcggcggcagcggcggcgactgggagttatccattgctgacgacgaccatgtgttgctcatggaccgggacgatgagtacctcgcgctgatgctgtccaaggagaggtgtgccggcggcggcggcggcggcgagcgtggggatgaggaggaggaggagatggtggaggagtggatgaagaacgcgcgcgcctggtgtgtcggctggattgttaaggtcgtttcgcgtctcctcctctctttgtcgcccccttgacctgagattactctccacacggtttcgcggagatcggatctttgtattgactcttgttttcggagggggggggggggggcttcctcctcgctttgctggttgcagacgaacgcgggattccggttcagcttgaagacggcgtatgtcgcggtgacgtatctcgatcggttcttggcgcgccggtgtgtcgatgtaatgacgatcctccctgcttgccttgatgcgccgcctcactcttgttgtcgtgatgccgagtgcgtgttcgacgtaatgcctgactccgtattgccattttttttgtgtttgtgtgtgggggtgttttagagggacaaggagtgggcgctgcagctcctctcggtggcgtgcctgtcgctggcggcgaaggtggaggagcgccggccgccgcggctgccggagttcaagctggacatgtacgactgcgcgtccttgatgcggatggagctcctcgtcctcaccacgctcaagtggcagatgatcaccgagacacccttctcctacctgaactgcttcaccgcgaaattccggcacgacgagcggaaggcgatcgtcctgcgcgccatcgaatgcatcttcgcctcgatcaaaggtcgatcattccccccctctgctttcatttcaccgaatcggatcgcaagaatctcatttcatttccgcaatctcgtagtcattagctcggtggggtaccagccatcaacgatcgctctagcagcaatcctcatcgctcggaacaaggagacggcgcctaatctagacgagctcaagtcggtcgtgggctcgttatggcagcaactagacaccgtaagcactcccaactttctcttttgcgagatctcatcccattaggtttaagttcttggtagaaatgacaatgtcgagagtaaattctgcaacgctgttgttctcttgcaggggcatgtgtattcctgctacaacaagatgatgattcaagaggacaggtcgatgcaatcgacgacggaggtagcttcctcgggtgtctctgttgcccacattgggggatcggaggacagcgccatgggaggggccaataatgccaccaccttggaggcaaccccggacaagaagaggaaaaggttgcactcgcctcagcgccagtagagggaggagctggaggctggagctggacagcatgttggttggagtccagctctgcaatttttagttgatcattttcaccctttttcttttgtttcagctgagccctagtcagtgctcttgcaagttcagggggggttggccaaatggaggggccaacatttgattcttcttctgattatgcaattgttacagttgattgattagttagcaatggaaagattctggttttgtggagatctttccctggcccagaaaggtactagtgtaaagagcagaggaaaaggcctgaaaactgataaagagctcttgctcaaagtagggaggaagtcctcactgagatgtggagacagagagagggaatcccaattcccaagtattgagtagaagtcattttttgtggatactgtatggttatctgttactctctgttgagtcatgccattttggttcattagcaatttcctgatgctaaagccaaacagtggtagtacatttttgttgcaagaactgattgatagtagttggatagccagggggcaggggccatctctctcactgtacttcactctactctctcgtgtctcgtgtgcaattgctgaccatgagtggttgggaattgtttattgatatctgtgggacgaaaggaagaaatgcgtttgctcggtgcctttctgatgttgcctttgtgccgtgtcatcaaatcaccctgccttgctatttctcagcaatggctttgctgttctttgccttcttggaggtgactgccactgttggtttgtctctctcgcatgaaagcagctgtaacgctgccttctttagctctctctgaattgtgcatcatgcaatgcaaatcactactccagtagtagtacactccactaggacacgtggaacaggccaaaagaaagactcttcttcactcttcagcttcctctcaccagctgccgaggttctgatgaattgctcatcttggggagcatgtgagtggatctgcttctttcccctttccctccaattttttaactgcctccaagaagacagtgcgtgtagtgtagcactgtgaaaacctctgatgaaagtggagtacaagagctgctgtgttttgtgtggtctggatctttgaagtttttgaccaagggggtgtttgggaactagggactaaatttagtccctctcaaaaaaacataagtccctcaaacataagtccctaccacagggagggacttatgtttttttagagggactaaagtttagccccaatttagtccctccaactaaacaccacgcaaagaaacaactccccatgaatgatctgaatctgattcagatggctgtggatgaccaacccttgcactggattcctctagcccctggtgactcgtcgtgggcggtagcaactggcattgcggtcaaaacccaaaagcgctgcacaagcatgacatgagaaagagagagacatggtaaaattttttttttcatgtactgatctgttgtgttgggctgtcttgtgcctggcagcaaggtaaaaaaatgggttcaccgcggttcacaggggcatggctactggtggccgacgctgttggaattttatagtgggcagtaacatgcccagtcactggcttgactggtcagcagcattttgtattggcactggtgaagtggtgcagtagtgatggaagcacaagctgcctgttgattgtgtgtgtcaattgcatgcgatgtgtgaagagagaaaagcctgggatgccaaaaggaaggtaactgacagcctgccaggcccatgcaaccagtacatattatctgctgatgctggcatttggattgcaactgagattcgtggtcaaagttaaatgtgacgttatatcttggatcttggaaggtagcggaggcatttcacaaatcctactacagctaaccatgctgaaaattg

SEQ ID NO: 60414 - DNA, 1274 bp, Oryza sativa
aaaaaagggggggggggggggggggcagaggttcacatctaaacaagcgcataaagagaactttgttatgcccatggtactgcctctaatccctaccgacttcagtcccgtgtcttgaattagttctgctttcctacttagaaatcaactgggatcagcttgaccgcagcagcgatcggcatccctatgaaaccgatgaaaatgcagttgaaccactgcttcaatgtgagaggagtcgtgttggcgaaatcacccaggaactgtactattatgaactggaagatgactgtgctgccgaggacggcgacgaacacgttgttgtctagaatgccttcaaatacatttatcctctccatctcccttgagctcacctcattgaacacctgcacaacaatgaaaattttaatgaaactgcacactaatattggcaaaatatagtctgaaatttttcattcatcattttacagctgaagtactacattcatgtgagtattgatccttggaaaacatatttgccaacatattattcaagagctaaggtctatttttgcaaaaatgtatgcaagagaattattttagacactaaatagatgtgacaagcactttcaaattacctggcagaacacaaagcaattgaagatgagtgtgttcaagactagatcggaattttctccctttagtccaaatagccacttcccttctgtctgcagataccatattacaatgaattggtagaaggcctgtcccaggatgtttctccacataatgttgctgatgaagttccctttccttccaacaggagttctcttcatcagttcatcgtttggaggttcagttgccaatgccagtgctcctagtgtgtccatgatcatgttaacccagagcagttggacagcagtaagaggagcactccctgaatgccaagcagaagtacaaagaacagtcaagagtaagttatgaaacaaactaggaaattcttgattttccacattaataaattttatgttagtttatttttttaagttttagcacatctcttctgccactcatttgaaatctaacgaaaaatttctgctgcactaacactaaacagtatttgaacttagaaacagtaggcagcagactaggaacagtggtgaaggagaagtataaaagatgaacatgtatcagcagtgcagttattacaagaaaccaacatcaaaggttattttaatcggaacgaaactatcaattctatacagtagaatgaggtaaaaaacatcaacatttagctg

SEQ ID NO: 60415 - DNA, 1672 bp, Oryza sativa
atacacttctaaaaaaatcgaagtgatgcaattcattaattatattgttcatgcaaggggaacactatcaactatctttgaggaaaatcacctcagttccagcaatgcccattgcaagtccaatatcagcttcatgaagagcaggagcatcatttgtgccatcaccagtaaccgcaacaacttcatcaaaagtggtccggagatgcttcaccaaggtgtgcttgtcaagtggtgaagatctagccatcacctgatacatgaaaccagaacacatcagcaaatgaaatccagaaaattcagttaaactgaccagcaaaagcaacgaaaactttacttgtatttttggtatcaactcattcagttcctctgcactcttggttctgaaatccggtccttcaatggcaatgccaccttcagtcaaaatgccgcattcccgcgcaatcgccttcgctgtattgatgttgtcacctgtgaccatcctcaccatgatccctgccgacctgcagatggcaaccgattccttcacaccaggacgaactggatctttgatccccacaatgccaatgcaggtgtagccatcttcaggaatctggtcattcgccgagaacccgtcaccgacatcgacgtaggcaaggcacaaggtacggagcgcctcgtttgcaaagctgttgatcgtggcgttcaggtgagcaacggttgcatcgtcgagtggcacgacgttgccttgatcattcaggtacttgctgcaagatgccaagatgatctctgacgcgcccttgctgtgtgcacgcattgctcctccggggagctggatgaccactcccattctcttcttggccgagttgaatggctccaccttgacgagggtgctcgccttgcgcacggccaggaagtcgccgccgagtgagaggccgaactcgaggatggccgtctcggttggtgtgccaagtatctcgcgactcccgctcttgttgaagacgacgtcgccgccggtgttgttgaagatggactgcgagagcagcgtcatggcggactccggcagctcggagaacaagctcttggtgtccgaggcgctctccacgtctttgatcttgccgcagatgcaggccttgacgacggtcatgtggttggtcgtgagcgtgccggtcttgtcgctgcagatggtggtcgccgagcccatggtctcgcaggcggcgaggtgccggacgagcgccttgtcgttcatcatcttcttcatggcgaacgcgaggctgagcgtcacggcgagcgggaggccttcggggacggccacgacgacgatggtgacggcgatggcgaagaactcgagcagctccatcgcgtcgtctccggtccagctcaggtacgaggcgtccatgatcttgcgccggaagaggccctcggtgagcacggcgaacgtgacgactgcgaagatgaggccgatcttgccgatgatggtggcgacgccgttgagcttcacctgcaacggcgtctcatcgtcgccgccctcgctcagcgtggccatcagcttaccccactgcgtcctcatcccgaccgtcgtgacgagcatcttgcaagaaccatcctgcaccttggtccccgacaggaggaacgggttctcggcattgacggcgacgggctcgctctccccggtcaggctcgactcgttgatgag

SEQ ID NO: 60416 - DNA, 1559 bp, Oryza sativa
  unsure (1)..(1559): unsure at all n locations
tgatgccgaacagctcctcccggacggcttgccggcgcctcgacttcgggagcccgtcctccggcgaggtgcacagcttcgccgcgatggcctccacgccgccatgggacttgagcttcttgatgtcgtggctctccacgatggagctcagctcctcggcgcagatgccgtagcccgccgccttgacgtcgtcggggaccgtgtactcgctcgccggagcaagtcctgcaggatcgtgccaatgtcatgattgggctccatggaaaagagaaaaaaatgttgatttcattctgggatgtgattgtgaactggtatcagtatcgttcataccttggatgaactgaagtgcagcctttgacactagcacagcaactcgcagcttctcctgaaatcggtacagaaaaatgtgcattgatggtaagcctcgtgaattttacagtggaacaattgcatgaaaattcatgaaaaaaacatgagtttgctggcgtttaatcttccagtgctcaaagaacgtgcagttttagcagcagattgcacacaatgaatagtcgagctggctgaaggtttgtcaacacgcacactgacgcaggacacaggctgagtttctgtgtttagtacatgtgccaaattttttttaagtatatggacacacatttgaattattaaatgtagactaataacaaaataaattacagatttcgcctgtaaactgcgagacgaatctattaagcctaattaatccgtcattagtaaatgtttattgtaacaccacattatcaaatcatggcgtaattaaactcaaaagattcatctcgcgatttacatgtaaactgtgcagttggttttctttttcatccacatttaatgcttcatgcatgtgtccaaacatttgatgtgacggaaaagttgaaagtttgaagaaaaaagtttgaatctaaacacggccaccatgctcaactgcaatgtgttcggcacccaattttcccaacacttcttcctcgttttccacgtgcacgctttttaaactgctaaacggtgcgtttttttgtaaaacatttctatacgaaagttgcttaaaaaatcaaattgatccatttttagaaaaaaatagctaatacttaattaatcacgcgttaatgcaagcatcgttttgcgtgcatgggaggaggggttcctaactggaaaaaaaattagctaatacttaattaatcgcgttagtactacttgattttacaaagtgatgcagaactttgtcctggaaactgttgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60417 - DNA, 1174 bp, Oryza sativa
atgaagttcagaggggtgctgcaggcaggggtgttggaggcgtccaaacatcaaaaatagcatctgaagctaacagagagttcattttctcatcatcattcactggtgataaacagtaagtactagtcttcacatatagtcatttgttaactttgtgcatgtgagtgtgcatcacattcggtcgctgtacttgttaaaattcaattccaacccatatagatattgatgatacttatctggatcaggacattagcacaaagaggcggaaaggagcatattgtcgatagcattaaatcaaagagggaaatcaatcctgctgtcttcaaatccaatcccactagtagttctagctcaattaagcctaacaacagtgagcctttggggagttttggacctgatgttgagacatatcgtgatgagagaggaaggattagagtaagtagggtcaaagcaatgggaattcgtatgactcgtgatattcaaaggaatttggattttatcaaagagcatgaacaggtcagaagcagggggcatgactctgtagttgaaggattagctaacaatgaagagcctccagattttccagaacatctttttgaaggtaatgggctgcggagttctcttcatctcagcgaagattatgatgaaactgctagcgataaccatcacacatcatcactagtaggatctgacaaaatttctgagggtgattatcatggaagcaaagaaacaatagagatatcctttgctgacgatcaaacagaagtgaaggacaatgatgaccaaattttcttgcatttagcttctggagcttcatccaacttattcactacagaacagactgatggctctgattgcattacaaaagaaggcgtacttgaaagtgaaacacctcctatgcaagttgatgagaaggatcaccaagcatcactgatggacaatttctgtactgatgatgagatagagtgggaagaaggtggttgtgatgttcctggaggtccttccagtaatgaaaacgatcaatctaaagtaccgaaaggagatctagaagaagatgcccttgttcaggaagctataaggagaagtttagaggattttaagaagcaagaacatgaaaatgtgacccctgaagatttacaggcatcttttgaagacaaacctttgcaatcttatg

SEQ ID NO: 60418 - DNA, 1288 bp, Oryza sativa
attcaaattcaaatttgaattgagtatgtaaacttttgactcataaactttggatctataaactttaggtgtataaactttagatgtatagaaatattatgcatagaaaatatttgaattcaaattcaaatttgaatcggatataattcgaattcaaatttgaaacgggtatataaaattttgacttataaactttaggtctataaactttaggtgtataaactttaaatgtatagaaatactatatataaaaaatatttgaattcaaattcaaatttgaatcggatatataaacttttaagttataaacctttggtctctaaactttagatgtgtaaacttgaggtgtataaatttactaaaataggaaagtaatgcggtgccaaaaaagaaaaccaggtggaggggtgaagggagggaggggggaggggatcgatcgctaccccatgggcagggtgatcgatcgcccattagagtttccgacttcaaggagcaaagataacttcgcacggagaaaaaataacgcagttcgcgcgtagaggcggtgcggtgatacctcgttccccacttcaaggagcaaaaataaccgcgcacagaggaaaaataacgcggttcgtgcatagaaaaactaattttctctattggtagttaaagggagggtccacttttcattataggaattcaattttagtctttctccgggagagataggttttctcgctttctacattcagtttagaaaatccaaaacacatagtttttggaattaattattggaatacttttggtgatgctctaaccatctgcttaagaattggagtttcctttcccttcaaattcggtccccacaagtttggggccgtgctcgctcccgattcctcgctcgtagcttcttcccaccgtgcaaagagaagtggaatctaagcaccagctgcaagagatatcgcagtgcgggaattgggggagctcaccttttttatttcatttcagggacttaaatgaggatatctcttgaagagaaggatattttcatgccttaaattctcattatagattttttttaaagaaaagagatttaggagattggatttagaggaacagtcggtcatgctctaaagaacgacaaataattaaattttccaattgtggataatgaaaatggtttgtatcttcagccataggagcaaattggtaatgttatattttaaaaaaaatttataatcttcgagaggtactaaaaagtaaaaaaaaaagaaatttccgtatttcctagtgtcggaggtaccaa

SEQ ID NO: 60419 - DNA, 16105 bp, Oryza sativa
tgatatacctccttaagaactaacaaatcactctacattttaagttagagccattatcttaaaagaatattttaagttacagatgactatctgcaagagaatttctgctgatcaggaggtgcaacttcaacgcaaaaaacccccagatatcgcaacactttttttttcagtacttggagaagctaataccggtttcagaaaagaaaacaaaaggtccctattcagatggcgattagcagcatacaatacatacatgacgacatgaaaactacgtatgtacgctcctcggcgacagggatgcggcaacgatttgggagcgtgagtgagcgtcgctggacgcttcgcgcgttctctcttatttagcctcttgcacgtagccgtttgcttctcgccgtatttttgcatgtgagattgcgagcgacacatcacggtgttcctgctgctgacacgccgatcgatcggcctcgttctgaaagcgccaggacaccagctgctgggagtatataagcactgggacttgtgattattacgtgtagatttcatgtaagcgagttggttagtgagtggttctgaggaagctattttgggcatgaatgattatgttgtttttttcccccaaagagaagatttattggttattagtagtttagtactttttgaatgaactttgctgttgataagtgaaaattctttagtctgaactttaatttgatccctctctgaattctgctgcaatacggaaatgcagctgaacattctgaatactaatcaaaacctcaacttggaagtcattctaaactggtcgaatgatcagagcatctattgggaatcttattggctaactcgtcatcaagcttagcatgaaacagtgaacaattttgtcacgcagacaggatgcggtttaaatgcaatgcattaaagaagtaggaacaacaacaggcaatgccaaatgtcattgaaaaaagaagatcagagcccagagggcatctcaagattccgaagagaacgaatcaaacacaaaagctgcgatataaaagcaaatctgaactttgaaatgttgagaaggttttagcagtagtacctgagttggcaatgcagattgcagagttcccacagatgatcaggttgggagaagcttagcaggtgactgaaactgcagcctcccagaccagctgctcaattgatctcttaagaaaagagcctccaaaacccagcaagaagcagctttagtgcccttaaaagcagctattatttgcagattaagctaagtgagccccctcatacagttcccttccctctctaaatacctttccctgtcctctcctcctttgcttctaaggaggttcttgctccctttttattctcttttattcaatcctggggtcacacggtctcttctttaatttacaggttggaacagtgtatctactttctcatgaacataattttctcagtattagccactgaagaaaaaactcttatcacattaccatttggccatgtgcttgtgcatgtgcactagtgtacaaaggtgtgactggtatctgacttctgctcatccacacagtaaagtggcagcatcttttttagaagagctggacctttgtaagtactgatcactgactagctcatcaagatttgcagattattgcagggttcttgctgcagtgattagtctctgggaagtactgaaatgttattactgcctatgactttggttactctgaatatctaacattgaagaacactgaagaaagatgaatagttcatggacccttacggcaactgctttgaggcttttactcaactcatgtattagtaccaagtactgtactgtacttagatgctgcttactacggcaactggtacactgcagtattcagctgtatttaaatacatgtacgtagagagaagcatttaagtttgatgtcttgcgtatcacccaacaattagaagtggcttgacattatagctcataagttttaacactcaatcagaagaagcatctaggaaaagaagcatcaagagctgctacttatctttacatgacttaacactgactactgctgaaaagatctgtgggatactgggatgcatgtatgcgtaatcatactcaaaacccttgctaacctgggcatggctggcataattgtttatgatgcctttgcatcaacactggcgtgactaggacgattgctcgtgactttcggataaggaaggcgcaactcaatttggaatggaagtatggaacagctaagcttgtgcccagaactggacttgtttgctcacacttccatgcagcatccagctgaacttgacactgctttgaatcaaactgagtgcattgctgggaggatatgcaattggcaatgattttctgaaaactaacaaaatacctgtattttactaaggtaaaatgcatgtgcttatttcaatatatgttattcacttgaatcaaataaatattagactgttgcataatatcagaacaaattagggattgatttataaaacgtgtaaaggtagtggcagtgagtcggtggcaaagttaccatcaccactatcgtcttttatagtagtactatagaaaatacaatgaatcgtaactgatgtaaggtatgagggtatgttcgagattttgtatatacatgaagagctgtggatatacattagaagtttttttcaaagtagtctttcacgtgccagtttttatgagtcagaaataattacgaaaaataagataaacggagcggtcctggctgttatcactagaggacgtccatcagtcataaagattcatgattatgcttagccaacatttggattgcaatcgtgactaatggattgttctgaaattcttttttgtgtgtgcattccctggaaagaatatttttgtatgtgaataaaagagtctcattgcttgcttcatggtgttagttcatattccatgcttaattcaaaggattcttcatatgaagataacatcgcactaacgtttcgaaagcttgcaacttcaattcatttggccattcgattcagtgcccatttttcttattggcattcggcaaggaaatctctagttttccagttttcagaacaactttgcttatacgagggaatgaaacactcaaagcattgatcaatttcagttgcttggcaaatggccgaaggaaagtagaccatatagcgtttcacttgtatcataatctattctcatttgaaacttaggaatttgtcaaagtggaacactactttcctttataaagctatcctgaaacaacggaattatgaaactttagcagccttgaagatgcagttcttgttggttgagcacaaaaagactaatacgcagtagtattttttatcgtacacttatcgtacgggcatgttcagattgtagccaaaataaaccttaccaaattttggcattaccaaaattttaacaagatggcaatattgctaaaattttggcaagacttcttatgtatttatcaaatttgacaacaaactaaacgtaaacattttttttgcaactttgccaaaaaatgatattatgaaaatgacatcaatctgaacagccccataaattttcactaaattaatttgaacgcgacattggaagtgtggatgtcatccaaatctacagtactaatatgatacagaaatgagaaagtgaaaacataacgggctgctttgacagaagccgattttgacttcagttacagaacggcgttaatcaaaagcccgtatcagaatgttcagagggtgctaccctgatgtttacagcaagtcaataaccaagaaaaccttcctctaattaattttaaaaaatgaaaggagggtctttttcagatctgataagcagattattcaagaattctgtcgaagggtagcaggtgatagatcatatatgagcagcagttttttttccccaaaagataagggcaaaacactatgccaacagcttctgaagtctgaacaatctgtgtaccgctgaaagaaacaccaccaccggttttcagtctttctaatgaagcttcagcattagctaaggtgtcagctgattgctgagtcttaattacaccggcattagtccatcatcactgactcaattgtctactaatgatgcttgttagtttgtagtaataggcccatctctgaaagcctgaaagcaagtgtcacctacagagcataatatggccactgaaggcttaccttcagttctttaattaatccagatggaggttgtcagtggagaggtaattaaacctcactgcctagtagatgaataaaggattagaaattagtggcagatttctctgcataattgtaagcatgatgcttacaaagatttgtgtagaagtgggtgcatgttgtggtgtggatttctcagtagaatgctgatggccttattatggcttgagacagaaggaacatacatgccatggctcatcatactggtaatcaaagttgttgccagtgatgcttggtgattaggtctcatgtcaatcaagcttatccaagttgatgataatagttttattcttttgtatgcaatgtgaatcaaaacggggtgttttctaagatcaggatttgccctagcggcctacctagcaggtgttcagaatgtttcgttctgcttgcttttagtttaggatgttccccagcctaacagagacatgctttggacaagcaaagttcgtttcaaaacaagtcgtggtctaattaatttgctcttgacaaatttcagtactgagacgaaacagcgacatatatatctcctaactaatattgtttgtcgtgtgtctcgtgtttatatcagtgcgaataaaagcttgaaaggaaattgtcaacaagggaaaccatcactattagtttgttctgcctgtccgagcttaagttaaaagcaatatgaaaatcctaactaacagctctaagaaattgaaacattacatcaggtaggtataagctaacacttgtttctaaacaatatttcaagtgataatctggatacacgattttttttttttgccaggccggccaagaaaggccaaccaaatttacttaagattgaagaatatatacaaatatacaaagttataacttcaacaaaaagctgtcgaagtaatggaagttgtcaccggagcaacttcccaaaagcaaaagattacactaagagactactctcctatatttttgaaaaccccagcttccttccaaatcgccacttcctatttgattgaaccaaacaggaaaccggctgagcgccgctggttttgaaacacacgcgcatttctttccttctaaaccatccaacaaacaagcagcacaaggctgtcaatggcgtccctgtagttgttccgaaaattttgccgcatcgctaaccaccattcgcccaagtccaagcctgactcagatggcagcagaaagccaaccccaatccagcccttgatcattctccacaccctggtcgtgtaggtgcaagacacaaataggtgttcaaaatcttcatcacccaccaagcaaagttggcaaacctgctggtgcggccagccacgcttacttagattatccgccgtgaggcatcgccctttttctgccaaccacataaagaatttcacctttgacggcgctcttgtttgccaaatcagagtaccacatcgcgccaccgtgtttgtcatgaagaatatgctgtaggccgagcagggagtgtattatccatttggtgcccacttccagattgtctcatcttcctccccatcttgaagttgcaccccctggaccgcgtcccaaatctgaaagtattccccaattgcgcgattggaggatgcccccttgatgtctcgtacccacctgtggttcagaagccctcgtgccaccgtcaagcccgagcgctcgacatggctgaagttcaaggggaatctcgactttatgctccccaccggcaaccagtccgccaaccaaaatttggtgttcttcccatcacccaacacttgtctcgttcctgcgaggtagaggtcttgcaagtctttcgactgatctattggaactgttgtccacggcctgtcttgttgttccccctttttaccaaccacttgctttatttcgacacgattatttaagaaagaagctaaccgtgctttatttcttcctttattcaatgtcgtcagaatactactcaagttcgtcaatggaattagaatatatggagtcaaatcaaaacttgacttgacagactaagttttgttgcagttacatcaaatattgaaatgcagcttggaggtattgtattgtcacatgcaacaattttccaagtagttctcaatgaaaagacctgaagacggtagaaaggtgtacactttgttttctgattaaatcatcattcgtagtgtctaagccaaacaaagaatataagaatccaacatgtgctaaatacgatgtcataaaatacgtataagggtatggtagattggtaggttgtcgtgcaaaatttaatcagcacatgtctgtatagcggaacaaagacagacatcgtttcacttatgttgattataagccataacggtttgtttacgtcggggcgtaattctcaccaagaacaaccttgctaaaagaaattggaaaggcagcaagacatgttgtttctgtcacaaggataaaactatccaacatttattctttcaatgccgcttatctcgcttggtgtggtctgtaattcatttggcttctaatctgaaacctcctcgcaatgttggtcatatgtttgggagttggctatcatgtgtccccaaagaaatgaggaatctgcttttgatgggtgcaacagctctgtgttggtccatttggctaagcaggaatggagtaatttttgataacaaaatggtgtcttctcctttgcaggttatcaccttagttacccggtggctacgtacctgggctatcctccaccaactgggaccgcgggatactattatagtggtatctcgatgtttggaccaggtggcacaggagatttttacccagaagcatgggtagcggtctagtctacggattgatagccactaagatatacggtggtatctcgacagttggaccaggtggcacaggagtttttttacccaggagcatgggtggcgacctagcctacggattgatagccactaagatatatgtttctgtcaaacttttatgcttgggagatgttctagttgtttctttcttcttttctggctgtgtgcattttatgcagaggccggggatgactcagtttgtttgtatcatcttgatataactaactgagtctaaataaagcttccattatctaaaaaataacggtttattagcaacaaaaatatgatttgtgcatgaaacttatatatacatgttgttaacaatttaaaagaaaacagtgaaaaaaattacgatgaaaaacaattcctaaaattaactctaaaattaataaaatttaaatttaaatgcggcttataagctgaagggtaaagtggcttttgttcagacaaatctacagtagtcatacttctaatcatactgaccgaaattttaactctcctaaagtcctaatcttaccatgaaaaataacttaatattatgctacgtattgaaatatccaggaacttctccattaaccaataaaatttcagtattatctgttcagtgactggataggagagcagaatgatgcacatgtttgcacaaccacctacaatagtcgtcgcctaaggaaggacctctctactttctggtgatgacgcacatcagaaattgaggcgtacaaacacaagttcaaagttcagaaaaatggacatctgcgctcactaggacacaaaagttcagtcccagttgtgagtagtgacaacaacatgacgatgtcagttacacctaaaagttcactaaacatatatcctcaaggtttgagcaaatgagcagttacctaatccatcactagcaaagtaaaatagaagagtgaaacattgcttcttatcatgaaattgatacacagcacaaagcatgcagtactcaaatgctcatggaaacaaagtttaaggcatatggcactttagcaaatctgaacaaaatagcagaacaaaacagcagattctggccatatatatagtggttctagagatactatccagtgcattgtgagaatttcagttttcacctaggtggcaggagattgggcaggatgatcaggaggcggcttcggtcgcggcacgtaaggaaggagaggagtgccatgctcaattggacctgccccgatagtcgccttggagcttggacttggatcaacaggtcggtagtcatcgatcctgacattttccaaggcccttgtctttcggttagtagaagaaagtcttctttcctgagaaagatagatgaaggaacacgagttatgtagaagtacaagtactggattgccattatggaactggagaaaactttccaactaactttagtatttcttataataagaaaataaaatcaacatcaagggaaatatatacagctagtatgttttccattttctgccagaaactgaaagtgcacacctgtaatctcctgccgtttagctcaatgcttccataggtttgatgatctgctatgaatgtagcaaaaatgtcatccattgtcagtacattgtttattgccaccacataatctaaacaaacaaatgctaaaacgatgagcctacatacaaaggactgaagaaaccagaaccagaggcagccaacgaacagaagtgggtacagcaaaaacccaagtacaactgatggaaatccaaacattcattcgaagtgcagaatgaatcttacctacgcctacggtacctaagaacgttggaatgtcaatagcatcacatctcattcacaatcttttcagagatccagcatcaaacatgaaccaagaaccaatggcagatataaccgctaaagctaaaggtacagtagctatcacttttcactcaaccaatcaagacaaagtaaaagaggacaggaaccacacgaaccaagtgagtgacaggagaaaaacacaaagagggcaagagacagagcagagagagccatcgttttctttgtgtacctgaggatgtcgtagtgcttcttcttgcatccaaagcgatccctagcaacatgtttcctcctccaagaaatgcaaagagtagcaaaaccaacagaggaagacgcttcatcttcatctcccctgcaacaccgtaacttcagatgcttctgcaccttcctcctctcgctgcttcctctttcaaaagataacgaaaggtccatgcgtgatgtgatttcatttgcattgatcgtaaggtgtcagtacatgattaaaaaaattgatgtgataagacggcagaatttatggtctcgccaacaccgaggagcagcagcagaaaaaatggccaccatgcattcctctgttgccagcacctcgcattaattgccaaccgtgcaacatgtacagtagcgcaggagtatcatatgtccaggtttttcgatgctcagggcttgttaggcagagctccagctccacccctcctgaagctggagctcagccaaatagtttcagctccaccaaaactggaagtggagctgggtagagctctctcacaaaatgaactagagttgtagagctaggtttatgcaactccacaactccactccagactcaactcctggagttaaatttaggagttggagctgtaccaaacaggccctcataaacttcagatacaggggacacagaaatctgactgcaagattgacagtacagggagttgaatcaaagcatcagaacgaagtatataaatccacaaaaatgacaacctcagcaaaaatcttcagagctgaagcttgtaaataacaaaatgaaatcacatttgatacactagtattacaagggtataggaagaatgccggcacggcgttataattcttttcccatatgctcttcatgctgcccatccagtgatggtttaaactttgtcactgttccagaatttctaaacgatccctatctaatgtcatctattcgggatgatgtcgttggagccttctagatcacaagagcgttcaggacaatccagcttaccccaccgtgcatttactctctggcaaggaaatataggttttccaaggctgcaaaagacaaccacaaaacgctcagatattgtgaataatctcatcatgggagggcaggaggccatgagattcagcaaaatcatgatgttgtgaatgaaaacatctatacttcaaaacacataccccctttatggtaaaagggtgccttaattttcctctttttggctttgagaccttatttttgcagcaactctatacgaacaaattaacaatgcaataccttaagaaagttcctttcggaatggcaagtcaacagttcaaacttgacaatatggacttaccttcgattgaccacattgtgcacgtagcataaccactgagagaattcagcctgagatcctgcctgcacaggatttgctctaagcaaaaagaacataaagaagtcagttcaatattgtgccgagacagtttattgttgctacattgagcacaaacatgaaaatttaagggcagcacaagaaaaaaacagaacaacagaaattggcagctggatataactggaacataataaactatgacagcaaaaacgacattataaccataaaagtaaatgaaaaatagctataagagaaatgagcttataaatggattgttacatccaattcccacatcccattatcaccatagcttctgtaaatcatattcccaaaaggtacagatggtgtaaaataactaaaaagtttttaaacgagtttgtggatgcatagctttagaatataaaagatccagaagcacagtttcataatgcaaaagtacaaagaatttatagttcctacatgatgttatatctcgccctaaaacaatgaatggataaaggttgataatgtattacataccaacatttcaacaaaacatagtcctgtcacacagaaacacatctcgaggaatcaaactatcaaaatggatactataatttatgctagtggttggagagcatttcttactttaaaacttctttgaagtgttccgcacattctttgcaaggatagagtctagatattatagccatctgaacataaaaagcagcagaaatgtgaccttgcatgaaccaagtaaccaagcaaaaggaataatgagatgcagaaaaatgtaattcttcaggaaataataaaataattcctcttcgttaaagcgagtaaaaaaccagtgaacgaacttcccattattcatcatggattgaggctcaatttgcagttgttgtgctggcctatgcttattttttaagttttcatggaacaatttgtaaaactcagttatccaatttggtagactcatccatcaaatttcaactcagatgttttatatgatgataatgcatctgtatgcaccatgattgagaaaaaaaaataacagctagccaaacacccatatatctaaatgaggttcaatcaaatgagatagtcgattccaaacgaaaccttagcagtagtcgtaacatactgccacccattttcaacgatgcaaagtataacatttatttgtcaagcaatgtagtggtaattcataactgtgctagaccaaaagcacaaaacactttctaaaaatgtctaagctcaaagttagcggggaatgaaccaggagaacacctagaacaaagcctgcatcctgtagcaacaaaatcacgagattaccatgctggaactttactgtgcagtcttaaagtaatcttgaatatttcaaggcacataaagaataaattaaatacaagctatatcttaaacaggatccattgcaggagaatacaaggcccccaagataaacatcaagaaagtgccttttctaagattcaacaatcctgtagttagccgtgacaaattacgagtgggtagcgacagcaaggtcctcatgtttcccccaaaatcaaaacaagggactttaccatacttccacccaaactctagagagatatcactaactgtttatcctgcttaatgcttaccagctctctcgcatcgcgtctttgttgcctggttggttcgtcaggaaactgaaagacaattcacaaatacaaacacgagttaaccgtagtcaataccagactgcgtactttcaacaacttgcagcctattcacaagtatgtcaatcaatctaacaaatgagtcacggttcgttgatgtgctctaaattcacccctgatgctacagaacttactagtgcgaggtaagtacataaaaagctttcatatgctctgttgtgctactcacagaggcaaaagatcgagcacctgcgctgcgatggtgtggagcagcatccacgtggccctgccgacctcctccttggtcaggggcgccgccttcgaatccttctgccgcgcatttcacccccacaacaacacaagttcagaaaccccctccgccacaatacagcaacggagagataacgcaatgaaggcaaaaaaaaaaaaacggagggattaccttgaggacctccggtggcggcggcggcggcgacggcggggtgggcggaggggagagggagagggagaggagggggcggaggcgtgcttcgtcgggcgcggcgtcgggggcaatgaggaggcggcgggagaaggccgcgacggtgtggacgacgggctccagcgggttggagccccacccccacgctggaggcggcatcgcggctcgcgtggaaatcgtacgacgacggcgacggcggcggctgcggatgggtgaagccgtaagcgaggtcgacgtcgacgaggaggagaaactcgagggcgtgcggtgcggagggcgtgaccgcgtgagaggggggagacagctaggaagggaggagggaggggaaggcgaaaacggcaaaaccggtgcgtttccaggaggaaccagttgatggatttggacggtggtgttcccgtttcacgttggtccgtgggccgcccgcgggcctcgtttgtgcatgccgtgttgcgtcgaaaacgtgcggtgcggtttggcggcgattccggccccgatagaaagtttcggtgcggcccggtttcgacacttcggcacaaaacttcaaaactacgatatatttcatctaattttgttagatgaaatatatcctactacgaatctgatatgctaaaatatatctcatacaatcaaaacttcttgtattttggaacaaaaggtattttggaacaaagggagtattgtagagcagaaatattatttgctaaaatgtggtctggtagatattagctgacatagtttctcctctttccaacttttactccctaattttttgcgtacacgttttcggatctatactacctccgtttcaaaatatagctacgtctaccgtgcatagtctcaagatgaagttatttcttcacctatcatctcctctcaatcaatcataaccattctccaattgattttttttcacttttctcttctcaatcaatcacaacctttctcatttacacatatttcaatacccatagacaactcagaatcttacattttagtatggatgaaatatttttttgcaaaaaaaatctatatgaaaattactttaataaaatcatatgaatctaattttcaagttttcttagctaatacttaattaatcatgctttaacgagtcaccctattttttgcacgggaaaaataagttctcaacctcggctaacaaacacagcctaattccacataaccgtcatttttgctcattaagtgctcgtagggtcaaaagtacagccctggtactacacttccctgcgatcagctggacaagaacctcttcgttggggcaacgacaataattctgggggacgggaaaacaaccagcttctaggactcgcactggctcgagaataagagacccgaggatatcgctccagctatcttggcggcctccaaacaaataaccaggactgtgcacgaggctcttgcccttaacacctggattcgggatattgacctactgcgtactatagatgcagaccatctatgctagtacgtttgtctatgaaccatgatacaatgcgttggccctctaaccgacctaaaggacctcgtcgtatggaagctgacggcaatggaatctactcttccagcacggcgtagaggctacaactccttggagcggcgggacgatttacaaccagaccatttggaagtgttgagctccacctaaatgtaagttcttcttctggctcattatttaaaacagagtctaaacggcggataggctaaaagaggtggtgggccaatcaacatatttgccccctttgtcgcaaagtaccggatctgtccaaaagaatctggactgaaatgttgattggcccaccctccctagattgcatgtgtaaagttccaattgcatactgtccagaagaatctaggctgaaatataacggtggacaggagcagatctccgattgcaagagtcggacggatgtgcgacagttgaataacggtagtacaaaatctcacgcacgatgagctgctggtaattatggtgcgaacgaaatgccaagatttttaggcatgttgcctccactcccaccaccatcattgccaaaatcaaagaggaggcgcatacttggatcacagtgggagcgataaaaatcacagagctaatccctacaggagagtagcgccttattgtttaattttgcgtgcccgtttgtttttgtcccactctctgtaaatactttaccattttattcctgctctatcactataaaggcctggtttagttcccaaaaatgtcacatcaaatatttggacacatgcattgagcattaaatatagataaaaataaaaactaattgcacagtttgcatgggaatcgcgagacgaatcttttaaacctaactaatccatgattagccataaaatgctatagtaacccacatgtgctaatgatagcttaattaggctcaaaagattcgtctcgtggtttacaggcgagttatgaaattagttttttcattcatgtccgagaaccccttccgacatccggtcaaacattcgatgtgacacttaattttttttttcgcaaactaaacaggaccaaagtggcgaaacttttgcccttcattcagaaaaaagtacagcccatagccgtcggtccatgtctttttcacgactaagtgaggagcacgatgcatcgatcgagcgggacatggtctgagatgttctctgtaacacgccacgcatgacgaatgggtacaatattgacaattaattaggcccgacggtaacgttcacgcaggaccagaaaaaaaaaaccctcaaaaaaatagcccgtccgacggccattacgtgaccggaaccaggggcgcaaaaccgaaagcgacgccgcggccccgtccgtccaccatccaaccaaccaacggcggatccgtcgaatcgccgacgcgcgcgagaccgcgaaccgcgagacaccgatacccagcagcagtggcacctgcacggctgcacagcagcgcaggcacaggcgtgcgtatgcataagccgtacgcccaggcaacgcgccaatggacgagagagacggtggctgtgacttgctgttggggcctcaacatcagcgaggcatttcatttcagtaccagtcaggaggcagcagctgccggcctcgtgacggcgcccagtgcatactacgtgacagggcccggcagaggcaggtcgaggttgacggtgatgaacagatatttcggatgcatgcatgggtgcagccatgcgtttaagcctgctaatgggttgggataaagtgagtaaaatggattgtttttaagtttgggttgtctttggttggatagaaatgggctgaggaggctaatgggttggagcggattggtccacatgtggaaatggattggattggtttggtttttaataggttgggttgaagtgggtaaaatggattggttaatgggttggagcggattggtccacatgtggaaatggattggattggtttggtttttaataggttgggttgaagcgggt

SEQ ID NO: 60420 - DNA, 1150 bp, Oryza sativa
tcctctcaaactcagaactttttagttcccaactttttttaaaaaaaactttcaactttaaactttcctacacacaaacttcaacgtttcggtcaatttctttaaacttttaattttaacgtggaactaaacacaccctcaaacgttaattcagagatgagataatctcatctcatgaatcattaagagccatcgttttgttattcatgcggcttatctgaataaaacttttatatatgtgttcttaacgatctaaaagtaaagattgaaaaataaaatttgatgaaaaaactcaaaatcaactttaaatttaagattgaaaattcaaattttggctgataagtataagcatgagcgaaaagatgatgcattttgtcttctttgatttattcatgatttcttttcattttctaatgaggatgaaaaacttgtctggttcatttctttattgcggagaagtggcccgagtagtaattgcaaagtaactcaaaacattttcaagctgaaactaacccaatttcattctctaaaactgagtaatggggattccttataataaaaaaaaagtagcagcagcagcgaaaaggcaggggaaacttagccgcgtaggtgaagtcaagagacgataatcaattaaagatgggggcaaaatcatctcgaaacttcacggaaaagaacagtaaattactcacagccacagacgctgacacgcacacataaagagcatttgctttcaggccaagcttcacggccgacctgtgaacatgcgcctctccacggagctaaacccatcatttttttcccacttttttaaacaaagattttcttttttgaaaagaagaggaagagatcattaaccaaccaactgaaaaaaaaaatcaagcatgcatgcttgatctgcatcagtaaaattcgcataactgaacaaaggattttgattgaatttaattgaactgatccattcattcctctgaagaaaaaaacacacaaaggagtacagatactagtagagtagtagaaaagcaaagagcacatcacacatggcttcctagccaagccctggatgattctgattctgattaccctagctctagtgtcactcgatgcgtacgcgcgaaatagtggcgtactatcactcgatccgaagagg

SEQ ID NO: 60421 - DNA, 1731 bp, Oryza sativa
gggaaggcgtgagaggtgtaaattaatcactagtggacgttgacggaccatcgtttcgtttattcgcgaaccgtaaatgaaaagtaagagtgaataaaaacttttatatgtgtttctagtgatctagaagcaaagactaaaaaataaattttaataaaaaaaatcaaaatcagctctaaatttaaggttgaaaattttaaatttttacggataagtattagcataagcggaaagatgaggccttctcctgcgcctaaattctcctccaaagttaaccaaactctacggtagagtttgagtttggttgctgggatgggatggaatggaacaggatgaacccatttttagaggtgtttggttgaggggtgagtgggatggattggtcctggagaggaatattcttcttagatccgggaccaactgatccgggaaaatatgacggaccaacttgggatgagcaaacggcgtcacaacggcttctcgcgtgctcgccgccctgctcgccgcttattgtccgcgtgctcggcgtgatggtggaagacagctcgtgtgacagcaacggcgacgggctcagcttgggcgacggcgacgatggcgggctccagtggtggggagggcgagggaagcggcggcgggatcggcgacggcagcgggtggcggggtgctcggcgacggcggatccagcaatggatcaggtgcacggcatgagcgtcgtccttcttctccgcgtgctcgtcctcccgctgctctctcgcaagcagccagcctgctcgctggccgtgctagctctcccggccaccggtcactgccgattggtccgattagagcaggcgatggtggcgctcgacgaggactcgcgctacctcaccaaactctcttgacggtaactgcaaacggcggccattccatcccttcctcgccccttctactaaacaaaaaaaactgggttcattccatcctttaaatcaaacatacgaatggaatcatctcatcccaaaatctggaatggtatcatcccatcccacctagtcccagaatcaaacacacgctacaagattaggctttggtttcaggtttagggtgtgtttgttcacgctaaaattaaaagtttaattgaaattgaaatgatgagacggaaaagttggaagtttgtgtgtgtaggaaagttttgatgtgatagaaaagttgaaagtttgaaaaaaaagctggtaactaaaccaggccttagttagggtcgtgtaagctacggtttagccgttcactttgtttgatacagttacggatggagtaatattttctttaagctggatgtttttagttttacaaatctaatatggatctgaatatatgatcatataataatattttgataaactattctgtttcacttataaataatttagcatacaaatttcaaatccagtataaataagaaatgtgaagttgtactaaacaggacctgtcttcaataaacgtatgataaaaaagattacggataaaacatttatatttataatcttttaacggtttgaaactttaaaagcaaatgttgaaaagatagacttttatgaacccctaaaatcaactttaaaattaggcttcaaaaattaaattctgtcaacgactgattaaaccaacgcaggcttgacttcttttctgaagacgcaggaatgtcgattggttttcagagtttcttcatctttctcttaaagttcaagaagcttgccagag

SEQ ID NO: 60422 - DNA, 2045 bp, Oryza sativa
tgtgcatccaaaactgcaatgacatagatgaatgagtgatgctagagctcacggtgccaaaaaagtgtggagtcggcaaactgataaaagtccccaatatcttgaaaacttccttgcaactttgttaaacttaaaactgagtggcgatggattcatgtcggtcagccggtcaccaacaatggtgcaacatctaatttggaggactgaatactgttgttctctagcctccgcagcactgtagcattcaaaaattggatttagttcaaatatgccaacaacctgattacctgaataatgttgctttctagcctcttgtagcattaaaagaaattggatttagtagaaatataccccttcactctagggtagtgcagaatattccattgattattgatctgtactggagaccaggcgtttagtacatttagtaaattcggacaaaagttagatgaacaacttatgtttcaggggaaaataacacgctaacatctcataattcaggtttagaaaataaaatacacccatattaaagtacagttacaatatatttgcttaggctaggaatttagtcacaacacctttcagaatcatcgtcccaaggccgatcgcgatcatcagaatattcagaatcacgatgctatcttcttttgcttctatcacggtgatccctgtggcgatcatggtccctatcattatcaccattttttaaaaaacatgagaactcattctgcaacacagaaggtaatgggccgtaattttgtaaacgtgcgaggaaagggaccaataaatataatgagaataagtgaatagacattttggccccaaggtttgcacataaggaagttgcagcatttttccaaaaaaaatatttcaagcaatgtaaatctagaggatatttttgccagcctaacgatgaggccctcagctaacatatccccagtgcagggttgtcattttaaacatatcagaatatgctactgctcaatgagcaagttgattgtaaagtgtgacctattggaaaacaaaacaactttacaatgagcaagtagattgtaaagtgtgacctattgagaaattattggctgaggaggatgaaaacaattactttaactcgtctgaattgctagaattgacaattaaacccatcttaatcctttgggcatttcatcaaacatatgtcatgcacgtccaaatttgcaaaatcgacagaagcaagatcagaaaccacctttccacccatatgtggcagcaatgatcttcacgttacccatctcgtatagggaggatctgcacaaataaagcagtaaaatcaggagccaaacccaccatttaaaccaaagacatataatcagtagatttacctcttttggtggaggaatgattctcagtatctcacctgttgttgccgggttggtagcccgatccgccagccaaggactgaagaagtagaagctggtggatgcggtgcaatgaagaggcagaaagaggtagcagccaggcagcaccgcggtagtaatcactgaaccctccctcgagctcttcactgctcgccgttctgcttctccgtagcacggttcggggtggacacggaaataagcaccagtcaatcgtgacaccactcgaaccggaaccctagccacccaatccccgcaccgcgacactcgaatcggagcccaaacgacgccgtacagaacttcaccttagaggggagaaacttcgagggaccctcaccttcgatgatcatcgccatctccacgagcaagtggcggcggcaggcggcatgacgatccgacgacgacggaggggcagcacgtgagggatgcgacgacagcggaggggcggcgcgggagaggagagaaatcgagcagcggtggacgggggatcaaccgcgcgcgggtggggcgtcggcgtcgccgggtgagtgcgagagagagaggagggaagagccgagcgagacgcgggagggtgaatgcggcgtgatttccggcgtgaggaggatgggtgcgaggaggggaggggatgagagggagacgtggggtaatctg

SEQ ID NO: 60423 - DNA, 1164 bp, Oryza sativa
ttagtacctaatccggtggcttgatcaaacaggaggccgacttttgtgcaggcatccttccccaaagggtgacaagaaccctgtaaactatgtcttgggtttgcatggtgcatgagctaacgacaatgattttttctgttaaaaaatgggttaacgacaatgatccagacattagaggtagtttttttatttgacgaagataacccactcctgaatcctgatagacatgagcacagcaaacactgggggttgttctaaaagcaagatggcaagatgcatatatatgacctgtcataggtcaaatgcttcattcagagttcagacacactcaacctgcatagctcatcctactctcttaactctcaatctctcccagcttcttcaaaatttcctgcgagacaagatgaggatgtccaagttgtcaatgctactgctggatcttgctcctggtagtgatggccatggaggttgagggcattcgattggatgcagaaactcgcgcagcaaccagcaaccaaatggtcaatgtaagtgattctgattcactgaatttgttcatcatggaattgtcttctgttcctttttcttttctttttgtatgtgtgtgctgacatatttgttttgttctgaaaaacagaaatcgacagagaatgtgccaaaggattccggtgactcactaggcgaggcgaagagaagcattgctgggaatgaagttagggctgtagcacacaagttacctgagttccatgaagactactatggtcccagtgaccatacacctagacaccactgaagagaaaacaatctttttttttcttcttctcaatctttttgttcagaatagattagatattagctagtcagcggctgcaggttgtagtagatactgaatttcatctgagcttagttagtaagcacatgatggtagcaacatgtgaatctttaacctatctctttttcccctccttttcacctcattagtgaaaaggagcggttttcatgtactgacttgttgacaatacttgaaagcaacaatctcaagacgttgtccatatctttttgtgattgtgtttgttcccatgatcagcgcatagcttaatgtgacgattacaaatccacaaggatgtcaataccatgatgtcgctgatataactggaattgact

SEQ ID NO: 60424 - DNA, 1289 bp, Oryza sativa
ttcctgcgcccctgacacgcatcagacacgattaattaatcaaagtcgttctcatcatgctgcttaactaatcaagcacacatggagttgtactgtggatttgcattaaaaaaaaataataattacaacagaatttacactgactcggatcactgtctggttgcctccggcccaggcaatttaactacacttttttgggcgatctttcccagtttctgttgctgcctgcctcgatcgatcaatcgcattcgcgacgataatctcgtcctacctggactaatcaagtccgtttcctcccgtaaaactcggagaaccaatcgcagcaaaaacttgctccggtttcgtactgtcaagaccgtgtcaagatctcgatcgagttaactcaaaataattcaagcccggattaattactgtatactacgctgtggtagatctgccctggtatctgggtaagctgtgtgtgtccttctaatgctaggtccatttatgcgtctgcaagatgatgatcaggtccaaattaactaactaaccaggataatgggtgattttacttggtcgtggaggttgtaatcaagttattccggctagtcaactgttgacttgccatggccccctccttgatgcagacgtcttgacattttttttttcaaccgctagctggatattcaacgggtttgttgcgtagtagtaatacagtagtactacactactactccactgtctaatgtacaccacggcactagcctttctgcaatttttttggtactcttttaatccttttttattagaatcaattgaaaaaatggtggactaaagttcggttttccattgaatacatgcatggtatcttcacgagaaattttattttatttttatatacttctcttgttgaaatgatttgcaacttgtgtcagggagtggtgctcccccctgctctataaactaggagcagcaaaactattgacaagcaacgctgggggtattttattacagcagaaatcaaacagaattgatttaagtattgttctccctcaactaacaaaacgaaagaaagaaaacactttttttttaaaaaaagccggcggccgctaactgtgtgcctgtgtgcggcgcccaccgttgcgtctcaacatctttgtgtgcaagcttccgtcagtttctacggtgattaaggccgagtttaatttcaaactatttctccaaactttcaattttttctctacacacataaatttttaactctgtcacatcgtttcaattttaattgacgtgaactaaacataacctaa

SEQ ID NO: 60425 - DNA, 878 bp, Oryza sativa
agcttgacgcgcgtcggggaggcggagcggtagtgcgcggcggagaggacgtgcccgctcggccgcctcgtggccgtcgccgctgccgccatgggagatcgccggagtcgggtggattggggagcagtggcgacgagaggaggagagggcggtttttgtgcttccgggttggtggttttggcaaactgagcggaaatggttttggcggttatttatagggactggttggggcagttccgtaatttactgccggttgggggtgggcccggagaactggtccgggcaggtgtcaaggaatggtggttaggtcaggttaactaactgtagttaataaagctgtgtgcgttgggccccacatgcagcacaccgaaaggctttctccaaccggtcccacattcaaggtaggattccaaacttcttgtttcattgcattcgtcccataatcgtgtatttccgtatctaatgtttaagcgtccgtcccgtttaaaaagtttataaaaagggtgtagctatatttatggcgccatatttttcatcaaaaaatagtcggcatgtatttacattgtaagttcctaaattacatatgtaattttagtgtatttacaatgtaaatctcaaaattacatatgtaagtactaaaattacatatgtaaatttgaaaattacatactaattacatatgtaagtggggtgtaaatgaggtgtaactactgtgtaagtggcggaaaaaaaatcgactatagcatattgcgccatatttctagcaactccgtataaaaattaaaaaatcacatatgaaatactattcatttttatcatctaataataaggaaaatattaataattttttaaataagatggacggtcaaatattggac

SEQ ID NO: 60426 - DNA, 1095 bp, Oryza sativa
  unsure (1)..(1095): unsure at all n locations
tcctgcagccccctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcatctcgtgccggcttgtggttgccggtggcaacgccctgggcgcctctgcgggcgccaccctcggcacgtcttcacgcccaccgtagctggacacctccccgcgccttgcgcggcttatggccgcctgtcggggaagatgactcccccttcctcccgtcaccntgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgcc

SEQ ID NO: 60427 - DNA, 2008 bp, Oryza sativa
tgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggagcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaggcaccacaagcccaagaccaaccagccaagacttattcctacacttacaatcctttaccacaagttcttccaatgatccggccctgccaaggtactccagccactccacgttcctactttcatgcaatcaacaaggtggaaagtacaaagactcttgcaaccaactgccaccgagagaagccctcttgaacttattgctggtgcaaagttcagcctgaaagaccttagtttcttgcaataagccagatagccaataccagaatcatcgatataggagcagaagtttaatgtgagatcggtcagtgaagagcagtgagacgaaagcacaaggagcccttggttgtccaactgcttcccgtggatagatatccaaccagagtaatcaatcactactttccacaaattagggaaccgggagcatagtgatgccaaagcttcagttgccgggtgaagaccacagccaacatggatagcatccctttgctccgcgtcgatagtgtagagctgcttcgacacaagggaaagagagttacgatcacttgtcttggcaatcctcttgatgatctctgcgagcagtggctctgacaggttgtccattgggcaatacggttgccttacttaagcaatatcaatgttcagctggcactacggactggcctaaaagtaataagaatgaaacatatgagatgtgatagtcagatggaattaatgatattaatttagaggtaatactttcgataagatggcaggagtgtttccaattcaactaagaggtagatttagattagcaaataactttaaatgagggaacctccctatgcatttataaatgactaagcaaataaagaatatgcaattagtctaacaacctgatcaactgaattactgaagcagataataaaaagggaagtttctaacaagcaaatgagcagtgcaagtccagaaatactagcattcatctgctgaaactgaactaacatatttggaagcactttactagtaacatgaatgaaaatcacgcgtataacaaggtgcagacgtgcagtgactcattattattttctacaattcactaccttcacaataaacagtacctaggacagacagcgccaactttatctctagtagtctagttggctaagaaacataagaattgcaaactattccgaacccaattaagaaaaacctcaaactattctcgcccttattatctcaataaaaaaaatctcaatcagaacaggggaagggactgaaaacacaactaaaattagagaccggatcatagataccttagagaaatcaaggacctcaagattgaggggttcagagaaggacaatccaagaaaaagaaagaggcgtcgttcttgatcctt

SEQ ID NO: 60428 - DNA, 893 bp, Oryza sativa
aacaaatctgaagtatgtggttggcacatgtaccttttttttacacagaatcaatatgggttgtggttgagcttgcttatatcttgagcagctgagaattctacagttgtgaattatggtaaacatatcttatttgacttgtaccatgagtccagtgaacctgtaaccaatatgtttgtttttaacttcatatgttcataatttaaattttccagtgattttaaaggttatgtccaaaatttaaatgttccactgatttaaaggttagtggacttttagtgctacagtcttacaaacttttggattgaaaaggatacatgtttctattgttaacttaagcttgctgctagcacatcttaattcaacattcctacgtaatttgtcaccctttctcagatcctccgtatgtttcaactaaatagaacatatgtactccatctgcctcaaattacaagtacctatgctattttctaaaaaagagattaaggttggggcgtgagatggttgttattcgttgatatgagaaaataggtacaagtagttgtattttgagacaaatttgaatcttagaggtacctatattttgagacggagtgaggagtaagttattactacatatacaactgaagaattttcttcctattggtaagagctatgtttcatatggcttctctcagcatttcatttccattggctcaccagtactagcatgtggcacatttgcactgcacgggtgatgaattgcggacttgtgaggagtccagctcctccaagaaaaatgtggtgatggattgcggacttgtgaagagtccagctcctgtaaggaaaatgggttgatggttatgtaagatgccttggatcttatgatagtatattaacgtataagcgttgac

SEQ ID NO: 60429 - DNA, 28848 bp, Oryza sativa
tttattcaaatttgaatttgaatttattcaaattttatagacctaaagtttataaacttttatatatatatatagtatttctatacatctaaagtttatacacctaaagtttatagacctaaagtttataagtcaaaagtttatatacccgtttcaaatttgaatttgaattatatctgattcaattttgaatttgaattcaaatattttctatatatagtatttctatacatcttaagtttatacacctaaagtttataaatccaaagtttttaagtcaaaagtttacatacccgattcaaatttgaatttgaattcaaatttgaatttgaattcaaatttgaatttgaattcaaattttttatatatagtatttctatacataattttttctaacttttgtttttttaaaaaaaattgtggtgtactgtagtaggaagagaataaggggagaaggaagggaagaagtgggaggaggggggcggatctgatcgttgggcgatcgccggaagtgggtaacgagatatccggagttaggaacctgtattattggaagacaagttgggaatctattatattattaatggaatagaaaacgaagcctccacgttcgctgtcatggcctagaaattctcacattaatcagagaaaaagaaaatgcagagtccatatagaaatacaatttagaaatagctgaaattcggaattaaaaaataaggaatattagaagaggagactagagtccatgtagaaatacaatttagaaatagttgaaattcagaattaaaaaataaggaatattagaagaggagactagagtccatatagaagtacaattaggaaataattgaaattcggaattaaaaataaggaatattagaagtagagtatagagtccatatagaaatttaaaactaactaaaattcggaataaaaaggagcctccacgttcgcttttatgacctagaaattctcacattaatcggagagaaaaaaagcagagtccatatagaaatacaatttagaaatagctgaaattcagaattaaaaaataatgaatattagaagaggagactagagtccatataaaaatacaatttagaaatagttgaaattcgaaattaaaaaataaggaatattagaagagtagactagagtccatatggaaatataattaggaaataactgaaattcagaattaaaaataaggaatattagaagtagagtatagagttcatatagaaatacaattaggaaataatagaaattcggaattaaaaataaggaatattagaagtagagcatagagtccatatagaaatacaattgagaaaaaaaaagaaattcggaatttaaaaataaggaatattagaagtagagtatagactccatgtaggaatttaaaactaactaaaaatcagaataaacataataaaatgaaaagtagtgtttagagtccgtataaaaatacaatttacaaataacttaaattcgaaattaagaaaaaaataggaagaagagtttaaagtcaatataggaatacaatttagaagtaattgaaatttgaaattaaaaattaaagaatattgaaagatgagtttagagtccacatagaaatacaattagaaataataaaaatttagaattaaaaaaagaaatattaaaagacgagtctagtgtccatataggaatatatatataatttacaaataactaaaatttgatattaaaaataattaataactaatacatatataaaatacaatataaatattatacattagtagtttcgtaaagttattacaaaatttaaaattatgttgtcatttaatatattttaataatataatgagaaaacatatatgctattatatgagagaaaatgtaatgatactagcggcgcaatctgcgcgggccatcatgctagttattagattaaggagggtgttggtcatgctactaaggatcaattggaacaattttttttcacctaaaaccctctacttttaggtttgggaggaatttaggagaaatattggccatgtacttaggtcggggatttgatgatttgccatgctaaaccactcgttactgattcagagtcctgcgtgccattggcaaggacgcaaggtaatctgttgaggggcaaatttggctctaaaatttgacacaagctctactaatttccatgcagagcacaaacaaaagccacagtggatcgagtatcttttgtacactagcgacattatcttacgctgcatgtagatgtaggagtactttacaaataggagtaattttagcaattccacatgttacacatgtgcatgacgggattggaaccctgagtagtagacagaaacatgtacaatcatcatgggcgtctgattactgatgcttcccttgtctgatctcgtgcctcttattgacatcatcacacaccatctctagtcaaattgaactcaaagataaccaaacagtgctgatgattggggtggatttgtaaatccgttctagtccaaaatctgggggaatatgtaaatgtttatgactccgtacattgcatggctccatccatgcatgggaggatggaatctttcttggagtatcttgcttctaattaagtaccccccatttgtcagtggactattggttcactgtacttggccaaaaactgggctctgcctacatggatccataattagtgaaacaaagatgacaaatcatgttcattgttattgtgttctgcttctgcactgctgccccgacagagactcagcaggccaataggttaacgggtcagtgttttcgcactgttcatacagaaaccaaatgttcagttttctgaagaaaaaaaatcaaccgacttttcgctcgtgtgttaggaggggatcaaatgttcaattttctgaaaagatccatcgtttttttttctttgctcgtgtgttaggaggggctacgatttttttagtgtccaataaggtcgagccatgttgatccttcatgtggtttcaaaatgctcatgaacgttactgcgtgcggggttttcttttctagatttgttgtactgtaagatatctatctaaggttaatttttgttagaaacacaccataaatatagacactcacccatataaacgcacaccctacccctatgaagacctccgaaagactaggccgacatatcttgagatcgacgaagtcatcacaggtgcatggactggcatattttgagatcgacgaagtcaccacagacgtctcgctgtcgatggatatgtcaccaaccactgaaaaaataattaactataaatacgagtatatgtgtcaagtctttggacttgaatatggatggattggttttaaaaaaaaataaccaattaagttacgcttacttcgtaaggtggtttattttgagatggaggtactagatgaagcatccagcagaagccatgccgaggcacctgcgacagaaaggagggccagatatagcaagcaccgatggtggcggatacgacagagagtacgtacaggagaaaacggcaaggaagcaggcaatatcatatccggtcaagtgtgaggtgtggaggatggaggccggccggtgccgtgcgtggtccaggccgtgctagcgcctagcgcccggcccgatcgatcgatcgagaccacgcgcgccttccgtttctagatctcttcgctgcaccgcgcatgcggccgttgcctgcctcgatggccagcgtgcggcgtgccaacgctggcgagcgagatgagatgtccgcggcgcggcatgtgcacccgcggctcttcgtttcgttggttggttggttgatttggtcccctgaatgcaacgccgaaacgccactgcggccaagggatcgtgctagcgtggctggcattggcatgggccaatcaatcccgttcatttcaggctgtgcctgaagcctgcagatggatactgatccatccattccaatcctggcagtgtgtgcctcgaaagaagatgattcttaatgccaccttaccctttacaggggcaggctgcaggcagcaccacttcacaccagctttctttatttctttctttctttctttttttctttcttatccacagcgagagaccgaggccgagggaccagaccagagggtgtacaactactacagcgttcgcatcagcggatcgctgtgcaaagtgcgttgcgagaggggaggagggtgagaatgtgagatggtgtgctccggaccccggtggcttggttggccgctgtcgctttacagcctcgcccacgggagcctgtgggtttcacggtcagtaggcaggcaggcagcactaggagtagtagtctaatagatttcggctggacgaacacaacaaccagagtctataggaattttaacataacagctgtttgcacctgaaagtcatgcccgatagatcaagcatcatttccatataagtgatacaattctagccatatataaacttggatttccttttctaattccccttagtaatgtattgtcattggcgttaaactgataaatatgatcattcgtaaaaataaaaaagtaaatatgtaatttttgattgaccgagattcgctttcgaaaaagacgttaccgttcccattcctacctaaaaccctcgtaggcaaaaggtgaacatgtgacgaaatgcgatcagtatgggatttgttaaaacggaaacactgtgaaatgagattctttagaaaaataaacaaaaaaaaatagagaatggagtggtttggtacttatggttggaccggtggtggcacatacatgtatgaccagttgaacttccctctcaggttgtttggcacattcacccggtcgatccatatattcaacaaattcattaattccgatctggctcgactgagtactcagacgtaaattctctgtatctatcaacatttaattggtgatttaggcgacgtagcagctagccatgagcaatatactaacatttttatcgacgtgacatgtagcttcatgcgtaggtggtgcgtgcaagtagggaccgattaaatttgcgtactaacgcaattagctttgctttccggtgatcatgcatggtttatttatgacttgacaaatgcacagcatcactgattacacgtacagcaactctacaaagtgtacagtgcagtgtacttaattttacagtcgctgcagactaagctaagcaactttagtggttcaagcaaccccatattatatacagacgaattaaaaagattgttatcgtcatggacacatggttagctagcttatgtacaaagcaaaaaaatacttacctgctcagttcttaatctgtgaaatactactaacacttttcatttgtcatatattgactttgacatacaatacaactaaccgtgattaacgaggaaaagacaatcaactaattatatggtcatgtcagacgtataaggtttttacgcaattacaatgtaccactttgaacactactttattttataatatattatcagcaaccacaaaattagtgtcatacaaaaaatacttccaaatacagattttttttagataatgactttttcttgaaacaagaacacattatatatccgtttacgtttgtatactctactgtcccggatgacaccgatactaaggacgggtgcttaattagtattggcgccatttagttggggcggttgcttgaacatgactgatgagatagctctgctacttagcacagctgagctaccgatcatgtatattttctccatggtattgccaagtttggtgaactatgcttgtctaactacccatctgattaacttggagcatgagtactgcttctatgcatgtgacgtatttatagtgtttgctaattataagcacgtactgttctgaccatggcacacacagagatgtacaggatgtatgtacgtacggtgaccactgttcaaatgatcaatcaaatccaattaggggcttgttttttttgccaattaattagcccgtgttacttaacaagtcacacactaattaattaaaagttgcctcacgcacttgtccagtggccatgtgatgagctccaatatattatggggcgaccaatttcaagatcatatagactcgatagtttggcaaagaaattgacatgtgattggcaattaggttcccatagcatattgttttcgtttacgagacggccttgtgatgttgtggttcccaaaatgacgagtgtgcttgcttgttctcctctctgaaccttaaaataacatctgtcagagaactagtgtgcccacattgatgcaataatataccggacacaactaattaaacaaccgacagttatacatctctcttcatcgagaaaatatatatgctttagatactcaggtcataaatgtttggtgcttaatacaagattagatcgaaatattgaaattcagacaatcaactttatatattagaatataggtttgtaaaatatatttttcttattatattatgatagcacttatcgagacaaatatctattgatgtcttcttttttatgattttaaactaagcgtttaaagaatgttctaattatgaaaaaaattaaaagtttgataaaatcttattctaaccatcctatatctatgaccggaggaagtacatagaagcaccggggcatagtttggaacaaaggaattgaattttgtcccgcacttgtgtaaatactaaatggtgttattttttagctaacattttttgggcacgccataaaattttaaatgagtccagccatgtcaggaaaatatccttctgaataatatatggctgccttttttagggcttgagaattattgtcacttgatgaagaggcctctttcccaattggcaggttttactaggccctgtagtggctcctgaacctgacaggacggaaaacaaattagagcctcaagtaaacaaattaggaaggttagatgtcaagcaaacaatgagatttataggagaagaaaggcgaggccacaacatcgttgtgagaaggactacttagcgaaaaatactatagttaacatgatgatgtgagtcataacggaggggttaggggagatgggaacaaagctagccagatgttcaaagtacatgcagttctcagctagctgtggttaaaaaggcactgtttacctaaaccagagaaaaaggaagaaaatgacattaattaatcaaatatgtgaaggtggtagtttgtgtgctgtgctaattgatccattagcaagtggaaaaggagtacctcaactgttttttatagattatcactccctctattcttctgtattaatttgtaccctaaaaatgtttggtagtcaatgttttacaacgtattcaacatattttttaaataataaacaagattttcaatataaaaataaatagatgtttcttagcatttttagactaagaagtataagtatacacggtcatccaactttatgtgtttggccagatcctgcaattttcccttcatcggaaaactagacaattattctccacaaatataaacaattaagttttgaggtcaaattatttgattttattttctttactcatacatgtagtaaagttctcatcattatagacacgaatgattatatcactttacagttttggtatcacaaagaaaccaactaactagtttagtggtaatattcagactttcttgattgatctttctaatgggtcacataagcaatcatatttcaaaagacttgttatttaaggtgtgttcttacttcttggtacaaccatttaggaaattggagatttagtacagaaagtccaacaagaaattggagatggtacctttcttttagcgaaaggaaacaactttcccctgtttaccttttgtgtgctatccatcactctttctatttatcaaaagagaaaaaaattaaactatacgtttcttgctagtattgtttaagtaatccttttcggagaaactgctcatgtcaatttttatacgtcgagccatttacactgaacttttctactaaagagttgttctggtggggcatccatattgttgctattattttttaggtttaatcagaggtgtgataaaaatcaataattgtgacgtttaactgaagaaaactaaatcagtcccaacaacgaagatcataagtagccatcacacgagttcacaaccgggccacataacatgcggttcaagccttgaagtgaactcgtgttatctcctccatcaaaattaattcaagcgtaaatatctctagttgaaaaaaatctatatgtccactacttttacttttgattagctgatgatcttagtcaaactcataaggtgcgtaaccatcgtggctcaaagctttcaggtgtttctcactttctctttcagcaaccaaaaaaagaaaaaaaaattaacaaaacaatgcagagcattttgataattttttttctttggtgtgattggtgtccgcgtttataacaacgttgccttcctgtttgcatcaatatcgccctgtcacgcattcaattaactttttgttacctagaaaaaacactattatgttttcttattttctttttttttttttgcatgtagcaatcaaacaaagcaggatggctatttgtttgtagatacgaggtaggaaatcaagtcaagcttatatagccaatacagtaaaaatgtttattaattccataatggagaattatgtatcttaacttttctacaaaatttgagatctaggtcatgtattattatccatattaaatgaaggcagcacggattgtactatagcattttgggcaactcaacttctttaagcttggaaatgaattaggagtacatcatttcattgaagaacaagataaagttaaaaaagcaaaaaacaatccggtacgtgtgcctaatcctcccgcaagttacacgcacaaacacccaattactaaacaatataaacaggacaaaatgtccttcgattcgttcgctaacatcctaaactaaaggaagtactactagacatattcagtctagctaacctacccaaatcttctcagccagtacttggctttccaacaccaaaatttgtcccttattgatcgttttcttcttcacgtttgatttatctatttcaaatacaatatatattttataagttgagaaaacatgtattccaatttcctattatttatcacccttgcacttcactcctggctcccatttctcatcacgctattgcatttaccaagtttttttttcaagtaaaaacgctaccattgaatcatcatcatatatggaatcttatactggccaccttgcttcaaccgtccgcacaaatgtcattgtccaacccaagtaacaaattgacacgaccaatcaccttttacttcttgagaaaatttaatttcccatatttgtttttttccattaaaccttagctaccaacgggaatacataaaacaaaaccataaattcatatcacccacttcttaaatcttcagttacagtattattttccatgtcaacccaatgaggcaaatgttggaatctattttgaggggaaaaaatcacatttacattccccacattttgaaattcaaggcgtgtaaaaataacggtcttagataatacaagacgtgtaaaattaacggtcttagatagttttaccttggttatcttctcctatttcaatactcgtgtgtttatagaggtgagtgtgcgtgcgttgtgagtttctacgttgtgccatgtaattttaaaaaaaaaagacgtacataattatagatagagtagcttctgctgacttttttttaagacaaacatgtaacctactcctgtctaattcctgcgcttaactaaatttatcgaattgtaaaacagaaggattatctccccatggttgatactgtaaaatgttctaattaacatcactttagaaagatcaaagagaaagaaaaaggcactcttctctcctctgggacagcttgacagccacactaaccagaaggaggccacacccacacacaacctggctggaagaatcagcggcagagctgcacaacacaacacaaagccaaaggcagattacaaaacgagtagaagtaaaaacaacagcaaaaggccccaaaaaaaattaaaaaaaaacattggaagagaaaaaaagacgcagaaaaatcccccacttcactctagtactctgcttgcttctccgcatccatcaaccactcacccagttttgctgctgctgctgctcgtcttcctcctcttcctcctcgcaggcggccgcgcgcgtcgatccggaggccgctcgccgccgacgccgccgccgcagcagcagccggagtgggagcgggggcggcgaatctggagccgaggggacctgcattgccgcgggagggcagcgggtagctagatctcctcccccctgtgcctccttccttggacggccgcggcagcggcatggtggctgctgcggcagcggctaccgcgccagatccggcgcaccccgcgcgcccgccgctcacgccggccctcgacaagcccaactccgcccccgccgcgcgccgccccgcgcgctccagcaagccggtctcgtctcgctacctgtcggcggccgcgtcgccgacctcctccacctcgtcgtcgtcgtcgacgtcgtcgtcgtccgcgccgtcgtcgaaccgccgctcgctctccgcgcagcgcgcgaggtcgtccacccccccgccgcagcactcgacgtcgcccaccccggcccccgcggcggcggcggcggcggtggcggtggcttcggggggcttgacggcgaccacgatgcggagcctctcggtgtcgttccagggggagtccttcttctaccagacgtcgcgcgcgccgcgggcggcgtcgccgtcgtccccaggcgggcggcgcgggcccacgccggagcggcggaagagcgtgtcgtcggtgcccgaggccgagaacacgcggccgcagcaccgatggccggcggcgaagcccaaggcgtcggaccccctcagcccagcagccctgcgagctagacaagacgcttgtgaaagcgcggcaagggactccatcctggctgccgtccacctgctccgccgctccatggcgttcgactccaccacatccctctccccttcggacccggccgccgccgccgccgcggcccacgacctctctgcatcctccgacaccgacagcgtttcatccggcagcaactcgggggccggtgatcccccacgccgcggcatcagcgtgccggcgaggttctggcaggagaccaacagccgccttcgccggcttccagaaccagggctaccgctaccatcatcctctggcaggagatcgttctcagacagtcaaatgtcaccgagactgcctggccgctctccatctccaagccgcggaagcaggggcatggcgagcccagcaagagggcggagtggggaggcatcacccaatggtcacacaatgcaggcgccggcaaatgcgccatctatcatcagctttgctgcagaggtgaggagggcgaaaaagggggagaacagaattgaggaggcacacaggctgcggctgctcgataatcgacatttgcagtggcgatgcatcaatgctcggacagatgcagctctcctggtgcagagcttcaatgctgaggtaaattatgttgacctatctggttttaagctataacattccaaaatcctcttactgttggttactcatagtatccaattatccactctatgtataaaacaattaatgttctactagtttcacttttattattgtgtttatttcacttcctaaatgcaaatgtgtgggggtacatttgggcctctggggtatctgtaatcagcaactgcacattctgtttcattatttgtttgaattcagaacaatttacaactcaatgggggtgcttgatcaatatgattactgaggtcatagtatttgttatatctcgcagacgaggaaagaatacaaaagttccatttttattgtgagatattagtctttgaggactgtagaagcctgataagtaagttggtatttgtagactactaaaaaggttgggactggttagctgcttatttactagtcctcacgatagttgcattgtaaactagggtgtgttatgctgcaagcgttgcatgcaaatcttgactaaaggagaaccaatggagctgctaatcacttgctccctgattttgaagaattgagttttgaatattcaccttcaacccatacctatcgattgtttatgatccattcagaagtcccatgaagcgtattaataaaaatagcactgtggggttcagtgcttgtagtggacttagtttggtgggcaaatgggcatttgggtgtcatattacgagagaatctactctatattgtatatagataaatttcagtagtcctttaattacttggttcacatcaaatatactgaaactgtaagatattttcacgtccgcagtcatgtcttgattattttatttaaaccatttttttctgtatgtaccacttcaaacaaccagtgctgtagcgcatttcaatcgcattcagtagctttagggtgtgtttagttcatgccaaaattggaagtttgattgaaattggaacgatttgacggaaaagttggaagtttgtgtgtgtaggaaagttttgatgtgatggaaaagtttgaagtttgaagaaaaagttgggaactaaaccaggccttacatttcaaagaaatgttatggcagatttgcccaaggagacttcttttagtattagtgtgaatggttggacccatacccctttgtttctgtactgttaggttacaaaaggatactggcgcgatgttgctagggatgttggcagtgtcaggatttagatgacttaactcgtaaatcgtagtctagtgacttgtcaactttattgcactattagcggctgataacttgattgaaattatttcttggtcaataaagtcatctgggatatatcacctaggtccttgtactgcctttgattaatgagagaaacagcctagataccaaattttacatttctccatctttggttccaatttggcaatgcctttgaatcaaatgtattgttttagattccagatatggatttatgtgaaggtgcactgttttgttatttttctttgatagctgtgtacattggaataaaccatttgttttcaaatgtatttgttctgacacttaatacattgagctgtatgctccatagaatgaaaatctaaaaagggttgagctactattctaactaatgttgcttatttcactatttttcagaaaactctgcacagtgcatggaaggaaatatcaaaattacgagacaatgtcagttctaaaaggagcaaactccagcttctaaaacaaaagctcaaactgttcgctattcttagaagacaggtaaaagagattatatctattattgttttagctatttatgcagtttgcactaggatttggtagcatttctggcaaagttgattgtatctaagtgcttctatttgacatgttcagatatactatctagacgagtggtctcatattgaaaaacatcattcaagtgctttgtcagcagcaatcgaagcactgaaggctagtactctccgtcttccagttgtcggtggtgcgaaggtcaggattttttttcataatacaatatagttatctgatatgatttgatatacccctttggatagttttaatgtttctctctgagcaggctgatgcccaaggtgtgaaggaagctgttaactcagcggtggacgtgatgcacacaatggcatcctcaatgtgtactttgttgtctaaggtgcatatgtcctatccttcttctccttgatatctcttttatcaagaatgtaattttcatatctaaattgcaaagtacgtagattctttaggtccatcctgatgggtagctatggtcatacataattgtgtactcttccggcatatatatttttgtagctataaaatctgagagataagacaatttccttgtggccaattacctgagtggacagctaacaactgcaaatctttcatgaatgatatatttgatccagcgtgcattcaaatctattgaggtatttacaggtttatggaaagttggaatcctagaatcccaaggaaaacatgcctattttttatgtttatatcgaacttgaatcactgcattgaatataagctggctaaccagaaccgcgatttgtctgtaaacataagctaggtgtactgcaggtgtttgcctgttatgtgaacattacttgatttgtaaggccttggacaatgaggcgactcttacatgggcatgcatttcatgtaattcatggcgtatttgctgtggcaacctctgaatcatgttttattggtcttcaggtggaaggaacaagctctgtggtgtctgagcttgccaaacttgcaacacaagaacaaatgttgttggatcaatcaagagatctcttgtccatggtcgcagcaatacatgtatggagaatttctgtaatacttttatttgattgtacccttgtatattgttgtttggctcattgtgttaattatatatttgaaaaacaggttaaacagtgtagcttgcaagctcatatgctacaacgaaagcaaaagcagagccagacacgggtgtagatcagtttgtcttgccacattggtggtcaactaacatcacacggcctcatcttttcacactggagactgtgctacaggtaataaaagctgtaaccatttgttgggtgtgaagtgtgtcctaatctgctttgatctcaccgagtgtagctgattcatgtaattttttgagtgcatatcaccatagaaatggccccttttacctgcaacagttgctgcagtggatgtatacagagaacctagtgttgaccaaggatgagctttctgtagatatgaaaaaagcttgtcgtttgcgtgcctagctttgctgtgttgcgtgcctcgcgtgttgatgattggtgttttgtattctggaatggaaacagttgttagtttgatacgggtgttttcatggcaaattaacatgcaagttgttcattctaacttgctccggggcagtatacagacgttatatgtatgtctcatgcttatcctggaactaattcgtagcgcactaaaccttgttgtgattgctgttgttgagtcgtgccttgtgcgacgtgtattggtccttagttttggggattccgagaagtccctagaacacacaattcacctacatgttgaactacactgaaatccaaaatttcattttgagacgtgcaatgcagagtctagacttggttggcggcgtgagggcgaggagatttttttttaatttttaaacttttttaattttaaaaataaaccattctaaaatttattttagatccgaactttttggccatatcggtcgaactttttggccacatcaactgagctggagtggcaaaacaatattgttacactggtgttatttagttacaccgatctcgctggcgctggcgtgattgttatttggtcacatcggtctgggcatcgcatgataaaaatgtcacgtccgctgtagatggcgtatcaatgttgttttgccacgctagatagactgacgtggtaaggttcagattttgaaaataaaatttggaagggtttatttttaaaattaaaataaaaaaatgttcaaaaaaaaacttttaaagaaaaatccgaggagatgagaagattacacgtaccgtaaatggaaggccctggttctgtgggagagcgagaggtttcggttggcgcatcgtcacatcatcggcgatggtacatgtcgcggaaaccaacccgccaccgtcaagtcagggcgcccccgttttgcatgcccacgtacggatgacgcaggcgccgcggcagcagccgcctgcatccaccaactgcctgggtgcctccggttgagagcgacgggaacaccacgaggcgaacaggcgagccgaccagcgcgcagcaccccctcgtgctctcgttggcgcaggccaccgtccccccggtgcgtctggtaggaggccgtcgctggcggcggcgggacagcggttgggatactgggaatccgggatgtggcgtgtgcatgtgccacagccgccggtgcagatttgtgggctctgcatgcagcggccacacaccgacgctgcgtcacaactcagtagttgggttgggccaacagaatgagttagcccggtttggatggtctaggccttgagcttcaacgtcttcagctcgatctgggatggctgcagtccccctgaattctggcattgtcaagtttgcttgccagcaggcattagctttacatcttcagctaggttcaccgttttcacaatccaaacctacaaagtttcaggttcctctagaaaaacaaatccacggtcccgagtcttccttcccaagtggtatttttctggtggacggcattacatattgccgtagcaaccgcgcaagtccactctttctgccttcaagtttttcctcctttcactcaagtgttcagcacttcagcaatcctcgtaaacatttctggactgtgagatcagagtatcagacaggtctccatgccaacgaccgaatgtctgtgcatatagtagactttgattcgagtagactgcacaatgtctatgcatagagtagactctgattcgagtagacttcaccactctcaagctcctttaaaaagcattcaaaattgagaaaggaagacttacagagagacctggactacaaaaacgtggccttgcgttgtgtgcacttttttgacccacctatcctacattctaacaatttgtccaaaagaagcattcaaagatttgatctgaagttcatgtcaagaattatactggaagtacctgtagactgaacattttttttctgatctagtcgtaatgcattagcttgatcatcattacaatcgctcaatcagtagaccagagcatcgacgctccagaaaattggcatcccagtccattcggcgactcgccatctcaaatatctgcctgtccgttgtctttattacgagtcttgtcttgcttccgtcagttgagctgagctgtttctgaagaaaattcagctgaactgttttggctttgagccacacctcccttttgtcccgaggatggagcaagtaacacaacggcaacagcatggtgtacctgccaatatgccatcagcccatcacaatatgccatttggaaatatcagagcagctccattgggagtactgaaccgcagaagttacttcgtccaaagcaacgtgttctgttatttctgttgctgcaacgaactgatgacggagacgacacctggaaagcgttggaagcggtttgcatgcttgcatggtcgatcgacccggttgagctcgtgcctaccctgctttcctctcatctgaacaaacccgttgcaagttagcctcaagcgactgaccatggtgataattgatgacctccaaacggcaattaaacgaccatatataacctgtcacaatcacgcatatctctgttgctggaagaatccgaatccgaatatgaacacagtgagtacgatacaaatacaaatgaacgcaaagtcgatatagaaacaacaatgaactggctagtactagtagtagcaaacagcacatggaagatggaagtacacttgcttggagatagatatccccccgtgtggctcccacgattgtacgctttcacgatccgtgcgtggccgcattgcccatatgaaggtgcatgcatccaggacttgacagctgacattccaatcagctttgacacactgcagcgttttgcgagagatcgagtttggcaccattggtcccctacgtatacgggcgtgcatttacttgatctagctagccaggtgcctgtgggtcagtctctgtgtgtcgatcagtatctctagctcgctatgtgccaaagccggcatggcgagagttggagacatgcgcatgagccgttgtatccatcttgcttgctgcctgggaccatctttggcaaggatgcacctgcccaagctagctaggcgcatgcgtgcgggcgtgcggatgcatgtacaacttcgccacgactctgatcgctgcttctatcctctctctgtgtgtgtttgtgtcgatctctgctgtttcgtctctgtgcgctcgtcacggcactgtttttctcttttgaggtggcggcgcctctgattacatcgcttgcgcttgttgcttctgatatcaatcagctctcgcgcctccatacctcttgtcgacggcgacacgcgcggcccggccggagagagcaagctgagtgagccggcgttggctttctcacggctcgatcggccgtgtcaccatcagaatgtacaacacggaagcctgcgctgtgcatgcggggctttgggcttcccctcctgtcatggcaagcataatttctctggtggacatgctcgtgacaactacgtccacgtaccaccagcagctagcagctatagctaccactatcgagtatagcagtacagtactagtaatatcttgggtcaactgtctgagaaacttgatctcacctttcatttcaacggagagagcagccacgtacgtgcacttgggccgaacaggtgtagtggcactactatagtaccaaaagttggggtgtcaagcgtgctgatgattgactgattttgctgtagcattgtcggtcaagatcgataagaatactgtactggtacattcccagcagttggggcccatgcatgtataggggggggggggggtggggggcaactggtggtggcctactgcgccgccgcctctccatacctccccgtcagttcctgtgtcatgtacggtgcatcttcttgattgcacccctcgacggttaatgcaccggcggcgggctgtctgatgatcagtttaccacatcgggttttacctcatgttaccgatcgagatcaggttacgtagcttggcttgtcgtttgtagtacaagctcctatgcccaatccgggacgcacaaacaaaggggttatggactcaaaccgcatgatcgatcgggttgcggatccgtgctaaagccaagctctcaggtgtgggtcatttcacgtgaccggaccgcgaaattgaaatcacacaccaccgtcgtcgccaaaaaccgctccacgctatcagacacggctcgcctttccactgtgtaaagtggggccttttcccctggtttgtacggcggaaaaaacagcgcgcgccaccgaaacgattggccacacacaccccccacccacaacaaaacccacccccgcgcgccgtgcctccgccgtacgtcgcgtcgttacgtcccgggtaaccaccagctgtttcgcgtctcgcgcgctcgagtcgggcgactgacgcgtacacgccccgccttgtgatcatgagccgccgatgacacgcgccgcccggctgggcgcccaaccaggaaacgacgagagatcaccgagcgcgcggcggcacgtcgttttcggcgcggatacgcggtcgcgggggcggatgctgttgccgttaactgctggggggccgggtgtcccgtactcccgtggcgcggagccgagcgagcgcccgagcgcgcgtacgtcggcatcagattcgtgcatgcgcggcgcttgcctcgctcgcctcacatgtcctttcgcgagtggtagcccgtagctagggagggcgcgatatactcctatcgaacagtagaggccgtaggcatgtcgtcgtgacaaggaggacgtacgatgcggtttgttttcgactactgttcaacggtgcatttctggtgatcgatctagtcacatctatgctcatccacttacagacaggatcgcttttcagggaattatttgagcaagatttctacactactgctttactacttttcggtcatggcctcattggagctccggtgtttctgtgtcaccgaaagatttgtgcatatatattagcttgtacacctagtgccctagttactgcatcagtctgtgggatgcagatcgtctgcagtactgctcattgatatatggatcccacagcctcttaggtccacatgtcagtgagcagtactgcagggaatatcaattgcattctgttgctaaggttcagatcaatgatattagactttgttaaggtgtagaatgctagataagtgcgaatgaatacgtgcaggtttagggcaaaatgtcatggtagctcgccccctgttccgcgaagcttttggtctctcgataactctcgatctgaaacgcatatagggccgggtgcattgcacaacacagcacaaggcacgcatgtgcatttggcatgagtgtgagagatgtatccggggcatctcctcgagctctcttagaaaattgtgcagtggtcagggatcaaactatccaattagaattaggcgtggctttatactgtccataatcctttcgattgagaaattcacgctccatttaggatagaacagaaaaatagggaaatgtttccccacttggctcccttcatccgacaagttgtatcgcctaactaataaccgtgtttgtatcggcacaaattgacgcagaaaaggatagattaatcccatgcaaaatggatggatcgatccacaagttgagaagaacgctagctcgaacagtttgctaaaatgctgttactgtattctaactttgccggataagcttaactattggagagttgggcgcctgggtgggccctatctcccctaggagagagatcgcactgccgcttttgatttttgactgactcggaaatccattccctctgcaacggaaacgtcatggtaaaaccgaccacggttagtgttgcaaatctttgtaacgccaccagtggccgaccttttgtctgatcaccgcatacaattatcgatctttttcacaggtggattcacaaacccaatcatgttaacagggtaattaaaagctaagcaaaagagcttcatcgtggcaggatttttaagcctcaatccacagcaaaagaaaagatccagtggtgctgtggtgcatgcatgcacgcagttaatttctccccaccactccaatcatacgctccactcccagccgacgcaagttaattcatcgcacaacccataattaaattgaaccaataataactgtttttttgatggagtcgtggatggataacgccacgcagataaaatcttttttttttaacttcatcgatgcctttttattcacccagcaggtttagtgatatcacgaaccacaaaggcatttacaaattctggaaggagtcgatccaaacgatggattgacccgggtcccaactagcgcctattttggcaagatcataggcaacactattacagcaacggagaacataagcgatatcgacatggataaaattcagctgaataacgccacgcagataaaatcttgagaaggaatcacaaagccaaacggccgccgaattaacggttggatcgatctcggcctctcctttttctgctgccacctctgctcttcatatgcttcttgccaattgaatgaattgatcgatcgatcgatgttgctgcaacttgcatacatggccgatcatatgcgcccgcgcgtatatgcgcgcactttccctctcccgtcaaccgcgcccacatgattcaggggagagagagagagggctcagagaaggaagtgcattcgcgcgatatctgcgtgattacgtccgtgcgttacaactttttaaaaaaatctcacagttttattgttatccctgcgagaaaatagaaggccggaaccccactgcagccgggtgcctgtatatatatatgctacattcctatgcagagcagcagagtcgagagagagagagagagagagagagagatcgatacggttgcgagattgatcgatcgatcgatcgatcggatatatgccatgatgagagatgaagaggaggaggaaggggtggtgatcatcatccgggagtacgacccatcgagagaccgcgccggcacggaggccgtcgaccgggagtgcgacgtcggcccgaccggcggcatgtcgctccacgccgacctgctcggcgaccccgtcgcccgcattcgccactcccctgactacctcatgttggtacgtactacgatcatatcgtgtcagtacgtacgctgttttggtggttgtgttttcattttgtagtgtgtgttgtgtcttgggatggaaaggtagctgagacgacgtcgggcgccaccggcggacggatcatcgtcggcatcatcagaggcaccgtgaagtcggtcgccaccggcaagagctgcccgggcgcccccgccgtcgccagcgtcggctacattctcggactccgcgtcgcgccgagccacaggtaacagcagcggacttggtcgtttcttgtgtccgcggaggcgcggcgtcgcgtggcgtggcgtatcgtttcgggaaagggaaatggcgcgtgattcgctcggggggttttcctggctgtgtgtgcaggaggatggggttggcgctgcggatggtgcggcggatggaagcgtggttcgagcggatgggagccgagtacgcgtacatggccaccgacaagtccaacgaggcgtcgctgcggctgttcacggtgcggtgcggctactccaagttccggacgccgtcgctgctggtgcaccccgtgcacgcgcaccgccgccgcgtcccgcgccgcgcggccgtgttccgcctcggcgcccgcgacgccgagcggctgtacgacggcaggttcgcgcacgtcgagttcttccccgccgacatcggcgccgtgctggggaaccagctctccatcggcacgttcctcgccgtcatcgacgacgacgggaggtggcgccacggcgagtggcgcggggccgagcgcttcctggcgtccccgccggcgtcgtgggcgctggcgagcctctgggactgcgggggcgtgttccgcctcgagctgcgcggcgcgtcgcgccttcgccgcgccgcggcggccgcgacgcgcgcgctggaccgcgcggcgaggtggatgcgcgtcccgtccgtgccggacttcttccgcccgttctccgggtggttcgtgtacggcctcggcggcgacggccccgacgccgcggtggccgccgaggcgctgttcgcgacgttcgtcaacatggcgcgcggcagggcggccgccgtggccgtcgaggtggcggcctgcgacccgctccgccgccgcatcccgcactggcgccgcctctcgtgcaccgaggacctgtggtgcatgaagcggctgggccgcgtcggagaatcggacggctgggattgggccaggtcacctcctggcctctccatcttcgttgaccccagagaagtgtaagtaaaagaaatcagcggcgaccagagtcaagagtgtagctagaccgtacgatctaaacccttttcttttttctcttctgcatctcggtatttttctcctttggtttaggtgagccttttacacggttcgttttgggaggcaatcgagtttttgtaggatacactgccctaattataatcggaaaaaagccggaatcgatagcaatatcgagagctcttatcttgttgatgctgctatccgtaatgatttgtgccgtgacggctgacagaatacgtggcccgcccgagctctaacatggaaatgcagagattgtgtggtggggctctataaccttaccaaaccttcgtatcaaatcaagcactttactaaaacatctaacttgccattttgccaaaatgttgcggtgtcaatagtagaaaatcaggcactaacatcttcttcacctttacacagtacacagtaacattaataatcataaaaatacagccaaattactgatgttgctagaacaagtgatcaactgattatcctgtactgtagagtacatgctgatggctcatgttcgccatgccgttcgagtttctgcactgtgcaacaatggtcgaatgaccagcatcagcgatgcatgcgtgcgtgatgcatttgctgatgtctgatgatggggttttcgttctgacgattccaatccaagcttctgttccgctcttttgaccggcaggcaggcaatatggtcgttcgctcggtgtgtactgtgcgagaccactgtgcagtgccgcgtgttgtacgattccatgtgagctagtagtgttcgactcatgcagaattgcatatgtgcagtggctctgcaccggcaccgctagctgcttcgtttacgcagaggcgaattttttttttcaaatggtgcaatgaataatgtcgtcgactcgtcgtcgctttgcagcgacgtactgtaacagggaaagccaatcgatcggggtactggtaataactgtagtacatgaagcacaatgattggaattctcgtggtataataattcaatttgtccgttgcattcggctacatatcagatcgagcgacaatgatgacaggtgcaacgaaatagtcctgttaagaatctcaggattaaaatgagctcatttcttcatatcagtactactcttacatttctcagcagacaaagcagattatccaacctcgttgacttgcaatctgatcatgttggcatcactgattgcacgcacgaattgatgtttgtgttacgctttactactactcccttaatcacattggtacttactcattggacacacacaaattgggtgttgcactatattaggtgttgcactataggtatctccaatgtttattaccatgagtagtattaaggtgggtcccactattcttatggttattactacaatgtctgaaataagagtaaactttaagatggatcccacaatgtactattctagtacttcttttatcagccatgccaatttttcatcctcacattcattttaccctattattttattgcttgtggtcaagccataagcttaaatttttcttttacatttaatgtcttatggctttgtttcacaatgtatatggtcactataaaaccttatggcctcttcttatggccacattgtggctgcccttaggtggctaagttaagtacgtgtgtacccagattgagtggataaggaagaatcaacaaagctcatgcagccagcctacgctttgcaccattcgacccctgcattttcacagggtatatgaccatatgtccgttcagtctactctatcataaaaaaaaaatctagaactaaatgtgacacattctattacaataaatctataaatctagataaagatatatctaaatttatactattaaaatgtgtcacatcagtattatattagttttttatgagataaagggagtactaggcagcaggccagcagctagcatctgctattacttgaactgtcgtagtttcagcatttggctgttggtgagttgatccaaatggccaagagcccaagaccgaggcatgtatggatgcatcatgcatgccagggtgagataaaccgaaagctcattggtcattgcagatttgggggcacgtcgtctcgccatgctctcgccggtcgacaaggagtagacaaaatcgccgccgatgagaaggacgggccctggataatccgacgacaagcaaagttcagatcgattgatacttcgtctgttctaaaatgtaagtatttttaagattgccacgagtattaagaaagtatgtgagaataattgaagaaggtgtgtgattggttgaaaagagaaagtaggtgaaaaagaatagttgtgattggttgagaggagaaggtaggtagaaaaatagctttattttaagacaaagtattgtgctagaaatattacatttttggacggaggtagtagctcgtttgtgcttcttcgcctggcacgacacgatttcgacggagtacgtgatggttgatggtacggaacttgaacggaggcacaattctttaacctcctgttgttctgaacaggacctggattgtggcggagctttcgatgtgatgagatgcggtactatgattgtgcagggtatgggttgtgtcagtcagtcgttgcaggcatatcacactcctttgacctcctttgacctactgtagtactgatttcttgggcatggatcctttgcacgcgtagctggtcaaatcagccgtcaggggtgtgtctggatttttcaatccttttaaaaaacatattctacaagtaaacctctaaaaattttattctataaataatttttttcacggcaccaacattattggtactgcggttccatccctctaaccccaataaaagctaaatcattaatgtgaaggacggcgacaccaatatcataaacgatggcctatttatttttctttcaaaaatgacctagctgtaatagaaagaacatacttgtaattaaaaatttacacataggtcctaggtgcaagtgtcattgacctatttgtagaatgaattaatttcacctccgtgatgatgtgcaccgagccaccgaccggacatatattccaccattgaaagagaagggaaaccgtatgtgtaccagtcctacccatttggaacagccatttgaacaggttaggtgatggacggaccaggaagacgagtagtagtatggactgcaacttaaacagtcgtagctgctactttggatctaaatctgacggtaaggattagcttgtctactgtagcaaaagtaatgtaccataaaatattgtttagagtactatatagtgaacactgtagtgattgatctggaccattgatcataaaattgaatggttaaaaatacatgcagttctaacgtgcagtcgtaattccaggaagacatgcgatgcgaaacgagaagcgtcaacgggtcccagcaggtgatctgcaagtgcaagccagacaacgtgatttgcatgcacgatgaagtgatttgcaagcaagaaggacgaggtgagcctatggatcatggtccgagtcaaatctgttagccggtcctacatggatcagaaaagcaattcaatggatatgatcttttactgtgttggggggtacagtatccacgttaattctcaaactagtgagtatctactattggttgctgcaaagccgagatattctattctattatcttaaaaaaatctactattgaatgctaaatggtatattagggatagagataatttaatttgcactaattgtttgctactagcctctaacttctggaaaactattcactcgaatggttatgaattttctttaaaaaaagagaagatgtattaaaaaaattaaaaaatatggcattccattcacatcataattcctaggcgatcaggatgatcatcgacttcaggtcttttcttgagcagtttgtcgtgcgtgagattccttgataagtataaaaaacattagctgatttcctgcaatacataggctaaaaatattctctgtatagttatactatcatcttgatgtaattgtctatgttcaataagacacactttaaaaatagttcctttcctgcatatgcgttcacaggattatacattatgcttcttacaaaagtgtgtacatattcagagtactgtttcttttttttttaacgaaggagcactaattttaactctctacaacgatatgcgcttgacatagctgatactagtatgacgtactatactacaatccaaatacttcttttttagaggtataatccaaatactaaaaaggcccaagtcgctcaggtaacaatggctgcaaaatgcctattgagcccagttgcgacaacactgaacatcactggctacctttcaacaagatatccctatttggtccgcagctctgttattcttggctcaggacagcattgtctaattacaaattacacaagactttgcacgatctgaactgagatcataccactataccagtataaacaggctagcagcagatgaattatgcttccaagttctaacaaagttctaaacttttttcataacagctactaacttctgagtatggcataaaacctcaaagtagcaaccaacattttcataggtttcatggcaagcctacaatgctactaacaagatcacctaaaagcagacctcacattataacatccctaccaacagacgtgtaaaccattagttcttgcttctatgcaacattcatgaagaaagaaagaaaagaagcagcagctaagaacctaacgatccttacgaatccactgagaattcatgcaggaagctaacgctacacagcagccggcttcgtgctcctggagggggtcctcttgggaagctccagcttctgcaagatcgcactgtccgacgagtccgagctgctgcgctcaccggactgccctttgccggttggcaccgtcgtcgtcctccggtgagccgccttcttcggcgtcgacgcgccgcctttcttcgccttgccgttgctgcaatggctattggctgcgccgtctagcttggtggtggtcttggtggacaggctgaggtcttccacgaccatgacgccgtcccactcgtcctccgtgttggtggtggcgcctgacctcgagctctcgtacgagccgacgcagatgctgtcggctcggatggtgaccgccgcagaagccctcgtctgctcgtggtacagcacctgcaccacggtcctcagtggcagccgctcgttctgcaccgcgtgagcacacgcgtccggtgagagtttcttgcagtccatgaggctgcacagcttcttcttctcattctttcccaagcttgggtgctcctgctcatttaagaaaaataaacagatgttatacttaaaaacaaattttgtacaaccgtaaatacagaagaatttatatgagca

SEQ ID NO: 60430 - DNA, 3728 bp, Oryza sativa
caaaatgggtgtatttggatctttgcaacctcagcaagatacccatcaaccactttagccactttgatcatggatgcactaggtgcttggacatgactgtccacttcaccaccattatgtttctgagcattcttactgtcttgcctgacaaattcttccactatactgagtatcatgtcaatgtcataaactgtggtctccccatccactgtaggaatcagaagatccgacacggacgcttcatctagttgccgtccaatacgcttcataagctctttcctgcagagctctccacattttagcaaatttgttgctttcagtagctttaagaggaagctgcatgaaactgatcctttctctgatggcaacaagcatgtgatggtaactagcatggcccgaacttttgcgtcgccatggaccattgaaaccttacttaaggaagggagcttcttgtatgtgtaagccttgattgcctccccaatcacatccttgggcaccatacccttggtcttgattgctgttatgacttgcttgtatgaatcaatgtcgagatctgcgagatcctcgacccaccaatcatgcggcacaaactgctgcttcttgactccattccattccaaatcaaggccattctcagttgggagcttcttgcgattgtatgaatatgaccactcaaccttggaggtgtcagtggaggctttcgaagcaatggagtcgatgcagtggctaaccagcttaagatcctctgaccaaggcaagtgagcctttgtagtaccaagaacaatgatagagtccttccaactccggaaaatgcttgagctgaggaagacctcaatcttgtagatgagattacccttgtcgacagtttcatgcatctccaagtactctgcggcgcagcgggctgcaatgacattgtaggcattgagcgtgacaatcataccataacaaaacttggcacagatctcaaaagccttggcgccaccaggaatatcatggatgtgaatctcaatgttttcatcaccagtagttgggatcatcttctgaaagcgagcgcacttgctcagaagtgggaactgcacgggtggaaaatggaagcataaagttaaagtagcataacttataacagtgacatcgctcagaaaagtatatattaaacattgaaagaacaaggaaaaaaaagtagcataaagttaaaatattacttaaggtttcaataaacagataaaccacaaaagaagaaaaaatggaagcatttgctctagttataagtggtttagcatttagagaagagaatatgccagcaagcaaatatcaaaccttacatgaggccattatcttctgaaccacaagaaattactattgcaataagttttatgaaggcatttctctgaaaaaaaaaagctgcatgaatggaaaggaaggacatttttaccttgtgaaggtaaaactttgtagtccctatgcgaacagtgacatcgctcactaattcagttgccacaatgctgcaaagatggaacagttctcgtaagtgataagtcaggaaacgagaaaagaacaagcagcctgtgcctaaatgaacagtagattttgtgcatctagcatctaggctatttggaataaatgggcctatataatgggatcgagaaatatagtttctataattacagtactaaaccaaacaggagaatatttctctgttatttaacatctgcattttgtaagttattcaagatcataccaaacaggatgtattacacatttcttggacatattcagacgttcaacagtagtacactcagagaagagtaagaactgatgaaaactactaccaggtaaaccccccaaaaaagagaacagttgacaagttaagatcatgtacaagaacaaggcaaaggaactgaacaagacaagacgaacaatcacctgacttcattgccatcatcctgaaaagtatccgggttcgatccaagcttcatgaatttcatcttgaaacaggcaaagaacagacgcacacgcgctgatcttaaatcttatctctcctgatcgacgcccaaacacacaaaccaccaccaccaccactaacacaacaacaacgctgcaaccaatgcaacaactccactactagcccatatttatctacacaagatgaacagcaactagtacccaggagcaaacaagtacaaggagcagaacaacttgctgcaccctgctggtggctgcggctgagacggcgaccgaatattgcaacgtgcccgggagatcgttcgtacaacggaaaacaagaacagactacgagatagtagcaggccctgatgcggctagcagcaagccagtaacagcaacagcagcacagcactcaaactgctgcttcaagcacactccaagttgaacctacttatgcgggctgatgctgctgctatcgtaggcaatgaggcaagaatggtgaggagcacaagcacctcaatggaagtaaactactcctatatgaagagagagagagagagagagagggaggcaaggagccaggagggacaacacccacaaagcacaaagctgacacaaccccacctcctcctgctgctacctgttaattgctgcctgtccttgctgatctgagaggcgattagtataattcccttcttccacctcgcccaactttgttttaattaaccaagaatcacgcaagatcttgtgtccaatgcagcaccgctctctcataaacaacgagtccacattcctctccaccaacactgttccccaagcaggtgatctctctactacaaatctctgcagcaacaacaacggcaaaacacaagggtcagtatatatttttttctttatcacgcattggagcaggagacaccgagcatcttttataatgcaaggtgtgggaggcaatggagagaccaagaacggccacttgctctctctcaagctctggctccgtgcgtgcgtgcttgtgtggggaatcttttactaccaatgtgccaagatctcacagtttttgtgccggagcctgagatcgcgatgacacgagaggatgcgtaatagaaagtatatacggtgagatgtgatgatctagagaaatttaaaaaagaaaagaaaagaaagagggggagaattaaaaacgaagagcacacagcaagcgcggccacaatgtgacagccatgagggagaggaggcatgtgggaggaggaggcatcgagattttatagctaacacggggaaggcaacaaaacagggtacgcaacaaggcgcacacgaacaaaggcaaagctaaagggcagcatcagccatgaccggggaaagaggaacagtgagacccacccctctcctctactcttcctcctcaatctcaacccaagaactggtcaggaagacgagtggcgcctccagcctcctcctcctcccggatgcagccacgcaagtgtgcgcatccatccatccatccgccgtgtgcttgcacatgtgcatgtctctctctctctttatcgctcacttcagctttgtcaagcgtgcatgcttgtgagaaaagacggtgtggcaattaacctcagtggccttgcagggtggtgtactccgtcctcctccaatggccgcagcacccaggagtcaggaagccgggccagcgtgcctcctcgagtgcccacacaaagctcaccacgccaccctcgcaatgccagtagtgttgctgcagtgaggtaggacgagtcgaccaggctagaaca

SEQ ID NO: 60431 - DNA, 7211 bp, Oryza sativa
gtttatggcacagtatggggggtgatggggtgggcctacctgtccgtctttccagctgcagcctccgtgtccgtgcgtgcgtgcgctcgtcctcgtcctcttcgggcttgggccgggtaactgacggaaacccggcctgaacccggtcggttctgctcgaattggaccggtcttgggcctaaggctgagttggaaagaggaagtcacggtaattttctcgttttctattagcatattttcctaacagctaaacggtatgctttataaattaaaagatagtttatatagttttgtaagaaaagtgaaatatattcgtaatgttataattgtcaatatctaatctaattaattatgtgctaatgatttgttttttttttaaagccgccaactcctctagctgaactatcaaaatgaactcaagttaagaggctggctgtttgaggaagctcaagattaagataagcagcagctaggtagttactcccttggtcatatagaaaacaaatttaaaactggatgtaacaaattctagtataatgaatctggacagtcttaatatgtcacattcatttgttttttgtgggacaaaggaagtactccctccttatataaatcttagacctatttctttttcatcaataccaaaaagcaattaactcatacatcatgtggcaaaaataatggacatgcaaccaataagtacgaatgacttcttgatttttgatcaacaatttaatttagcacatagtaactacaaataagacttagattttttgaaaaaccaaataatgaaataggtctaagatttttagaaggatggagtagattctgagaattaaaaaaagctgtgtttttagcttctagttcattttatgaatctacagctacagtttctcaaaaattaaacaaaaagttgaactgtttgggaagtttctgattgtaggagaagttacagttgccagaaacccctccaaacatgctcttagtgttgagctcaatatgataatttgggataggcttagacatatactcctacaggggcgtccagggggcccgtgcgggccgtgcgaccgaatagggcccccaaattttaaggacccctaaaatattaagtatgccctatatataataatattagaggctttaattttattaatttgcagtccaaatagtagcaaacacaaggcccaaaacgctgcataaggtgaatcgatccatcttccatcgtactctcgtccaagagtctgcgtcgtctcgtatcgccgaagtcctgatgccgcagccgcttcgtctcctctccccagttctctccggcctccgcttctgcttcatcgctgatgatcggttaatcgtcacgcccatttttaattttactataaaaaatttactaggctactagggcctattttaatattttgcacggggacccgatttgaccgggacgctccagactcctactttctactctctccatataacctatggtaggatttgaggttaagttattttggatgaagagatttgacacacataattgaacaagtggggaaaaggaagctgtgttattagaaaacggtagtaagtacgtagcagtacaagcttacacacgtaagctggtcctctggtcccagatcgatcgcataaaaccaggggctcgcatggctaataatctgcgcctccgatcgataaagctatcccgccttttcgagttttgctacccatgcgccccgccgccctcgccctctcttcccctattctttatccgccgtcgccgagccgcctagcggccgccgtctcgcctccgcacgcgcgtcgccagcgacgagaagacgacgacccgtgccgtgcgccacccgcggcttggacggccgcgcgctttggcctttgggcgcgaaacgatgccgtgagctggcggggcgtacatcgcggtgaagctgtgggtatactccctcaagtaaaaaaaaaaccctaaaattaaatgtgacacatgctaatataataatgaatctgcatatgtgtcacattcaatacctactgttaacttttttatggaacagaagagcgctgtaatacattactctctttgtcctgtaaaaaacaaattagaaccagatgtgacatatcttggttatatgtcgcatctgataataagttggatttttatgggacggagagagtattacattggatcatgtcacgctctgtctaacacgctactcccttcgtcccataatgtagcaaccgactacgaatttaaacatgagacataaaaatccagattcatagttttaggttgggtctcatcccattctaaggctgtgttcgcaccacctcgttcccatccgaaacagtgtgcgcggaaaacggagcggtctattagcgcgcgattaattaagtattagctaaaattttttttaaaaaatggatcaatatgattttttaagcaactttcgtatataatttttttttgcaaaaaatgaactatttagccgtttgaaaagcgtgcgtgcagaatacgatagaaaggggttagggaccctgggttctgaacacatcctaaattgctacataagagcaagtctaatagtatagccaactattaactccaaatcatctagagccaatgtaggagtaatagccaattcatataatagttacttactatattattaatatctggtctcacctatcacacacacgttatgttttggagtccgtgttgcagctggctacagatctatggcccgctacttttctcttttttttttatctttttaaaatatgtttagagctggtttatagtcttgttattgtattgatcttttgagaggtaggaagtaacattttctttgggtaacacacgaaattggccggggtttcaggttcaacagctagcgcttcctacacggctactactacttctaccgtctaccgtgccagtgctcgtggtagcctggtacagtggtagccgtcgtagagagggatggacggcggatgatggcagtgggggggtccgttacgtccgtagctagggtggggatttactgcgtagcgtgagcgcgtgggcggtaacctcatgatagccctcgggtgccagtcttttgatgcgtgcccttgctcgctctgcccgcgacaacctatgatgatgttgcgcttcacgaaggcagggcattttcaccaggccgcacacacatattccaccactgctttttccctcccccttttcccgtacgtagccgtaggcgggtgaaacgagctctccgtccgtccgtccactcgcacgcatgcagaggaggtgaggaggaattacggtgtgttttcgtggcggtccaccgcgcggaggctcctctcctgttggttgccgtccagggcgtgcccatgacgtcgtcgctgctgctgcgaagctagtggaggactactactagtacgtgctggagaccgacgttagcccggacgtgctggatctccgtggtgtcaatcatgcgtgtttgacaagatcctggctcttctttggacatgtcatcaaattttggcacttgtgagtttgataaggaacatcaaaacatcagagcaagtttaatagtacggccaactactagcttcatattatgtatagctaatataatagccaattcatacaatagttacttactatactattaatatctggtcctacctatcatacacacattacgtcgtggagtccgtactacagctgactacaaatctgtaaaccgctgctattctctctctttctttatcactttaaaatatgtttatagctgacttataacatgctactgtacctgctcttagatcaagaaacatctcacatgttccaaaataatcaacttttacaccaaataaactaaggtcaggtaagattagatgtaaccttattccgtgaagataacatatatagcggtgctaactaaagaaaaataatatcatttatgcccttgcgcatttcacctattttctcaatggtttttgttacttcaatgcgttgacgcaaaattttccgcttgacgtactagatgtgtgtcaatcatgccagcattgaggccccggagatcgactaagatttagtgctggattatagatcttgatgaggtgcaggcgtgccagtcagtttgattctgtaactgacaatatgtcgatgtagcaacgactagctgacacggtggaacaatcggctgttggagagttggagacacgaacgttgatgacaattgcaagctcgagtctcgagtgtgtcaaaagcatgtgttagccgatagccgatagtcgatggtttggtacagaatcaacgggaggatccgatgctagtacttagcatgaacgcttttgatcgttgatgttgatggggctgtggacgattagttgtaagcttgttgtacaattggatcggatgatagttcgatacaaatagattcaaatagttagacaaatagtgaagtctcttttgctgcaattggctttggccaataggagtacaactattacctgctagttagggggggtgtccaaacttgtataaaaatccttgtcacccatctatttttaccgtaatctcgcgtatgtcctgatactaacgatctccatactctacaaataccgtagacaaggcataactcgtcaataatggttttttattggttctaggtatatcattagtggagattgtctgcgatactatcaaccacttctattgtagatgcaatactgcagatgatccgtgttcatatatcaaaactttcggttgcccgatcaaaactttcgcgccaaccgtcatcaacaccagagttcggaagcctcagaaactacttttcctccttaccatcgagagtttggttgatttttcgacgggagccggatcgcagaggacgaataatgccaacacggcgccttgccttttctttctctttccactgggtggatccgaatcgcatcatgctcaggtatccgaatctgacgaccgggggagtacttctagtgcgcattgaaagtttggcaacaaccctgagtggatccatatgttttcttgcacgggagaatcatgcacaccacagacacacacaagcagatgcagcccagtcgtggcagtgtgacaggcacagcccaatgccaaattgctctgatttgctgtctcggcgagagcagagccggggggcgggggccgtaccgaccagaggagcgtcgggatgggagttctcagctctccctgtggacgctggatggacgcgacgcgagggatcatcacatcacatcgcgtcgcgcctttcgcggcggcaagcgaggcatcggcatcgggcatcatggcccttgcgcgcacacaaaaaaacaggggcctgcgacgtggtgtgtgtgatctgaggaaacggaggaaagcggtggcgggtgagatgatcgcggagcagaggaggcgcgctgccatatgctagctacgcttcgcttccgcgggttctgcccatggtggcgtgacgcatcatgcgtgcttcgctcggagaaaagcgcggatgggacgatgggttgatgcacacccagccgaataatttcggtaggcgagttggtagtactggttgccaccacctgcaataacgagagagagggagaggtgcttggtggtaatggaagaagaaaggcttgtgcgccaggactctaaattctactccctccgttccaaaatataatggattttgagtttttgtttatattgtttgatcactcgtcttatttaaaaaatttatgtaaatataaaaaacaaaaagttgtgcttaaaatactttagataataaagtaagtcacaaaattaaataataattctaaattttttgaataagacgagtggttaaacaatgaaaaaaaaactcaaaatcccttatattataggacggagggagtgggtttgttgggcgtagctttaacttcaactctaaacttttctggagttaaaaatgctagccaaacagtttcaatttcattcgaaaagagagtgaagcgaactgaacgaaatatactaaagagatagagttgggttcagaatgcttcaaatttagaaattggagccctaccaaagacttgcttgggaaataagtaaggagatgcaaaacaaaagatgtagttctactcaacatgatcaattataaatcccgtatttgattcaacacgatcgttcaagatgagaattcggtaggacttgcgggcattgtggttagttgatttcttgctcacgtgagccaaatctggatctgtcgtgggatacttcttcagactttaataactcctgagcagtcctctcaagaactcgaggtgcaaggatcatgaagaccaaacagcagatcaatcgatagccaaggcctccttgactgcatcgtcaagctagccgctagcgttgatcaatcgatagccaaggccccccaggcccccacggctatgaatatcatgggcggcctctgcatttcgcagcgctacatgtataaagcatggcagtactgtattgccatcatatggtttgatggtgagtagtcttccaatcaattgcgtatcttcaattcagaagcaaaacgattgctctgtatatccagaaattcagacatagatcgatccactacttgcaaaatcgatgatcatgatgtattctgcccatactggggcttttcgtgtatgattaccattagcagccttgcagataagcagtgggcagccgtagacaactacatgggcaagagaaggagatgtacatatcctaactcactttgcaagatgtagacaaataatcacacccttcgtacacaaccaggccagccttgtccaactcctcctccttgtaacaggcacaccgctggctaacttgccccgtcagagctatgtcacctggtcttctgactaatcttggatagcctgtttcgcaccaaacctaacacatagcagagttttaaagaaggtttcacattaggcaaatttgttaagccaaaatgctttgtctagagttcagacttcagtctctagaacgaggagtaaccataaaatatactctctttttttttaagaagtactaacaaaatagacaaatattagttcaactcgatctatggatgtcaagcatcaacaaatttaaggccttacgggcatagcacacccccaggaaagccgtagtccttaggtatagagagtatatactgctatgatgctatctcagaggctggaat

SEQ ID NO: 60432 - DNA, 8116 bp, Oryza sativa
tatagataaaaaccaaaaattaattgcacagttagggaggaaatcgcgagacgaatcttttcgccttatcagtccatgagagccataagtgctacaataacccacatgtgctaatgatggattaattaggctcaaaagattcgtctcgcggtttccaggcgagttatgaaattagttttttcattcgtatccgaaaaccccttccgacatccagtcaaacatccgatgtgacacctaaaaattttcttttcgtgaactaaacaggccctaatagcgttgcttcatttgcttttcttctggctacaacacatttctccatgatttattttgttgccacttgccagctttgttgaacatcagtaattagcagggttgaattctggggatagagcataatccttgctaatgctcatcgagattgcaaagacccattagtaaccagtccaaaaatgggcttgagaagactagtgcactagaagaatgataaatcctagtacaaaacagtgcactactgccctgccaatgggcgaatggctgtatggagaactgtgagcatactcccaatggccaacagtgcaacttacatgatttttgtgtgtcaaattagggaaaatcacaattcagttcaattttcatgtgtgaatctgacaattggtaatgcgaggtttaatttcattattaattttttcatgagatgttctaataaaaaatcaaactgaaaacagcagcagttgaaaatcgatatgagggtacttacttcaccaccctcttgctggctccatttcgaattacagttgggtattttagcttcttcactcttctgtttctcaagaagctgagcacctctctttgccttcatctctatacccttgagatattttgtagggttgccttcatcgtcgtagtagcgtccaacgattttaccagcgaatctgcattacaggttcacagaaatattatggtaagacacatcatctagcaaggttttcttttacacgatccacaatttgcatgataactttagcgagtttcacatagcatataggaccttgcgctctaacatgaagaataccacataaacatgatttaaaaacacgggaaatttaaagcattcatcaggatagagagatcacatcaggagaaataacatcaagattcaagagcatgaagatgtcctacatgaagtcctcatattgacaagtaatcaaatgaaatggaagtaacttgacaaatcaatgaagaaaaagcagctcacatgtatctctcgaagtaaaattttctccagtcaacaatgctgtttacctgaaaggaagttacaaaaccaataataccttttttagagaacacacaggcataatactgattatgaaaaattcagcaacaaggaaacaggaaaaaaaaagattgggcttttaagctacagaagtggctcataacagagcaacctccaacatatgttcaaatataagctgcagaagtggctcataactacaagatgtgttatcttcagtttactactcccaccgtcccacttatattatgggatggaggtagtaagtttaaggtttccattagttatttaaatatacatgagatcaatatgctaatgacctcttcaactgtttacagtgttatgctgatcactatatcaatgtaaacattttctacagatcgtgatgcaagctaggcacactagtgacatgactacataagatgaagatttagttactatatgaacttccaaattataaaaatgttggtagctggtacgaggagcaagagaccaaactaattgaaattcacaatattcctatgcttgcgccttttatgtatggtcttctctcaacaatttattcttgaccatctagctgtaaactttacaatttttcttatagattctacaagacttataaatataaataaactatgagaactgtgttctcttgtcgtacctccatgctagataagccctgtaaagaatctgtcaaaccatcacctgttgaattagaaaaaagaggatattctaatgtaagtccatatgaacttctatagccatgacgacttcacatctcgactaccctcaataaaattatgaacatacttgaagggaaagatgtggatgcagatcctattacatcaatttctggcagaaattgaaatttggcgagcttccaagaacttcaacaatgaaaataaaccagtcaaagttatgtatcctactcttcatcgcacctgaccaactgcattttatgtatccaagccccatttacagcttcgacacaaatcaatcttaaatgtacccaatacccatgtgctacctacttctgttttcatatgtagatgtatgttgttgatgctttgctaggaagcaatgttttatgatgtctgcagtaaacatttataattcgataaagatctaggtgtcctaaatttagctaaaatgatcaacacagccagtgtaatttattcctaatactgtgcaataaacagtggatatcataatgatatagagtgtggcttgtgggtaatgtaaatgaacatcaactatgtaaacctattactatgcaagccaaaagcaataagatagcagatttacctgtaaaattcccagaaacaaatgcacgtgatgcatccctgttatggaaatgctgttttagtatcagcaagatgagataagttctctggaattatcctaacaaggcttaatactgctagtaaatgttaactccttttgagaattatcctaaagcattgctattgcattgctccttgtgagaattccaaaggccttgaaagataataacctgccagcgaagtgatgataaccacctccaggaccataattcgacttcccttttgtgacatcaaacaccgagctgcattatcaaacaaaagggaaaaataagtttgtaaatagtccatgcagtggaatggaaaatacaacagagaacaactaagtgaatccataatgcataacaaaacttaaaaacagcgaacgggcttataagaatttgcatttacaactgaacacaataagtttctatgatatggatataggtattacaatccacaaacaacagaggacaaacttcgcatcatggattgccacttgaagccactacaatactagtataatttgtgttaatagaattgcaggcatacgtgagataagtgtgaataccccaaaatcccaagtagtatgggcaagctctcgtccgttccattgtacactgctaactcttccttggtccacaacctctgccgagtataacacaggaagaagagaaaatagtgctcactatacgatcaaattttactattcacaatatcaaaaggaacatagccaaaagcctaaaacagatactccttccgtcctaaaatataagcatttttagctatgaatctggataactgtgtgtccagattcatagtaaaaaattattatattttgggacgaaggtagtagtaaatctaaatatgtagcagcagtaaagtccagcatacaccatacagttacagccttacggggcatatcattaatttcaccagaaatctgcgaagttgcaactgggaacatctagtactaatagcaactagcaaccagctgattttgcgggcgatttcggatccagaattccggatcagttgcaagcacaaaggcagcttccacacattagataacaaaaaacacgcaatatctaacctcaaactcacaggtaagccagtggaaaatttcgggagaagtagaagtagagaacgcaccggcttcctgaggcggtagagctggaggacgacggcgagcagcgcggcgaggagggcgaggcccaggaggaggcgagcgccaagcaccatacctcaggctcccgtgagatccaccagccgccgccacctcaccgctcacacagtactagactgacgaaccctcgagggcctgagacacgacggcaacggcgacggtggcgaccgtcgagttggtttacgggagctcgtcggagtggaaggggacggcccgcgaaggcagcggagcgggaggattagttgactgggccagtgggccgggcccgggatccacgcgacagtagtgcactttaatttttattctgacgtactcgctccgttttttttaataatagatgataccgttaatttttaatagtataatgtttcaccattagttttattcaaacaatttatatcaaagttatttattttattttgacttattgtatcattaaaaaactttaaatgtgagttatacttagcatgtttgcactaattttttaataggatgaacggccatacgttattttaaaagtcaacaacatcatttattaaaaaaacaaacaaatagtattactgtataatcgaacttattgatgaaaaaataaacatattcagatagagaacaattgtcagtttttttgggtgtatttcaattttatcagtattttcatcgggtgcattgcttttgttggtaagcctgcgttacacatacatcctgatgcaaggaatcacgtcaggtttaaatgttcacttcaatcagtttacaccgatatacgataactgtcctagaaaaacaatggacagaaacctgaaaaagcctgaaaacggtgtgcagaatgccgacctgcattttgttcagtcttcagacttggcctacagacgacaacgccgcaagcccgcaactcattggctgccgaacaaatcgaaacgtgaccttgcccagttgaacaaaacggcatgatgtgcgaggcatgatctgctgcaaatgagtcatgattttctcctacgctttgtaagcttcggcacggcacctgaaccacggcttgcattgcgtccctgcgatgaagacgcccctcgggcctctgtatttgcattctctgtgccctctccagtcgccgaatagctcatgcttttaccgctttgactttcagaaacctcgtcaataccctcacaggcatcacgtgtttcatgctccatttctgcaccagattgatccactcccgtatcttgctcgtcaccctcttccatgcagaatccaccaccggtgaagagatagtcttttggtgcagtgtccgtatggcaatcctcgggtaactcaaagcccgaaggatcttcgttcatatcagagggatctgtatgcgtttgatcgatgtttaattcactcgtatcctgatggagcagattagattgtgtgtcaagtccagccatgtgacacatgtcctcctccaaagaaccttggccctgattttcatcgatttgatgtatggaaacatcattatcatcagcttcctgaccatcttccgcgtatgtgacctgcttacgcttcctatttgactgcagaaacaacatcagcatgaaaaaaataataatgttactctccagtgcaaatattactgctcttcatgtgcagatcagaagaaatgcataaacaattctgattctttacttcaaaaaagaattgattctcaaagacaagcatgtgtgatattttgaggactacaagcatatgctaaacagctagcaataaatggaagctaattttctaggccagaaaggtttagatcacatcaaattagtgggcaatattacagtacggagaccttcaataacagcatcaaagagaacatgagaaagaaccatacaataagaagtgcagaaaaccataaggagtacttaccctgcgtaatgtcaatccctctgattcatagtcgttggtatgtctaatatgggaatcctcatcagatgctaaattagagacatcagaatcttccccatttccaattatcacatgtgcagcattcatgcttcttcttcctttgcctcttgaaccaccagaggagtttgcagttcttttcttactggacgtgcttttttctgtagtatgttcacctgcatctactaagctatcagcaatgtcatagtcctgatttcctgtgttaccaggcccaacatctttggttctttgccctttagccctaccacgaccagaggaggttctctctttcttcttgctggtattactagtactgggactatcatgatcaagttcatctgtctctagaaagcttttccctgtaatacccttgatagctttcttaatccttttgctacgaatttttgcaaatctctcattgaatgagtaaaacgcctccatgcgtagttgagtctgcatgtgtgtgacacatgaaactgtaaaatttaaataacccaattttgcagactttggattgctgacattccggttaaatcactcttagttaaatgaaatccaagcagaaaagcatgcctattctattttcaaaaggcagcgatttcctaaatgaaaataacttaaagacaatgaaacgaattgtcaaaaacttgctttttacagatgcctaaaatgcaaatgttgcagaacatggcaaaccagcaccagccgatccaaaaaaaatgtaaaatagaggtgaaatgctgacatcttaacaattgatgttctcaaaccgtaaaactaacttactagtaactcatttttttagggaacagaattcaatggtatccataaacatattatcacatcaaaccattctataataggataaataatagttacagtcttccagagactaacctcgtgcttattatactctctcaaaacaggaattagcagttcatcagccttttccttgctccacccaaacctttcccaacataacctgaaggaactcaacattagatcttctgttgttgcgccaaagaaaagaaatagagcatgtgtgttttttcataatcataatccttagttttgaaacagaactaacttgtgaagaaaaagatcagaacaaattgtcaaggtaatgataaggagctaaaaagcacattccacatcataaaaacaaattgattataacatatcaggcagctaaaagtaacagaacactctgctttctggtaaaacttgtctagggttttgcgctccacggtaccagtctgaacacctaccagaaacaagctggtgctggcatatcggatatattttaggtttttgagcggttaatgccactgccaatatgttggactacattgtccaccactttccagcaagaaaaacattgctgctcttaaaaactgattcaatacaaaaaagtgcagggaaatgaaatgaacggtatcttttattgtttgctcgcatccatgagaacataaggttattcaagaaagcttacttgcgcagtaagcctgaatctggtcttccccaggaaaatggttctgttgaatcatcaacttgtggggaaatatatgcgtttatgactgcttcactaggaaaagtagaaggaatatgccagttcttgctcacattcctctgataaataaatgataacaagtgcaaaagaaatattagtaaagcagtatctataatcaccatgcaattacagcaattgacaattcagtctataaagacaacatacttacatgcttactcataaatatttccttgatgcgttgggtctcattagaagattggctgtcatcagaacctttagcgtattcaggctcaaggctgtttccctttccgtctgaatgatttctgccagacttttttttctttgagctgctaccactttccataccaagttttcccagtaaagttggatctggtgattcaacccactccctgaacttttggagcccatcttcctcaggaaatgcgtgtgcaacttcaatagcattcacaatgccaatgccactgcataatcagtatataaataaatacactggacaaaacagaaactgaaatggcattttccccccttcaaaataagaaattgagatggcataattaaagtacaatgctctgtattcttaatgactgtatacataacaaatttgtccaacaaaacagagcatgcacttgatctctggaacagcaagtttttcagttcatatttcctttcaacgaaaaatgcaactcaacaagaaaaatgaagttctgatcttatttttatacaaactgcaaaaaaagttacaggatacatattcttgttagcatatcacctaattccttcagtgtagtcactcccaagaagcattgccatacgtattaattgttctcttgttagaccaagctcagact

SEQ ID NO: 60433 - DNA, 1783 bp, Oryza sativa
tgtcagatgcaaaacatgaagactattaattattactccatacaaaataaggagagtttcttatatgaaccaaggtaggagttggagttctggtgcaaagaaaaataagtataatcactatattgtgtagcaactgcatcaaaccatcacaattctgataagtcaaaaaattgatctaacattttaggaaaatgataccaaacacgattgcaacagacagcagtactaagcttacatcttaacagctaaatggcagcagaaagagcaactaaaatgactcaaaatgtgaataaaccaattcattctattacatcgtgcaagctgctagcacatctctccataaaacccattgataaatcctagtaaagcttacaatagttattcagtctttgtataccaaaagatgacatgagctaagattttgtgactacaaactttttgatgtccactattctcacctctcatttgagtaatacactctgcatcgggatgagcttaatctgctttcacggatgagaaaagatagtggacgaagcagaatgatgaaatgaatcccactgttccagtagccagcataatagcaataaccatgaagagtgagtagccgagatagagggtcgccgacacaggtccactcaagctctttaggtcaaaaacaagatagttgatcgagtacaagaaaatgtagatcgccacagatccagatgagaagaatgatttccaccaccatttccaatcctcgacacagagatgcatgtaggtcagaacaagggaaacctcagcgcagacaataacaaggagcaacaggacgatgaagaggaatccaaagacatagtacacacgccccatccatatgctagacatgatgaagaagagctcgatgaacagggtaccaaagggcagtgtgccagcgccgagaaccagcaaccaggatgggtacttctgaggtgggatttcacgagggatctggttagtgcgcacggggtactcaatgtgcggtgccttggcaccgaggagtccacctacaagtgtaagcggcacagagatacagaaccagagcagaatcaatatgacaaacaacgagaaggggatggctcctgtgctttggcttccccacaacaggaagttcagagtggtaaggatcaggaatgcaatgccggggaagaagcaagctaccctccatgaaacagccatccaccctgtatgatcaccgcacttgattgtcttccacacacgaacacccacatatcctgccaaaattccaagaaccagatagaagaacagcatgcccgtgatcagagtaccgcgggaagctggtgacatgaacccaagcgccgcaaacagaatggtcaccactgccatcccaaggatctgaacaccatccccgaccataacgcagagcaacattgggttgcttggcgcgcggaaaacatcactgacaacaagcttccacccagacagctcctcgttcatctgcgcctcgcttcactgtcaagctcctcatacctcgtcagatcacgcctcacggtcctcagtaatatgacaaacacgataccagcaaggaaagcaatcaccatgagcgagttgaggatcgagaaccagtgcaccttggcaccctccatcttgaagtatgcctcccacctcgagggccacttgatatcgctctcgacgaacgacacctcgtaggtgtacacgaagggctcgttctccttgatgctcatggacacggtggtcgggtcgcacttgatgctctccgggtacttgccatacatcttgagcgact

SEQ ID NO: 60434 - DNA, 732 bp, Oryza sativa
gggctctagctccaccgcctcctcctcgtcgtcgtcggtctcctccacgtcctcctcctcggggctctgcgtgtactcgaccgccgacacgagccacgggccacgggcagaccgcgagccacgggccgccgtctcgggcgacgccgcctcacctcgcgcttccgccccgtccgcccccgtgcaccaccgcccaccgccccggggcgctgtcgccctccgccgctcgccaccagccgcgtccgccgctgccacttgcgtcgccgcccacatcctcccctgcaccaccccacgaccgtgagagagagagattgaagagagaggaagaggggaagggcatgtgggtctcacatttttaaaaatagaaaatgctgactaggttgccacgcgtacgtcacgtaggacaaaacctcgaggggggtaattcgtctggtattgaaagttccgggtgaacaatatatgatttttgggttcagggatgtaattcggtcgaccgcggtagttcagaggataattcgtactttttcctttatattactggtagcaacgcatagaaattttagctggtctggctgaccggccggccgagagctgcagagaaatttcttccattctgaaataatagatgtttaaaaccatgctcaatcacacacacacacgcgtgtaatattaagatttaacatgtgaaaatggcaccaattatatatttctgttgtagtgattttagcttgtcat

SEQ ID NO: 60435 - DNA, 2927 bp, Oryza sativa
  unsure (1)..(2927): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttatgctggaattgataaaatgctttagtttagaagaacaattagtgtataatccgaggagttacaaccactcacacagttcgacgtaactgtatttcagacaaatgttggctatgcactattgcgtgttatcgcgctctcgtagtcgataactactcccaggttgtgttgtttgatcacccacgggttgatgaccatgtttgtcgcacactggcgtttttcgcgtgtggacttgtgccggccatgcaaaggttcgtcgtgttgcatgcgttgagctcgttatgccaacgacggttgcaccgacacattccactatttttgtggatatgtctgaatataatggttttattgtgaatattaccattgtcggaggtatggattatctctcgatggctatgtccaggggacattagcaaatgtggtttgataattcgctcgtggatcgtacctaatacatgctacttaactatgacccaattctagagtttggtatgagtaattggggtcaaacttgggcattagacgagctggactttaacacaactctgcaccacaaaaatctgcttggcagagcaggctagtggccgcgcactttgctatcatactccttgttgagcgcatcggaatgcgttttgccaccataggttgccttcttaagcatatgacatgcgatgtctaatgcacgtcgatccagaatcgattgtgagtttgaatggcactaggtgagcattaatccatggcgagtgcatttggctaaagtatttgcatgttggttgcatatacatttggtagcaatggtggtttttgcagacttgtatatcctaactaggaggttgaggataacccttcggaagaaggaagaatacaatattcatgccactgtattggtatatgtccaggctcactgcatataatgaaaaatctctcctattaaagtgcgtaaatatttcccaaatatatcaccaccgtagcatacattcgtgggagaacatttgtgatcgaggtgaaattccttaatcctatgccacgatatggggattggtagtatgctattgaaacacatctcggcattagggggagagaaatgcccattttggaatgcctggagatttctttgagtgaacacactaaatgagctgaacttgtatgtttagttcatactcctggttgcttggtgcacggagtttttgccaacaaaatcatatgaggaacaattggataattgttaaatagagtaatgctccaaattgtggtaaatgtggatagacccgggaataatatcgtatccacataagacttatggcatttgatcatgttctgcggggacgcctgctaacacggtccgtgggtcttagtcaaagcataagagttctcacaagatgtgagcatactcctctgattctcctggtggagaattcacctttggaaggtgatatacctcataatgatggtcgtcgtggagacgacattcctagcgatgcgcgcatatgatggtgctaggaatacggaacaaccatggatcgatcgttttgggaaatgacaaagatctggttaaatgtgtaagtgggaataaatgtgtcgacactatgtcgcctcttgctaatgattctctctgagagaacccggatccggaaaaagtccatggcatgagcatacgatgctcaaatcgggtcaaatggaaatgtaattgaggttgaaccgaatagccaattgaaaatcgcgaacgttgttcggatttttatgggtcattattaatataatgaggtggtgatgcgcgatggttcaagtaggtcctagatgagacctctcccacgtaagttgaatgttccgctaaataaaggtattggcaaaatggcatgaaattaaatatgcagctaacggatttaggaaatccgtgaggtcttgaatagactcggtagtgaagttccatcatgcaaatctcgtaccaatgggtattccggtaagagtaccatctcccgttgggagaaaatcacattgacggaattttctctgagggggagacctcattgatgaattttcctctcagatacaaaataattagtaagtctgaacacaccatattgtataatcccttggagggatgatgacccatttatgacctgataagattgaaatgaggaacccgatgagatcaaacagacggggtctgtaagcacatgtgcatctcacgattatcactggagtgtgtacactcgtgatatctattctacccgatggtaggaacagtggtgtcctctaatacctattgaggtatacttggtgttgttggctgtgtgttatccccacagtgcttaaattttcagactagctagttactctgatcgttacaacatgtctttggaaggcttgtggttgatcttgtggatccccaattgttgttgacatcgtcagagaaagttgcaatgatcaagacctagttcttgatggagtcacgccgaggaggtgcgtgccgttgcgacttatttatccccataatccttctgaaggatgaaatagattgcgttgcacaacagtatggtattgtggtatatgatagtgatggaatgcattactctctatgttccctattctcattttagtgatgaaatgagataagtcttttaagactaatggtttgaggatctgaa

SEQ ID NO: 60436 - DNA, 6404 bp, Oryza sativa
cctcacatgaggtttttaacgaggcaacaacgtgcaatgcatgagcgataactatgtactctttctcctagcctttttcccactgggttttggtaggagttttgacgaggcatgagttagtcgcggataggtctaagggggagtgttatggaatattatctcccggggagataaagatcctttcttgtggaccaatccgaaccggagtagagataagatctatctcctactaagacccctatatatacagggggagggtgtgacatctatggctaatggttggcttgtactccagataagatctataatgaagagagagttccaccctatatctgtattaattgtctacttctgcaatgttcttgacggcaaagggatgggcgcgggtgttctacatcatctcacgcctatactgttgtgggaaggacagggaacggatccggtgatccgctaataggcgcgttgatttacaacacatctaatcacgttttttcctgatttttgtgcaggtgtggcagcttcgcgacgcgaaaaaagacagttgccacgggaaaaaaggaaatgggctgtgcgtgaggacatgggccgcagagctgtgggccaaaaaaaaatgcgcgcgacttaagttaatggcgcgtctgtgctaattagcaatcccgtgtttgcactgcaccccatccaatagcccgacccataacgctgtcatgcagcccagaccaacctgccaggcctagtgggccacgtgcgcacgcaggagcctctcgcgaagagggctcacggcggcacagcccatccaacatttagcaattaccttcgtagactttgttgatctcaaataaataaataaataaatatatatatatatatatatatatacatatatacatatatatatacatatatacatatacatatatatacatatatacatatatatacatatatatatacatatatacatatatatatacatatatatatatacatatatatatatatataccggtatggttttttgaggtgctcataaagttagggcgtaagtttacacgtttatagaaatgaatgtgtatgtgttatgagcgtacaacttttttaaaagaaaaaaggaaaaaacaacatacgtatataggtacttgcaaagttggtcgatgaagttgcattaaggaaatatatattctactagaaaaagtgtccgtgcattacaccgggtgattacggagtgtgtatattgaccaaaagtgttggttggtttagcaaaagtgcccgtgcgttgcaacgggaagcgtacatatcagaaaaatatgcaattaattaaaatacaaattctctgaaatatttggtatttttaagtaggtatatgtgtataattaaataaatttacaagtagagcaagtatgagaaataaaatgacatggttaaatttaattttttttaaaattccccatgattagttacgctctttgaaattatattggaattttcagagcttaattgctaattttattaatacaaacatcatttaacaattatttaattggaaaaagaaaggaaatacttccttttaggtttgcttcgaaataaacacattcaataactataattgtaatgcttctgaaaaaatgagcgctaaaaatgaacttattctctttttttcagcccgagggacttaaaatagacttatttccggcccatgccggttggcccacggccttttgcgcatgcgcgggctcacttttcttccccaggccgcaacctaggcttgggccagaaaagatgcctcactctcgatccatcttgggccgattttggcccggacgacaccggccgtccgatctctagggttttgatcggacggccgagcgtcgatagtggggaaacaaaaccctctccctctcagccgccgaaaccctagcccatttccctccctcccatctcacttcgccttcgccgccctcccctccgcgcccccgagcggcagcggcacccctcctcccgtgagcggcggcggcggtggcggcgccccccctcccccctcctcctctccctctcgggtcggcggcggcgggttggtggtggccgcggcggatccgagggtgggggcggcggctccctccaccccctctaggctccctcccgcggcagattcggcggtcgtggcggcggctgcggctcccttctcccctctcgcctccctcccgccctagatccggcggcgatggatccgactgcgatggcggcgtcggcggcggcgcccccaccacccacggcggcgtcggcggcaccctcccccaccaccggcgcggatctaacgagaacgacggtgcccttcctcccgcgagcggcggcggcggcggagtcctcccccaccaccgacgacggcgtcggcggtgctctcccccaccaccggatccagcgggaggggagccgccggcagccagccgtccctgcggcggcgacggcgacggtggtggttcggcaacgacagcggcggcggcgactcccttcgatctaatttttggtttttatatttggatatatatgtgtacatgcatcatgatttgtgtgattgaactccgattgtgattgtgatttttttacgaggtttgattggattcggattgggattttgggggatgaggggcgacgaagcgggacgaaaaaccggtgtgacgaccggaaaaatacgaatatttatattaagttatagatatacataggagcaatatatgcaatatgcatagaactgatttttagcaagagtaggacctccaactgtcaacggtgccaaaactgagagtgctaatccaaaattaacagcctctcatgactaatccaaaaatcccactttacagtgccactgattttgtgggcctaacgttgggtcttgccgtcttgggtgcctgtgcaccagtgcgaggatagagcaagcaggaccgtaggatggaatggacggtggatattgtagaactgcacgctcatgacgttactatgcaaagtcagacgatccggttccgggggtgggagcgactccgaagcgggccagtctcggaatcccaaccaaacgggccgtgtgggaatgttgcaatccactcggacttccgaaacggaattggaattagtcacggcgaatccgtcggcgaggaagcctataaatcctattccgaaatccaccgattattcgtttactcgcgcgcgcgaagcaggcagaggaagatacgatgttgagctcaaagcgggcgttgcaggatcagcacagcagcaacaccgccatgtccagtaaaaggtcacgtcggagggacgacgataaacacatctacgtggtgcttgattgggacatgggatacgtcatccacaagctggacgtcgacgagttcaccgattccggcaccggcgccgccatgttccaccacctccctgagcacgccgccgtccgcatagaggcgccggtggacctctccttcccggccgtggccgcggtcggcagcaagatcgtcatcgccacgcatgctctccttgaggatgctcccgtcttcatgtacgacacggggacgtcgtcgctggccgccggccctcgcccgacggcgccgctgatgccgggcatcatggtgcccgtccacggccagcggctgtacgcgctggaccctcgcagcgcgtcgaagcactacctccaggtgatgtcgccggcgccccgcgacgacgactaccccgcgcgcgactcgttcaggttttccgggcgggccgagcggtggtcatgggagagcgtcccctcgccgtcgccgccgccgttcgccggcgccggccgcgaccccatgttcgtcaccgcctacgccgtgcacccggacggccgcaccgtcttcgtgtcggcgcacaaccggcgcgccggggacgacgaacgccggaggcagggcacctacgccctcgacatcgcccgccgccgtccggccgcggcagcgtggacgccgctcggcgactggctgctgccgttccagggccagggacactacgtcgacgatctggacgcgtgggtcgggctcgacgacgacggccgcctctgctcctgcgacgtcgcgtctcgcggcgccgcggcatcggccgccgcgctcggttccaagatcaccgaggagacgctgcttcgcgaggaccccaagaggcacgtagggcatccctcgggcgccacgctcgcgtacatgggcgacggcgtgttctgcctcgtcgagtgcgcgcttcgccgtggcctcgacatggcggacgccctgtgcgcggaggatggatgcgtgctccacgtgaccgtgtttgggctcagctacgacaaggcgggggagctgcggatttcacctcgccgccgtggtcgcacgtacctggtgtctaggtataaccacgtagtcgcaccaaaagtattctggatgtaaaagttcaatccgttttttgttgaaataaaagtgtttctttacaatttttcaactaggtctggtcctaataagattttttttttgaaattgctaaataacagttgcaagtttttttttagtgaaaaacgttaatatgttttttttgcggggaataacgtataataatatgttaataaaagtataataatctgttgtcaagcaccgagaccttttcttttttttttaggaaaacactgtaggggaagcccccacagttaaaacattttattaaaaaatagaattacaaaagttacaaattgtctagccaggaacaaaaaaaacttatctatcatctaatcttagacggaaaaacaagaagggacatatcattctttaagaacgacatccaggaaggaacagaaggcacaacattctcaaaaatgaacctatttcgttacttccaaatattccaggccgcataaagaaccttttccaggaagtgcgaagattgataggagttcttggcatgtgttagcatattctcaaaagagtaggagagatttcagactataccaaattgctcccagcgatcagtacaaaagggacaggagaagaaaaggtgctcaagggtttctctttctccaaatgagcatagaacacaggttaaatcacttccttgaggagcataaaactttctgtcaagcatatcacgagtgttcaatctatcaatgagaaggagccaaccaaaaaccttaaccttcatagtgcagctactcttccagatccattttagatatacaggggactgcacatccatgaaatttgtagcataaattttctgagaagagaacctgtcattgccccatatataggaccatttatgatactcatcagagagccgatccaaagggtctgccatttgaatttgaagatactcctgataggccagatctgacaaaggaaggaataacatctgagatagatcctttaaagaagtctgcagcattgagtctttctagtttcttacaaaggagaaagctctaggataagacactgatattatattatcattccaaaagtcagtccaaaataaacaagtcttgccatcaccaactgtacacttagataagcctctgaaaatatcaatgaactgcaagacatctttccaccaaaaagaaccccttaaagacaaggcatgtggaactttatcagggtaatatgtagtccaaattagatttacccaaggaacaggatgcctattatagaacttatgaagatttttcatcaacagagcattgttctgaaatttaaggtctattactcccaaaccccccttggatttgggctggcaaaccctatcccaaagaactaaaggcttcttacttgaatttatgtctcatcctctccataaacaatgtctacttgctctatcaatagagttaatgacacttttcggcaaagagagagtacacatgtagtaagttggcaaagaagagagcactgagttcaccatagttaatctatcaccataagatagcaaagctgaggtagcatacaaccttctttcaattctatcaacaagagggctgaaatcaattaccttgggcctatttatacccatgggtaaacccaagtaagtgaatcgcaaggtaccaatcatgcaaccaaacatcttagataagtgctgtactttttcaggctgcacattgagaggaatcaggcatgacttctcaaaatttatcttcagccctgtcgaggaggcaaaagtattcaaaattgcctttaagctgaaaagctcatttgatgatgcagataagaagagtagcgtatcatcagcatattgcacaattggaaaatcattgtcaggagttgggataggcatagatattacattgtgttgataggcactattaataatagactgtaagagatcagcccctaaaacaaaaagaagaggagacaagggatctccttgcctaacccctctcttgcagtaaaaagactttctaggaa

SEQ ID NO: 60437 - DNA, 2409 bp, Oryza sativa
aacatatagaaatcttgcttgatcaaagggcaacatttttttcataaaaggccattaaacccatcaggtccaggggccctatctataggcattttattaacaactccatcaatttcagagatagaaatattatcaaacagattgataagtcattcacaaggtgataaaagctgactaagctgaaaatgcatttggggcttagaagttacccccatcctttgctgaaaagtctagaaaatgacagcagccttctcagcatgcccagagagagagataccatcattagatttaagatgagtaattagatttcttttgtatcattctgtagcagctgcatgaaaaaatttggtgttctcaccaccaaacctgacccatctaacagtacatctcttttgcaatataaatgtatgtatctcatatatagaactgctttccctttgataatatttctcagattccactcagccaaagtaagatccctgagttcgtctattctgtcaatgaaagaagtgaccaaagagcagtttttaataaccaaattaagcctgggcaaacccttgctccacttttttaagcccttccttaagcttttgaacttgagagagatatttttagctgaatcctggcagttcccattaccacaccaaattgaagagaccaaataaaaaaaaaccttcatgctccacccaaaaattttcaaacccaaacagatttgttttggggatagaagttacaatttgaaccacacaaggtatatgatctgaaacgactcttgagagagatttgactaaagtatttggatatgaggaagtccaagaaactatggtaaaaaaccagtctcattgctcaagcaggggagaatcttgcatattactccaggtataggccttccctttaagaggaatctcaagaattcccaaattactgataacctcattaaaaaatcattatatcattcatattagcaccatctctatttctattgtcaactgatctatagaaattaaaatctcccataaggatccaattctcattatcaggaatatctaaatcatgaagccattgcacaaaggccgatctatctggttcatggcaggggccatagactactactagagtccaacattcaccattatgcttggaacaaaattgaattatgactgcagatctagagatgctgatgacattagcagagaacaaagcaccaatccagcaaactaaaatgccaccagaagctccaactgagggagagaaacaaaaagaatcgaaccgttttggggctaatttctttatataagcagtgtcaaaaaaatctcttttagtttcctgcagacagaaaactgaacaaccactctcctcaatattttgcctaaccgtcctccactttccttcagctctatgattactcataattaactagaggtaggcagggaaacacacaatataacaaagttatactgctggaaagataacaatgcagaggaaagcagtcttaattgactgtagaaggaacgacaaaaggaacagcaagtagcaaacctgcacaaccagaggggggaattattacagccaaaaggaacatgaaggacatgagacttagcagacacataaactctaaaccaacaggaaagaatcacacttttattcttgactcctaaaagagactgcaactggaaggacttaattgttcccatcagattcatttggagcccgcgtcttcaaaaggtcaatttgggacacctcttgagcagaagcaccacacagatcaactgccatttttttgcaaaagaggcacgagcagtcagcaggcgcaccagaagcatcttcagtggtagacccttcctcaaaatccgagtcttgcagatcacaaccagagaacagaagacctacctccttggccacttgcttcaatttcttaactgatttacctctaggtttcccaatgccctgatttggatctggctgagtgagaaattcatctttgtgcccatcatttaaagcagacaatctagaactccttcttaacccaacagttgtgattggagtgtcaatccgtatttttggactcttaactggagcaggaagcacatggaccacaggtgggactataaccaaatgagtaagcataagtactggcaattccgattccattccctgactatagcccagatgctgcctagaagaagatgattcaccaggcatatatggtccaatactgagagcagcccaaaaggaagaatcttgagtaaagtgtttatcaaacatggtatggggaaacctctcacaaagataattatataagtcagcatgaacagaatccttatgaaccacaatactcttgtctggagaggttaaagcctgttcatcagtagatatgctgactgccgaatccgcaatacttgcagagct

SEQ ID NO: 60438 - DNA, 13610 bp, Oryza sativa
caaaagtagacaccacttgattgatgttataaaaattgacatagtccaaaggaaaatcaagcatcattatccaccctctatgatcataaggaacattacgccagtttggaccctaatcatgcctaacaaatctaacctcatggtttccatcatagttaataggcagcccaagaacaagtgcatctctttgatccggagaatcaatctgaaacagggcaacaacatttgggtgtggaaaagaagcagcaactcgaacatggctgacttgttcaaaaaacccactaatctcagccctatgttcatcccaaaggtcttcaggtaaagcaggatgaacaatagctagcacaaaatcctcatgccgcattggagtaggaatgaagtttactgtgtcaacccttcgacggtgatttggaccagccggatgcaagtgctgccccggcgggatgaaccagagaggatgaggttgaaggttcgccattggtgaactcgagttcgtcgccggagaaagaggggggtttactgtggagtcgggtgaagagagaggatgcgacacagtggggattacagagtttataggagattttgcacccaaattttccgcgaattggttgcggcttccacgaaactggttgtggcttaactcccttgggctgatccatgggctttttctcatggcccaaaaaggggtggatagaatattttttttaaaataattatgcttggaagtcggatcaggcttatcggtcttctgatgagagactaagtcattggacaaagacttaggggccatggaagacgaatcatgactatcagaacgatgatcaccgtcggcaatccgtcgagcaaccttttctggctccttagaagaaacattattaagcagaactccagcaggacgagatgaagaactattaagcactcgaaaacgattaaaaacagatgagactgggatcactgaatgatttgaaggagatttgcctttctttctcttgacaatagtccattcatctgattgctctttttcccagcgcatgaactcataagaccaattaggacttccattgcgccacaagaaaaaacgaagatgaaatggcggcagataaaagatctaagcttataaatacacaaagaaagagaagcatcgatcccttatatgactaacatagaaatcagtaggagatccacctaaacaagcccgaagagctaaagccagggagttctcattcaagcaaaaggtcgatcgcgaaacgtcaacaaccaaacgaaaaggagaaggactgaagtacgaagaaaagtgaaccggagtaccatgaatttgccagcactgatcccttagctaattgccgggggaaaaatcccagccaccaggggggagggagtcgccatgaagatcaatcgccattgcaatcgccaaaggaatcagctctggagaaaacggaagtcgccatcctgaacgtattgagcaccctgtttattccgaaaccttttctgagagcatgaggaaaacaaatggtcgcttctcctttgctacattaggattgaacagttgaacctctaagttcaactaaaattatagaggaaattcgtgtatctctgaattttggctcaccatctatatgcccttgaattttcattttgatatcctacatccatattctgttagttgattgtgagttaactgttagatttttctaaaataaccatatcgtccatttctcatacttacatgctatatctacttcataattcataatgtgaaaaactgtaattcatgataaaataaaatggggaataattagttatggtaaattcgaaaaagaaaaattaaattggtgaacaattttttttttgacaaaatccatataagagcattagctagaaattatgttttttttaaccgaaactatttatttattgggttcaaattttgatgaaaacaatgtatgaatttcaaaaagataaattaaaaattatttaaaacttttagattttttaaaaaagtgtcaaataatcatatttcctttgtttttttttacaaatagatcttttttatataagaattgtgtttttattactaaactagcacataaatataagagagggataatatagtcaatttaaaaaacatttaatggtcaactaacagaataggcatagaggagacgaaaataaaaactcaggggtatataagggataaggcaaaatttagcggcacacaagggattgaacaaattctcaaaggtacatagcggattttctcaaaatagaagatcaagcatttcatgtcagggtatagttcaaaggaacaagttcaatttgactcccttaactagaggcctagactgatttgtatgcctgaaccacaatacccgatatctcgacccctaactattaaaaccggtgtaaattgactcccttgatagttttgaaggacggttttgctaacgttgtggtattgacctagtgtggcgttagaatttaaaaaatatgtgtgggacccatttttcattcacaaagaaaattcctcttccccttcggtcagcgaggatcggagcggcagcggcgggcgagaaggcgcgcgaggcgcaacggcgatggcgcaggcatgggcacgggagatggcgcacgcctctcattcctcaaccatggcgcgggcgtgggccttcacacgctgtcccccaacgccgcacccttgccgtcgccgatccccgtagttgtcccaccatcgccgctccggagctcgagggacaataagggagtgcggggcggtgactagcggtcgacggtggcagcagcgggatggagctcggcaagggagctctaggcggcggcgccccgcaacgacggggacggctctctttctctccccttctccccggtctccttatcttctttgcggggacagcgagggagtgcggggcagcgacctatggtggtcgatcgcaacgacgagatggagcttggccagggagctctagggcagtggcgtcgacggcggtgatgaggatggctctctctccccttctccttggtcttcttttcttcttcacaccgcttcctttgccttcgccactgtgggctcgcctttgccgctccagccctcacccaccctcccacccgctgccaccctcgcctcccgtctggctgtcactgaccaaaggggaagaggaaggggagagaaagagaaagaaagagagaagagggagagagagagggagagggaggaagaagaaagagatagaggatgacacgtgggccctgtaattttgtgtgtgaataacaaatgggtctcacttatatgtttttaactctaatgccacctaagcgccacgttaacaccacagaccacgtcaacactgccatgcggacgccacgtcagcgaaactgccctccaaaattaccgtgggagtcaaattagaccggttttaataggagctgggttgagatatttggtattgcagttcaaggataagaattagattcaggaataagatcactttgactccctcaactgaccaccgaatctaaattgtatctctcaattgcaataccagaaatctcaacccccgaacttgcaaaaccggtgcaatttgactccctcggcggttttggggggtggtttcgctgatgtggcgccacgtggtgcctatgtggcgatattgatcgagtcttcggtccacgtggcgttgacgtggcacttacgtggtagtagaattaaaaaatatgtgtgggacccattagtcattcacaaaaaaaatgtgggcccacttacatgtggggcccacatgtcagcccttccttcttcctcctccctctctcccttctctctctttctctccccttcttcccattaggccgacgtgcaggagggcggctagcggcatcgaggcgcatcggaaccggaccaggggcggcggtcagcggctaggacgacggcggctcggccgtagtggctcgcggcagtgggaggacaaggggaacggtggcggcgacccgcgctgccgctcgtcatcctcgtcctcgcggttaccggcacagtctctgacggctcgcggggtcgtcgtcggtgacaaagcgactggcgcggggggtgatgaggaggccgctggagaagaccggggcggtggggctggagaaggccggggcgttgtcctgctcgtgtgcgccgcgtcactccactactcgaccgccgtcagctcgtcgctggcggcgcccaagaagctccgatggccgccgccgctccggttctgctgcgccacgatggctgtcgctgctccggttctgctgcgccacgatggccgccgctgctccactcgtccgtgcgccgttgccatcgtcggtggaccccggcggtgcgccaccgcctccccaccgaggcagagctgggccggccgctcgctctcgctaccctcccgcccgccggccgaatgggaagaaagggagagattgagagaaagagagagagggaggaggaagtaggaaggactgacatgtgggccccacatgtcagtgggcccatatttctttttgtgtgaatgactaatgggtcccacgcatattttttaattctactgccacgccaacgccacgttgaccgaagactcggtcaatatcgccacataggtgccacgtggcgccacatcagcgaaaccaccccaaaaccgctgagggagtcaaattgcaccggttttgcaagttcggggggtcgagatttctggtattgcagttgagggatacgatttagattcggtggtcagttgagggagtcaaagtgatcttattccttagattcagtaactagttaagggaccaaagtgaacttattcctatttaaaaaggattttgttattcggcccatggagatatttttgtacggatcactccgagtcatcaactccaagaaggctggcccaatccatgcataaatgcaaaaatcaaataaagcccattaacaattccttcccatctccttcttgacctcttgccagttctctgccaggttatatgacccactatccaacatgtgaatatgtgatagtagatggatagttgctcaactccataactcagcacaaatgaggatcttgagttatggatgggccttcaaaatcatttggaccactcccagaaagtgaactgataactgatagcccaccgaaacattcggcttctgcctgttttagcatttttgtcgctcccaatattacttgacaaaattcaggatttgggactccacgtgaagacattatggtcccattatagataccctaatggctaaacctaaaaaagaaactatacagccccattattttgcttatacttatgattatatgtacgacttattagcaataaaaaataatttataaatataatttttatatgtgttcttagcgtttcaaagccaaatattgtaaaataaaccataataagaaaaacataaaatcatctgtaaaactaagttttaaaatttaagcataagtataagcaagacgatggggccatatgagtggcaaatcttgaaatccctatgggcaataagatacaagggatgtttaggggagctgctagatgttgcagcttctcccaaactgtccaatggtctgtttgagagagattaagattctaagaagcagctggttggtagttagcttctaagaatctgtaaaagttaggtttcccaacttctggattctagttcattttttggaatctacaactacagcttctcagaatctggagcaaaagctggactgtttgggggagcttatgattctgggagaagctgcagcagctagaagctcccccaaacagaccccaacttttggtccagattctaagaagctgtagttataaaatccagaaaataaactagaagtcagaagttggacacccaacgtttccagattcttagaagatggttatcaaacagttacttctcagaatcttaagctcacctagctcttgtatatcttggatgattgcacataaaccaacttgtctaaaaacactaaaatttctgagggtgaaaggagcggaagatataaattgtatggttttctatgcgtttgatttaacaaaactagcagctttgctcgtttgacttatgaataactatccgttgagaaatggactagtaggcaatgtcaaaacttttatacctatatcttttcatcgatttaaaaaccaatgctgcgatgaaagaaacaaaaccactcaaaatcgactctctaaaaaatagttttaaattttcaagttttgctacgattcaaaaggcaacaagaagacgaggagaggccgccttcacaaaagatttcccatgccacattcagcccaacttcttttagctggtgaaccatcaaattgtgggagggttgggaccgtgtggatctcggctcacagagggcacacagtactctgtcctagccccgtgacattaccggccatgtgcaactgctagccttggagggaccgatccagacgaggggagggagctccaccgtcgattccctgcgaagctccacgtacgcttgcctccaacaaatcgggaggacccatcgtctcatgggggagatttcagtactgcaggtccactgtactatcctgtctatctgaagctcaagatcgatcaaactggtggttaccagcaccccatgagcactgtagctagatagccggcatccagcagttacagtggacaagttggacacttgtctgtcgccggccaccgccatgtgtccatccgttaattagttcctcttctctggccttctcatgaaaaagatgaaaaatataaatgcaacgtggatatatatccgttcgttctagcttaagaccaaattggttatttcctcctcggtgctagctagtatcgagctatcgatcatctgcatgcccattcgatgaaaccaatcaacaatcgcaaatacgtagtacatgtcacttgcgtaggcagagctagctactgatcaatcatcgtgtgcatatctggcagcttaatatgatgatatgattgaccgaccacgcatgcattcgagtatggttgatagaccaggtctgtatcttcgaaatctgccatactccctctaaaaaaaactcaaaacttgtgaccgttcttgatacgacaaatctatataataattattcaaatttgttgtgacctttcttagattgagtttttttttacggaaaaagtatattgttatcgattaagcagtggctcccctacttcctcctcccactactactggttgccttcgacataaataaaagctgatcaatattgcaatgaaactttataagtcatctggactcaacgacgaccagtgacaaacgtatgattaaaatttaggagattaaaaaaaaagacaacgcgacggtagtgactaaaataggagacaaaacataaatcaaacatcaattggatacgaacgttgtttgctttcctaacatgccaactagtactctatatactgccgactgccctcttgccttgagtggtatacactatgggcatctaatggacttggatgcagtagggggtggtccctcgtgcctccttgctgtgctcgcccttaacgatgatgctgttggctccttcactgtgactaagggtttgacataacattgctctgcttcgtctgaaatgagttcatacgtgaaagataatctgtactttaaaaaaaaaagagattagtagcactaccttttctttaagctgaaaaagggagtaaatatcagtacgggcaagacaaaaagttccaacagatcgaacagctcttcttttaggaacacgaaccggagagctgcgtgtggcaaccgatttgttgcttcatcaatatggaaagtacgtgctcgtcgaacagtattaatggtgcgtgaatgtgtgagtgtgattgagatgctgtatatatttagagcacacactttagtagtgtacagtgatctgggtttagctagctggttgtacagtactattaagatcgatcaaccacatcttgtgtactgtcacccatcttggaaggggtcgacgtggactgttcatccaaaaccttttgattttgtggtatccatatatgttggtagagaacccagtagaaggccagtcactcgaatcttttctcaattaatggtgccgcgaccaaattggtacccacggtacaagtgatcgatactctagctcgttactacatctacagcgagtactaactaactaatgcacgaccaacactgacttaccatgtcgaaaagctagcaaaaaatcgtgctgtgaaatatctatgtcaacagaatatatatgaaatattgtcatcataataaatcatcatgtgtatcatctcatcgggggccagctagctgcctttcgtcagaagtttcccaaaaccaaaccgttgttgttactcatacttcgctgttaagtgtaacatctgatgaacacgcttgctggcatatccctaaattaaacctcgtgcacacatatgctacaaatgacacgcaatatgtcaatatgaatagcactcaagatgcctaaaggttttcaccttaattagcttaagtggtgcatgcaccgtgtatgcatgcatgccacgctttatctactgttaatttgtgctaccgactttcttattagttgtgaggtaccagtaaatagcataattactccaccagatacttcctttatggacagtactaaaagccaaatcaatgacacatgcacctatcatattagtcatcacatgataatcaattaacttaggaccaaccctgtcacttcagcttcaagtttttagattggtattggagctgagcatgactaaaattattagtactccctccgtttcacaatgtaagtcattctaacatttcccatattcatattgatattaaaaaatctagacatatatatatctatctagattcattaacatcaatatgaatgtgagaaatgctataataacttacattgtgaaacggaggaagtatgaggcatcttagtcacattttagactaaaatacttttatccagcttacaaattaattccatttttacataggttttgaccaagaatagatgaactttgatagttagtattatttaagcacaacaaagtgttccataagttccaatgtaagaagtactccacctatttcatactagtagttttagagaaaaaatagcaacatgtatgacaacaaattatcatcaaatccatatgtttttatagtatatttattttatgttaaaaatattgctatattttttataaacttggttagagttgaagatgcttgacttaggataaatataaagtaacttataatataaaatggatggagtactaaattacttttgatcacaaatctagctaactacaactttgcacctgtttagagacattttcacaaccatggcttaagccatgggaatcaaaagaacaaaaaaaaattatgttaagattctatatttctactggtatgccttgttctaaagtgcaactagctaggtactcgattatcatcggcatacttctcaaactaccaaatatggtacgttttaacctttctttttttaaaaaaaaattcttgaatactttttaaaatccaccttttcaacttggcaacatattataataaattaatcaattttctaattaccctgctaataatgacctgagtcaaatgggaccgagtggttcaaaagtcaatactgaaaaaaaaataaaggcattgattcatgtgatgctagcaaaaccaacagaaaaaaaacacgaagttagttctaaaactcataagacttcgtaacattgtccatatttatttagatgttaatgaatctagacatatgtatatatctagattcattataatatctatatgtatgtggataatgctagaaagacttacattgtgaaacggagggagtaattcgatatggcttataagttgcagctaaaacaagctgggatgctatgctaaataattatattagttaaaaagaatattgttgatcaaaagtttgcaactcaaagggaataattgataattactttttaacgggggagtatatgagttagagctaccatgggccttaatactagtcttctgtgacgtcttctccatgctttagtactagctaacatgcacttcgcctggcgaggcacacgcatgcatatcttctatagatacaaaaccctagtggcatcgcaaccaccgaacatgctgtcatcgtcatgaaactaaaccggtgaccactgccacagttgagctggcctatttccgaaacaaaaccaacaaattgttaacccatgatactactaatacaattatcataccactagtacggaactcacacacctgacgactcccatgtaaaaccaatgtagaaggaagagaggctaaaaaaaggaaaaagagatcgctctaaattgggctacttgaaaagactgaaacacaaacaccataaaccaaaggtgtgttctaaagtgaagttgggttgaacgcccaactaattctacactactaataagctatgtgtttcatgaaaaactttcaatgcaagggtttctttaaaaagcaaataaattcattttttaaagtttgtagtagttaattattagtatgtaattaattatatactttccactaaatagccaaacctaaccactgtatcaaactcagccttgagctgaattacatgcatatactgatataccaccaggcaccagttcatatcattgtggttttcgctgaactccacgtcacttacaaacaacaataagaaatcaataattacaacactaatcaatttatacaagcatccaacattaatagaaggggcacttagatttctttaaaaccatgcccaagtcatcacgaaaaacatctactttcccatctatcatcttatcccatcatctgtctcaacaaaatacctatatagttgtacttagaatgagttcttttatacctttttttctaacttttttccctcgttttcacgtacatacatcttgaaccgctaaactatgttttttttttataaaaagttctacacgaaagttttataaaagaatcatattaacatatttttaaaattattttagctcctacttactacctccatctcagaatacttattattctaggtcgtttagcatgtgctaggtttttagttctgttctaaatataaggtttttaagtgatatatattgtccgattataacactaaaaatattatcgcagtatatacggttcaggaaaaaaaggaatatctcgctgacgcatgacgaaaacaacattttgggatgaaattttgtggccgctgcttttcacatgagagatgcgaagcagacaagacaatgaaacagaaatctgactcgcgtcgtgcagaggttcacatgggagagcgagagcgagagctagagagagagacaggtgtgtgttggatgcagcgaggcggtgcgggcagcagcaaggcgacgtgcagcttttgcgctttttttgcagcaaagtcagaccgcgcgatccaagtgtacagtggtacgtctcgccccggccgatggatggatggatcgatcgaccggtgggaggccggatgggcgaaggggggagagagagagcgaccggccgcgtccacgtagagtcgtgtctcccctcgctggccgcttctccttttgcaacggcacccgcgacggccggacggagagagagagagggcttgaagccgttcgttcccttgagagttgagacatggagcccggcgcgcatatacgtccttctcgtgactcatggagtcatggtttgatggctagctctgacgtgatggcacacggtcaggtagctagtagcagtagcaagtagacgagcagcccatgcactcgatcgacatgatctccggttgaatcttcgaacatgcttataggggtatgtttgcgtgtgtgtttataggggtgagtgtgcgtgtattgtgagtgtctgtgttgtattgtgtaagttaaaaaaaccactactcccttcgtttcatgttataagacgttttgactgttttaagtttgattaagtttgtagaaaaaattaataacattttcaacccaagataaatttattatgaaaatatatttaattattgattcgactaaactaatttagtattatatatagtactatatatttatctataaatttagttaaacttaaaacagcttaattttgatcaaagtcaaaacgtcttgtattctgaaacggagggaagtagagtattgtaatgactgtaccggtctgtgtctttcctttctctggatcgctgctttcaattagagagagatacgctgtcatgtgggacgacctggaccgtttcgcaaaatactcatgcctccgcaatgcaaaacgtgccttaaaaccgtcataaagcgtgtaatcataatgtaaaatacctttgcaatcgaacccgatcgagaagactgcggagatatttccccctcgaacgagtcagtgatggtagcagtaattaagacgggagaatatacttataatctattatattattaaataaatagaaaaaggagcctccacgttcacttttatggcctagaaattctcacattaatcggagaaaaagaaaaagcagagtccatatagaaatacaatttagaaatagctgaaattcggaattaaaaaataaggaatattagaataggagactagagtccatatagaaatacaatttagaaatagttcaaattcggaattaaaaaataaggaatattagaagaggagactagagtccatatagaaatacaattaggaaataactgaaattccatatagaaatacaattaggaaataactaaaattcggaattaaaaataaggaatattagaagtagagtatagagtccatatagaaatacaattaagaaataactgaaattcagaattaaaaataaggaatactagaagtagagtacagagtccatatagaaatacaattaggaaataactgaaattcggaattaaaaataaggaatattagaagtagagtatagagccatatagaaatacaattaggaaataactgaaattcggaattaaaaataaggaatattagaagtagagtatatagtccatatagaaatacaattaggaaataatagaaattcggaattaaaaataaggaatattagaagtgaagtatagagtccatataggaatttaaaactaactaaaatttggaataaacataataaaattaaaagtagagattagagtccgtataaaaaaacaatttacaaataactaaaattcgaaattaagaaaaacatgggaagaagagtttaaagtcaatataggaatacaatttagaagtaactgaaattcgaaattaaaaattaaagaataaattaataacattttcaacccaagataaatttattatgaaaatatatttaattattgattcgactaaataatttagtattatatatagtactatatatttatctataaatttagttaaacttaaaacagcttaattttgatcaaagtcaaaacgtcttgtattctgaaacggagggaagtagagtattgtaatgactgtaccggtctgtgtctttcctt

SEQ ID NO: 60439 - DNA, 30140 bp, Oryza sativa
tatgttgtcattttaatatatttaaataataaaataagaaaacatatatactattatataagagaaaatataacgatgctagccgcgtaatctgcacgggccaccatgctagttatactatacagtacaaacgacgattgatgtacgtggcttctacataactctagtaagagtacccacaatgataaagtaaggtgctatctataaaagatgtacatcttagcaatagactagattaatagtaaactactttaatggtatgtctacatgggtatctatagctctctaatcaattgcctcgtttttctctatagagtatctcaaggttagtagatagctttgctctctctcttcatttaatttcttccaagtaggaaaatatgctgatatatatctcttgtagagcctatagataattattgtgggtgccctaagttcgaggacgctaatcatagccaaaacccaatcgcttgcaaatcatgcgttccttgcttacactgtagtagagtagtagtactactacggcgcggctgatgacgaggagggtgtcattaattagcgccacaatcattcagctgtggcgcaatgataccggtcttgccaagccaaagctaatctgcgtctcacacttcacgcacgccgtctcgcgggcgagatcccgcattccagccatccacgcgccccagcgcgcgcgagcgacgagcgatccactccccccgctcgcgcccgcgcgcgccttcacgtcacgtcaccgcgcgcgcgcgtccgcctccgaaccataagtccataattggtttctccatgattgggaaacggtccgcccgcgcgccacgccacgacacacatccacgcacgcaggcaggcaggcaggcaggcaggcgagaacccgaattcgaccgggcgggctcgatcggtcgcgttgagagagctgccaaccagacacctgcaacgttaatggtctgcgtgcgcgatgacgaggaaggcaatccacgcagatcgagctggctcgcaacgacgggcgcatgcagagagatggaggagttcagtttggaaaccgtccgcggaaacggggccggatgcagagattgctgctctgctttgcttgcttgctcgtcagtccgatcgatcgatcgacgtcgacgtggtctcatttgtggagccctctaccaatgatttggttgacttgcgccgcggttttacctcaaaagcgtcgaaccgtcgcgcgatgctagcctggctcgcaagatcgcagttcatttcgagaaaaaaaggccgaggcttttcctcgttaacgttcaatcttgccacttatgcacaacacgcaaaacgagttacgcaaagcaagccaagattgatccaccgatcgagattgatgagcatttgaagctaggtaggaaacctagagtcgagaagcttctgggatcagttggagaggtagccctagcgttgagttaaccatccgggcgcgggacggatctgtagcacagaaagagcgcctgggcctttttttcgctcggttcggcacgcccttggccgccgaactcccgaaagcctggctccgtccggccccgatcgaaccgacgtcgtacgcacacacacggtgcccgcgccgcgcaacgaaagcaatcaaccaagcaagccacaccgatctagtaagctatagtagctacgtacgcgtcacgtgaccgcgtcggccggccgggacgagccgcgcgcgcgagctggtggaaagatttttcggaaggacggacggtcgcggtgagtctcgaatgacagcgcgggcgcgctacgtacaaaaaatgttgggctgtcagctgtgtcaaccgtgacgagcacacaatgcaggttgcagcgcacgcgacgcgtccctctccgtgctgccgtatctttcgcagaaatctatcgtggtgcgagagcccggccgttgcagcaacaaaaaaaaggcaggacaagtaggcacccggtgacatcgggggagagctctgcatgtcaaacagctgggtgcatcacccaccgcgaatcgcactgcacacagagcctctcgaaagtagaggtggaaacggccagggatactgtggggggcttaacacggaagcctctccaggtttggtgtttgacatgtcacagggcgttgccgccattaaacacggcttactctcttcgggcatagtgtgtacgcacatacctgaaaaaaacctattgcccctcgatacattaggagtacgttactacatactgtacatgcacaacatattgccatggctggtgtctggtgaggttttcccgttccagcagggtacgtatgctacacgtacccgccacaagcgcatcgcgcgacaggtcaggtcagtgtgcaatgatcgacccgtggggggcccacatgcttctgctggctgttgccacacctcttcctttctccagcatctctcctcctcctctcacctctctctccctatatataggagcctgccttcaaggctctccatgaacccaagccacatcttagcttaattacatagctcctcctcctttctccactgactgctcagtgtgttttgcatctctccattgagcaagaggagaagggaggctcagctagctagctagctaccatctatactagtatcaagtttttttgttcagatttttttgttggaggaagagttctagggagatcgatatggccttcatgtccatggaacgcagcacttgggccttcacctttggcatcttaggtacatacaggcatcaacatgctcatgaatgctgcattcatctcatgcatacggtggtctttctagctgttatattagcttactctgttcctttgatttgattaatccgtgcatgcatgttctcccatattgttggagacacattatggcagcatgtatcgatcttaattcccacaaccgcacaagcaatgtccctgaaaaccgcagcaaaacacccattggaatcaagttttcttagttaactagatcaataatctcctttgttgcttctgtcaccttaattagtactccagtgtgtcttcctcaatatctttcaaagctagtgtttgaacaaaaaaaaaagaactagtgtttctgtcctgaataaatggaactgctaaacaaaacttttaggctctaatcaggtagttactctaaacagagaaagggagccatcacgcatgttagttagaaacgtacacaccttatttttttctctttttagtttttaccatgcaccatgcatttcttttctctgtttgcctctctctctctctctctctctctctcttttgtattggctgacatcactgataacccgtgtctgcctttgatcttttttgcaggtaacttaatctcactaatggtattcctttcgccactgtaagcacctcaacttgcttcaatttctatcaagcacatgcataacattgttttgttaggtttttaaaataataatactagttcagtatgtacaaaaaaaaaagcatcacacatgtcaatgatacacatgaagggtcaccatcatctataccattctagaattcagcatacacctgaaggcaacataactctgaagatttctactaatgaattctcacaatagtcagctgaaggtggaaagaaaaaaaaaatctctcagcacgtcacttttagcagagtaattgtgtgtgtccttgtaggcagttgtagttccattattgagacgacacagatcaagcatgagtttaacttccattaatcagacgaaagaaactgctgttagctagtttgttgataactaattattagcaggttgaacaataacttaaccgtgtgtgcatgcgtgcgtttggcgtgcaggccgacgttctaccgggtgtaccggaagaagtcgacggaggggttccagtcgacgccgtacgtggtgacgctcttcagctgcatgctgtggatgtactacgcgttcgtcaagtccggcgccgagctgctggtcaccatcaatggtgtggggtgcgtcatcgagaccgtctacctcgccatgtacctcgcctacgcccccaagagcgccaggatgctcacggcgaagatgctgctcggcctcaacatcggcctcttcggcgtcatcgcgctcgtcacgctgctgctctcccgcggcgagctccgcgtccacgtcctcggctggatctgcgtcgccgtctcgctcagcgtcttcgccgctcccttgagcatcatcgtaagctagcaaacgaatgcaatcttgatgtcttgctaactaatcgctcgatcgatcaaccagcagctgatgacaaggttctgatgattgttgtgttttgcagaggctggtgatccggaccaagagcgtggagttcatgccattctcgctatccttcttcctggtgcttagcgcggtgatctggttcttgtacgggctgctcaagaaggacgtgttcgtggcgctgcccaacgtgctgggcttcgtgttcggcgtggcgcagatggcgctgtacatggcgtaccggagcaagaagccactggtggcgtcgtcgtcgtccgccgtggtggcggccgggctggagatcaagctgccggagcatgtcaaggaggtgcaggccgtcgccaagggcgccgtcgcggcagcgccggagggcaggatcagctgcggcgcggaggtgcaccccatcgacgacgtgatgccctcggaggtggtggaggtgaaggtggatgacgaggagacgaaccgtacggacgagatggccggtgacggcgatcacgctatggtcagaacggagcagatcatcaagcctgacatggccattgttgtggaagtgtagtctgattaagcttagagaactagtagtaattctctcatgtgaggtatagccagctagctggtggtacacaaacataaacacgaacacatgttcatcgcgtacgtactagctactaggtgagacacctcttggcgtagtacgtacagtagtactccggccagatctagtagggactgtattggcgcgtgactcgcctggttcgtccagcttgcatgcagagaccgaccgagcaagcaagctaattaagctggcccgaccgaccgagtgcatgcgtgttttgtgaacctagctactgaggggggagtgaagggtgtgggtgtgcaatcgaccggcctgtcgcgtcgatgctcttgcttagcttcattcgattcatgcagttcaataataaaatttggattttactgcaacatgattttccagtctctcagcttaccgtgcgacaccgtttacattcacatcaacgagctgtatagcaaaatggcgagcgagagagagagagagagagagagagaggaatcgaaagcgttggcgcgaagcggggcggtgggtgcacgcacgcgaagggtagcgggacaagtgtgtggaggtcgatcaaataaggcggcagcggcatatgcaggcgtgcagaagcggacaagggtgtccccgcggaagcaggaggtagcgaccgcgatcccctcctcgcttttgggccttggctgcacgtacaacacgcgctctccgctcctcgtgggcgcgccttgcatgcacagacacattcacacacagagacggtgttgtcctctgcgggctattgaacgtgtctgagatcgaaaggaactgaaccggtgtctgtagctagctcagctaccgtgctcgatcgatcggtttcaaccgaaccgagcggcgcagcagacgagacgcgccaggtggtggtgtgcagctgcactgcatgcgtgcatagtatggtcgcatgtgaccggcgcgtccccagctattgcagaccgggatacgtacgaagggcgagacggggcgccacgtcgagcgccctcgcctgcaggccgcggtagacgacacgacgtgtgtgtgtgtgtgtgtgtgagactgtgacccgtgcaaagcgaaatctggcaaaaggctggcagctcccctttttaccggctcagctactccgtagacggcaatagcaagcagccctccgcgcgccgtgtgcagaagcggaggaagacacagcgtcgcgtcgtcgcagcgcgcgcggtgagtcggtgatgacacggactgatcatgcacgcgctccgcgagaatcaaccgcggcgcgtgcgccgcttgcatgtttatcctgcaacgcgggaggagggggaggactccgcaatattattatatcctgtcattctttccctgcagggaacgggagaggcgtctgaatgggtgctagagcgcgcggcaccccgcacacatggcgtgccaatgccggacgccgacgtacgaagccctttcctccgtttttctttttcttttgcagttcggaaaaatctcagcgcacgagatcgctaaattttacgtatgggactacctatacaaccctccggacgatgtctgccataccaaacgtgtcaaagcaagcctctcaacctcgatctttaatccgttcctgtatgtcgttaggggtgagatcacacaactagagtccctccaacacccgctgcatcatagactatggcatagttgttttcttcaactccaaacaatttactcgttttttttgttaacatattttcagaccatcaaatggtacgaattttttttaaaaaattcttatttatgtaaaagttttctttaaaaatcaaatgaaccaatttttaaagtttgtattaattaatacacaattattcatatgctaatggcttactcccacttcttcagcactatggggatgaagtccacaccacttgcttcgggttgttagagccccaatatttcattaggtgttgtgggatgaagaacgacctgcagaacaactccatcgacgaacatctcgcacacatgggcgaaaatggccaacactatcatgcgtgaagaactataagaagagagtactaacctgaccactgcgtagtcaatgcagtacactacctccgacgactcgttttccttgggcttcagcgacccccgtctcaccgtgatgtttggcctccaccaatgggaggctggtatcagaagttctcccttctctagctctggatcgtcgcgtaggcgcgagggtggaagagctcacctttcgagtggcaccacacgacagttggcctatggcatcacggacaagaatgaaagaagaatggcggcggcgattaattgaaggagaggagttgggcatcagcatttcaaatgagatggagtataggttgaagtttcacggggagaggttatgccttggaaaccctttggatgctttggcagcttcgccctctccaccacaacagcgcaattatcggagaccagataaacattagggtcgtgggcagttatgacccgaagccttcgaaaccgaagatggctaatgataggaaagtttaactagtggcccgtcacatcctcctacaatcgtgtggggcccacattatcctgtgtttcatccactgcgagtgctgttatcaagatggacttttcttcgaccccgaagatagcctagcgatgagcgagactacaagtctcttttggattggagccacgtgcttgtgtaattaacaatatatttcgaaatgacgtgcttgtgtaattaacatgtatatatgaccaacactttttactaatatgaccaacactttttactaatgaatgcaatatatgtgtattatatctgtattacatgtatatactagttgttagatatatttatgtattaattaattaatttcaaatatactacatattttctcaagcgggcgtaacacattttcccagatggcatattgtgctgcagcctgcttgggagatatatctttctaggcggattagttatgcggtctacctgcgaagatacagcttcccaggtggactggacgtccgtctgtgaaaatcaggtctttgcatactgatggacggagcgcccgcctactaaaatcttttttggcctcctaaaaattaattttctagtagtgtttggacccatagcgataagaggagagcggagaaggaggcgccgctgtctgtggagatgaagaggagggtgggactattttgcttccaatgccacctcatcgtcacataggatgagaactaagtcaaactagccacgtataagcaccatgtcaatcgaaattgtcgtccaaaccaacttggaccttatttgcactaattttgaaagttgagagacgcgtcatatccggtcttgtggtttagagatgattttcagactcgatgacaaattaaggtacctgaagtgaacttattccgtttatcattgggttgaaccgacactggagaattcggcctgaggtcagcaaagtagtaaggaaaatgtgctggtttgggcctactaatgagtctgaagtgcatgttggatggcggcccttcactgtgggcgtatgtctatttttgtgtatgcacccatacccttttggaccgtggtggttcatgcctacggtagcgtcgccttctcgtctaaagtctccgtccgtttaggctttgcgtgttgcgtcgtgatgatgtcctaagcagccgggtacaccagcacggctagggcaaaaacaagatcatcgagatcgatttgagccaaacacaaccgcaggaaaagccagccacacacgctttgctttctcctggtgagattcagggcgtacgcgtgtaactacagcttcctatctatgccttcctacatggcaagtgacagggagcgagttgagcctatatttggggtctccctggccggcaggggacacgggcgcggcgacggtggtgtaatgttctccgggagatgcatgcgtcgtgcgcgcaagcggttcccccgctccaccgatcggtcagtttccaggcacgcttgccgtgtgctcggtgcgtgacaccaaaacgtctgcttgatatttttttgacgtcttgcctcttctctcccgctgatggatcgaccaatagacagagttgctttcagagcatcttcagcatctcgatcgtgtaaccagtcggcacagcaccggcattaactgatcgctgacgaagaatgatcccatgtccatgaccaggatcaagtcaactaataggaacgagtccgatataaacattattaattgctacgagcgcataacatgataagaagatataacgaggatgattcaaagggaactcaaaagtgtcctttcattctcacaaaaatttctgagaatttacaagtacaacaacatgaattcactatccagttcaaagctcccgtttcttctctctttttctctagaaatgtacatctaacccaccgtccctccctcccctctccctgccacaggaaagcaaatagtgttggaaataaacagacatacatgggtggatggatcaacccctcgctgccctgctcctagccattttcagttggggaatccagactcccctgcccgttctcgatcgcacgtctcttatcccgccaattctcgccccacatctttgcctcggctaccatccgctccctatcaccccacatctttgcctcagccaccatccgttccctgtcgccccacatctttgcctccgccaccatccgctccctgtcgaaatccttgttcaggatacctgggggctctttcggggaatcctccctgtccttgtttggtgacttgtggccagagctgctggcttcgtcgttcctggagactaccctgccgttctcgccaaccttgcttcgctgatcgccacctggctttcttgaagcatgagccgcattagggtcatatgattgagatgccaggtaggaaagagcagtcacaacatctgcaataagtggacgcgacgcagcctccgactgaatgcacatagatgccactgcaagtgcttggtaaagtccacgcatggggtatcgtccctccagtcttgggtcagccatttttgggagctttcttctgtcgttgaaaagaggtcgtgcctggcagttaatatgaaatattgtgagtacatgggtcaagtcattagcctcttctcacccccccaaaaaaaaaaaaacatttagcctcacaatacatgatctgctctagcccatcaaagtatgttgaccagtataagcatggaggacaggaaatcatagatgtagcttacaacatctaatatgtcatccgttccttggaaggtggacatcaagacataataatttactctatttgcttttgtattttcagttccagaaagtaaccaggaaatatcttatctttatgagctatttttcaagatgttttaattctgataaaatgcagcagatattagttagatctactaccaaacatattgatggtatgcgacatgtcaggatccaaacaattacttaggagatactagacagataaatcatttcaggttattagcatatatagatagcatgtgctcctaaataatcagaacatagcttacccatgagacaagattttgctccccatgtggcctagtgctgtcgatcgcccgacgaccagtaatcaactcaagcaacacaactccaaagctatatacatcagacttaactgtcaactgtcctgtcatagcatactcaggagcacaatatccatatgttcccatcacacgagtagagacatgagatttgtcaccaacaggacccaactttgcaagaccaaagtcagacagctttggatggaaactctcatctaagagaatgtttgatgacttgaagtctctataaataactggtggatttgctttgtcatgaaggtactctagtcccttagcagcaccagccgcaattttcatccttgtgttccaatccaatgcttccttatcaggaggtagatctataccacataaacaatttattgaagtttagtacggtcattattcatacatatttatatcgacacttaattcaaaatcacatattagactcacacaatacagttaaagggtacaatttctgaacataagagaaccttgagaagtaacaagacataaaaaatatatttacaccttccatagatcattgactaaaaatatttcattggtttttacatcacgaaccattttcagtagaccacataactttataagtaattttttggtatatgcagaccaacaactccacataactttataagtaactccataggttttatgacttttatttaacttacaacaaatagccaaacacatctaaaaattgcagctgaaaattacagtacacacagatgagaaatgcgagcgaactgtaaaacatgacaaacatagtactcacattatgctgtcatgcaccattttagggaaaaattaactatttgccactcttacaagcctattttagacccttggaagagacaaaatgtcaacacttcaacagggagcaggttaatgcaaatggtgacatttttagggctaagtaatgaaatactagtctaccaccacataaacatttgccgatattgaaaaacaataatcatggacactaattctgccacataaagagcacagatagaaaagcatggatagaatcgctgatggacaatctgtacctaaggaaacatgtgacagaggacagtattgcaggtacagacatagaaaccattaacagaaaatttacaggttgtggtcatatgcaaaacagtatctctacagggaataaacatagaattcgtaccatgcaaatgatcttccaatgatccaaagtgcatgtattcataaacaagaagacgttgatctccgtcagcacaatagccaatcagattaacaagattttgatgatgtaacaaactgagcattagaacttccactagaaattctctgtttccttgaagcccatctctattaagctgctttatagccacaacctgcaatgacgaaaaagggacttcaatcatcatacttcttttaaactaattttaatttagaagaagttttggtgcttcaatcatattgctcttaatttttcaatacaacacactgaacatacaacactagatccttgttgcctaaaattgcacttactagttattactacttcctccggtcagaaatacttgtattttggacaagcatcatgtcaaagtttcaaaacttctgggtatagtaatatttctgaataattaaactggataaagaaaatcatatgagaagatttgcatttcaacgtacttgcatagtcctataatttaatgggtttgacaaatatatttaaaaagaaaaaaggcggcccaggccaaaatgacatgtattacgaccagagggagcagcatagtattataatgcataaacaaacaagatgaaataaacagttgctcaacatggtcatttctcattcctgtaaacagttcagaacgtagatcttagacaaacaaaagtgaacagtaaagattttacaacagtgcaattttccggttgttcagctctccacaggcgaatgcaagaatgaagcatatacccatttgccaaaataagttacctggccagtgctctcgaggcggcccttataaacgcgcccaaagcctccttcgcccaggaagcactctggcctgaaattcctggtggcggtcgcgagttctcggaaggtgaaagtctgtgctgatattacattcccattggcatccttgggcgcagaaggttcccttagtattgcattgctcttcaccctcgtcttctcagcccctgcccatgttgaccaaaacatgagaaaaaaaaactaagctaaccagtatgttcacgcgacagcgagaatttacaactacagagtccaaataaacagtctgaatgtagcataggccttgtcctatcggtctatcaattcatctcccatataataccatatttttttttcatttcagaatgatctgaagtagatgaactaaccccaacagcatctacatatcaaacagcgcaagatagttatgctttctggacaaattttgcaggacaaattgcggtaattcggtaggcagagatcacgaaacacgagaaggaatactaaaatcagatcaaaggaggcgtggaaaaggaaggaccgaatccgtgtccccccgacgcggatccgatccccaccaaccgccgccgccgcccggagatccaccccaactcaacccaacgcgaacggagggagtaacggacgcacctgcggagagcttctcgacgcgcggcgctgccatgggcagctgctgctgctggtggtggtggtgcaggtccgggtaaccaccgcccctctccccatgccgaccagcgctggaaccgccgccgccgccgtacgcggccgcggcggcggaggaggaggagccgccgccgtacggccctcccaccttggggttcagctgctcctccgcgggcgagtcgaagcacgagaagcagcccatctctctctccctctccctctctctctccacccacaagcacccaccacagccaaaagccagagaaaggcgcgcgtcgcgtcagagggccatcgccgccgccgccgccattcccgccacccctcaggctgccggaggaggccacccaccgatcggtgtgctgctcgtgctcgggatcggatcttcgcggcgaggggatcgaggaggaggaggtggggggggggggaggaaaggcgttttttattgggtttttggaggggaaggaagcgaagagagggagggagagcgaggaggaagcaagcaagcaaagcgaggagaggtggtggagtcgcggcagccgcccaactaatacgcgtctttgcgggttccgtctcccgtcttcgccccgtctttgggtttcatccccctcgctcgttgctgcggcggctttcacacgatgtggtggtggtatttgctggcttggccgtccgtcctggtctttccttacctacgcctgcgtgggggtttcgttgtaatcaatgggttgttatctccttgaacaccttttatggtagttaatgactgcatgtttatctcattttgtacatttgtatggtaatttgagatccgattgtttttttttacgtgttcgggggtggaagatcttcggaaaaagatgttccttattggttggttgagataaggcttatatggaaggaaaataaataaaataatcggaaatgatccaacaaattaaggctagaaaatatacagagggatgaaaaaaaaagttctaaatcaattctaaaatttattatcgaattatggtcggaaatggtcagaatcggtattatttttctattatttgtacggaaatggtcgggaaattttatatttatgaatttaactattgaatgccaatttcaatatcacacttatataaattagaaaaagtaaatttcagaaatgaaaaaagaacacgaataatagggaatgatataatatcaaataattagtaacgacaaggtttcgaaaccagatcgtttaatccaccaccttgtggagttagctggaatatccttatgcatttttcttcaaaaatggcatcagttataaagatattattattattatatttgttctggagaaagaaaataatccatctctttatgctgctgtagagctactacggcaagtctatagcggctggtgaccaatgaggacgggtgcacatcgtctgccgttagctgtttcaacggcagcgtgccgttggccaatcccaaccgttggtttgaaatggacggataagatcaaaataacccacgagaagtgaagaacactcctattttacattgaatttattgttctgtaacttccaccttggcatcgattgatgacaaatttacctatcaaaattttagctttgtggcatgaggcgacaagctaacagaaaaatctttttttttcatttttttgaaaccaatattttttcacttttacgtgtgtcacctgaccattttgtttctgtttactcaatgatggaaacatttaacggtgatgtcgctctttccttttattcaatcgggacaggtcagaagaactaaagaagaaaagaggaaattaagcatcgatccttcagccagtgggttcgcacatcctgatcatccattcaaagtaacggttgggattgatcaacggcacggtgccgtagaaatagagaacggcagatgatgcgcacccagtgaggacgtctgccaacaacagtgggctgcacacgggctggcgcgcgattaattagcacggagacgaggccacaaatcaagccttaattgcatccgtgtttagtagtagcagctgcgtacgcactgtctcgcctgctcttctcgtacgcgagcgacggctggtccactactttgtgcgaggctgactagctaccaccaaataaacccattaattcaacgcaacatgttccatggctggtattagcaatattagcatgtacgtacacgcattagccagccaattagctagtagctaggtcaggtgagcaacttgcacgtagtggagtattttgctagccattaatcatacacatacatacatatatacataatgtactcctgcttcaagagtgttcgagctagagaggctcattatagctaagctatccagactaattaatcactcagagttgtattagcgtgtagccatcagtatcctcccgtcgacaacatgtgcacactctgtgcgcgctgtacattcagtatctccagcctgtacacacgtatgtacgtaggtgcagatacgcttattggttattgcctttgatattaatgggtttttttttcaacatctatcctgcagtgattttaaaaatcttactccatatatacctgccgaaatatcatagaagtatgagacacgcttatccataccggccgactctctgtgacagggaatataatccttcatttttaaccactgaattaaatatatttagctatttgaccgtacaagtgagaacacatggctcagggatatagcactgttgggatctggaaaatatattgagggattacaagacaaactactactagcgcaaatatgccctctatcccaaaatataaagtataactattttttccaatatttcataatacaaaggcatccatgcattatatatataaagttaaataacacccttgtcctcttttatttatttatttttaaatactacactctcaatatctttaattttattgggtgcaagtattgtatttattcgagtggtttaaatgaggtgataataattctttcttgatcttcatgttaatgatagttacacattatattttgtgatggagggagtagttcttaaagcaggaagatatatataagttaatcaatccacaccaaacattaagaccttgttttggttaattccacccacaaagaaatagagggggttttggcgggaatagttccacatctattaaggtgtagaattaaccctcctcgatcccctccaatcccgccctcaaatggaataactaacacaaggcttaaagacaattatgcttacatacccctgcatttaagcattttggagcaggttttatgctatctttacgaggcgtccactatatattaaccgcaccacagctaggtttaaccttatagatcagagagaggtttcccctctctgcaataagcctagttacaagcgaaaataagaaaaatggataaattctacaaaaaaattattttttatttaaattcttttgaacttggtcattatagcagtctgttacctttaccacacctcaacgataaaacccacccagatatcgtgataatcatagatgttgtaaaccttgttcatatcgccttggtgttgctattgtatccttcgttatccatatttcttaataatttgggcgaacgtccgttgttctccggtggtttggtaattccacaaataacttttgtgtttaaatcaaccaaacaataacttttgtgtttaactctatttatggcaccatatcttctgtaaagaaagagtagaaaaacacactataaattactacagttatattataaggttttgaactggataagagggctgtaacatgaatttgctctaaggggacaaagtgagccggatagagagtttagggttgtaaatgtttggttttgtaattctagattgatgctgagtttctttctgcaagaatttaggattataaataggacttctcccctatctagcctctcatgtataccttttctacttgcaactaaatgttctacaatgtaacatgaactgttgcaagtgatgtgcacagttttttttatcatgccattttctctaacgccgtctaatgtttttgttacaatatgagatttggttggcctatttgttacccctggtatggaggggatcagtggtgccaaatatctggtgttctgtaaatatttgactacaatacaacaccagtctcctccaaaacaaatcatagtcgtcgccagccatttttattcttccaggacaaagtaataaaacttcacataggatacaacaaagaggccaagatgttattatgcccatggatttaaatctccggctattagctgctaggagaagcaaccgctaagatatgtccaatttgccgctacacattctatggcgctattagctgctcttaactggctatagccgctaaatgggcccttagatagcggcaactaacttggtgggctgaaggcctaaagctaaacaacagcccatataggtccatatagcagcagttcaaccctaactctatctctctctctctcaatcactctgtctctcaccctcccccctcgaaaaaaaggcacggcagctttgtggcggctgcgcccggaggcaacggtggcggctgcaagcctgcaacctgcagcggcgacggcgactctgacctgcagcaacaacgactgcagctccacgtggaggccgcagcggcgacgcccggaggcggggctgtgcaatcccggcaccaagcggcgactgtgttgggcggcagctgcaccaatccctccctccccatacttctccattcttccccaagctgcgaacgtgacggttgtgctgaagacggcggggactgctgggctgcacaaatctctccccattcttctctagttttcctaacaagagatgtgcaagatttttatatgattctcggatattgaatgtggtatggaactattgaatataatatcaagtgtctttgactctttgaactgtatgagaattgcaaaatttatgttagtttttgcaaaacagctaatgggcttagctgccgctatagccagctatagctggtcgtagctgatggaaagcctagcagctaaagggcatatccggagattttaatccttggttatgccacaagagaaggaatggctttttcttatggagagaaacatgagaaaagaggatgttttagaaagagagaagacgacgaccaggaacaactaaaaaggtcagaaaaaggaggtgaataagaaagccacactctccctctttgttgcatgtgtttggctccttcatacaggggcaacatgattgggaaaggaaattatctagcaaaagagagaggaatattctcagcaattacttgactcatgtggcctgttcggagtttatgaattgattatcaccgcagttgattaattatactaaacgtaaacatcgaggtaataaccgggtggtgatcggtgaaattgcttctaattcatgtcacttgcgtttattttacctagttttcttttaagaattcaactcccaagtaggagtaactaatattaccagattagcatgcgcattttcttaaaagagtactatgccccttatccattaaggactttgtatatatgctgaatatttttatggtcttaggagatattgaaaagacatagttatttttcagagttattttttaacatatatccatacttattatacagatatcttacattaatagaaacttatataactacttatttccttaggacaaaaaaaagaactctcatatcttcaatttaatcaagaagtgatagatggatgtatcaagaattatgtgttacttagatgatgtaaaatctaactagtcaaaccagacaaggccttaattaatcttaggataaattaaactcaacaaggttatggattgcccatgttgtaaaaaagaaagttctccagagacaatttgtccatgttgatgcacaggagtactactaagtactcctaacagtaaaaggttgttcatatggcattgaatactatcaagtcaacacacacttaattaacagtcaaataatgtctcatagagatcacgttgttgttgcacagttcacttgctatagttaacactaggataatgctcttttgttccaacgaaaatgtttggttaaaaccatggacaaatgacaaatcgctggatcgatgcccctcggaacaagggaaattaagcaaattgctccaaatctacgaatccatttggattctgcagtcatttctttctagcgaaaatactgcaaaggtcaaaagttgtgggcatcagttcctcagggaggcgtaattttgacccatccatctgatccgggatgcctgacaaacacatgttaccatgtagacctaaaggtaaggaaaaaagggttaagagtctttcgcaaaagtggacgattagatccctcgctttgcacatttgttgatctaccaaccgtgagcattgcaagggtgaaagaaaagttgcaaaggagcacctctagactccagttcccctattttatactatttatataagaaatcaagggtatgaattgatgtctagatggaacccacttaatttagttatcgctacaaaagaggcacctcttttaacattcacaccattctttatggtagattaaatcaattaatgtatatatgatcttgatgatataatacttgattggcggtcagatctttctacttaacgtagaatctcctaagacattaacttccatgaaatataattttgcatgctttagttaacgtcggatctcttgaaaagtgttctattaatataggtactgatagattttaatgagggattaactaccatgagttacaatttcatatgctctactggtcatatccctttgaaaaatacagtacgctactactttccactaataattgtgtggcaaaatttgctatagaactcttaaaaaaagtgtaatttgctggtagatattgtaaaaacgtgttacagctaaaagacactgtaaaaacatgtcacggctaaaagacactctaaaaactggtaatttgctgaatgagagaaattcttaaaaaaaagacaagaatgcccctaggatcaaaagcttttgagctgaggctggagtgaagatgaaatatgatgtatgctagtgatatacttagggtgatggaaaacttagagttgcataatttataaacttttactctaatgccatgtttgaaacatgtgtttctatgcgcattcttgtcattctgttggtttgttagtgatgacgatctgcttaagagttacaactgtatactccatccgtcctaaattataaggcctatatttttttttacacggtcttcaatgacatactttaagcattaatatatttcatgttatattcctaacaaatatgaaattaatattacatgaaagtactttaaaatatgaatataagtgaaataacatgtataatacttagcatatatatggttagtgtgcttattagttaaaagttaccgagcttaatttttcttaaaaagaggtgccctataatttaggacaaagggagtagtatgcaactatgtacatcatttgctgattagccagttgctagctgcaagcctgaaacgactatgcttgcatcatcaaagtctatttacttgatcattgtagccacaccaaacaaccaagcgacagggcaacagatatgtagataagatgcattcgtcttgatagaacaagtgccaaacaaaatataattaattgcatatatatggtcaaaagcatgcatgctcaagtgatagggaaaaatatattatgaaagtcaaataggtatcttgattgattaggtcacatgctatagcttgatcaaggtcaaagagttgcttatgttcatacaagaatctaaaaccatgttctaacccaggatcagaattggttccttggagagaacaaaaccaggattatacatttgttatgtaattaacaaaatctgcagtgtatttccgttaatcggtcttccttcttattggatgtcgagtgtcgacacacacggtttgactgtcgacctcgattctgaatctgatttttgtgtttctgtaatgaaaccttgatccatctgattttgtcaagttccaccattcaatccttccatttcttacatgataaatgaaacatatccatccggagaattatttatctaggtaaatttggcagatttgatacccttctaaacctcaatccataccctgtcccgcccaacatgactaatgctgacgcctggaaattgaagggcccctgcatctttctaaaattatttacctaataaaaaatactttaaaagaatcaatcagaaatatatgcttttaaagaaatcaggaaaaattactgtgttgtttttcatgtgtttttggggactgccgactatagtaatgtctcgaggctaaagtactggaagaaccaagccaagccggatttggcccacgaacaggccacactatgagcgagcctacatctcgacggatgcttccaaataatcatgccatttgccacatgcagccaccatctacacggtgtacttgagctggaacggaacaggtgaaacgcacaacttggtctttcaaaaaggaaaacgcacaaccagctcgcagcaaaagtgggaagagaaggagacaaaaacagttgagataaaggctggttttggtttaggttagctagcagctctagcaaccggccatttttctgatttttctaccaagtgcaggtgcaggggaggttagttggagacttggggtagagggaccatgcttttgagttttgaccaacagtagtcgaattgcaaatgtatagcatattaaaaaaaatgtgtcaggatttcaaatttcataattgattttttttattttaaaaaaggatagaaatgctacttttatagctgttaagaacatattgattgtactcaaactttagtttcaaaacatattacgccctaaaatgagagttagtaattgaccaatataactagcctctgtggtcaagcttgtggtggaaatttctatttgtgaggacgacttggaaacaacgaattgacaccatatctctccatctatctctgtctctgtctcggaagaaataaaaacaaattgactccatcaatcatccatgcatacaacgtaggtagtccgctcgtttgatttggcccgttcgtcatgacgtacgtgtacccctgatctccacatcgacaatgacctctcgctaaccaaatgtccttttttttttcgttttctatttcttcagtacggttcataaattagtggcatttgagattgttagatacttcaggtctgacagaacttctttcaaacattcagtatctgcagtcgtaagatacttaagactatgcatgcatgtgaaaaactgcaaaaactccaatcaatccagctcagtattagacgacctgtttagatgggactaaaacttttaaatccttatcacatcggatgtttagacactaattataaatattaaacgtagactattaataaaacccatccataatcttggactaattcgtgagacgaatctattgagcctaattaatctatgattagcctatgtgatgctacagtaaatattctctaattatggattaattaggcttaaaaattttgtctcgcgaattagctctcatttatataattagttttataagtagtctatgtttaatactctaaattagtgtctaaatatagggactaaagttaagtccctgaatccaaacaccactaggctgtgtttgtaacttgggttgggaaccatctcctccgcacagaaaaccgagcagttcattagcgcatgattaattaagtattactccttttatccctaaatataagggattttggttcgatatgacgtattctagtactatgaatctggatagggagtatagtactagaatacatcccattcacccgaaatctcttctatgttgggacggagggagtagctattttttttcaaaaataaattaatttaagttttttaagcaactttcgtgtagaatttttttacaaagaaagcaccgtttagtagtttaaaaagcatgcgcacggaaaaacgagggagagggatgggaaagcaccgaacacagccttaccggactcaagaagaaacaaatgtttggatatacagtgctttgcttaagctgccaatgggcttcggcgaatgggcctaatactctttctatgaggcacaatggatattgtttgggcccatgtggatcatgcatagaacgaataagtctattttacctcactcgtctcttgccctcaatcgaatggtatccctccctcaaccacaaaaccgggtataacgtctccctcaacttcaaaaaccggtgcaaattagctcctaaagtgatttagaaagcgatttctataggtgaggcccatatgtcagtgagacatcaaaacatatgtggtgggcctcacatgttagtgacggcatcggaggccatgtcttccccgcgtgtatgtgagagtgtaggcaaggatatgctcagtggcactactccaatgcactatatgccctctgccgcctcatcctcctcctttgcggacaacgcgtggtggccgtagatccgagccacgagctcttcccgctggctaccgaaggtgcgaccaggagatccgcgctacgagctcctccgtacggatggaaggtggcagacgtgtattggagggcactgggcacaacagcctacaccgtgcgagtactctgcttccgccggcaatggagtcaccgactgagggagtcaccggtggcatggggggaggaggagaaggatgcaccgagacatcgggttttagtcactaaagttgtccatggatgagccgctcctcacgtagcccgttggcatcacgtactagggctctggtcaaccttttccatctcagatgccactcagcttctcctccgctccctacacgcgtggcacaagagagcccgcctcctcccccatgcacggcgcagcctccccagagggctgacgtgatgtgcatcgaagtggcggacaatgacggcacatcgggggaggaagacgagggatggatggcacattatattgtcagctctctcgcatccctcctgtcttcctctattgctacagaccgccttcctcaccggccaccacagccataaccttgaggttgacggctgggaacgaggatggatggacatggaagcatcaccttcctccgtcgcaacctcgaggtcgataactgggaacgaggaaaggttgacgtggaagaggtcggggtgaagctcggccatgcacgcgacaggcgcggaggggtaaaggaggaagacgaggccaataaggagtgcgaggaagaggagaagcaggagcgacggggcggagacagatgaggatggggatgaagaagaacatcggaggagacagaagtggagagagagaggaaggacataaaagaggatggagagagttcgaggaagggggggatatggatcccactaatattttttaaagttttttttgctgacccagcataaaccttttcctaaaccaccgaagaaaatgatttgcaccttttttgaagttgagggaggcgttatacccgttttataattgaggatatgatttgatcaagggcaagatatgagggaggttaaatagacttattcctgcatagagctagcatgggctgaacttgacataaataatttaaattatagtagaaatcaggaaaaaggaaacaatactttaaatgggcctaaattaaatacacccttgtacacactaccttcccaacaggctaggacaagaacacggaaaaggccaacagatagcagtagaaaggtgattcaggcatctatgccactggctgataacggttcaatctatctgcacagagaattgtttgcaaatcgaaaccagtagtactgtatgagcatcttaataaaaagaaattatcatgcacgctggatgtaggtgacagccgcatctgaaccagcggtttctccttttcgttattttattatctatctattatattttattatatactaaaagtacattaaacttcgtataaacgctcttataccgtcatgtggtacttttataaacactcctagacagtcacatgacactatcaaatctcaccattgattttcatttaaattggtggacccattattttacaccactaaattagatctatcattaaaaataataacttcggcctggtttagtttccaactttttcttcaaactttcaacttttccatcgcatcaaaactttcctacacacaaacttccaacttttccgtcaaatcgttctaatttcaataaaacttccaatttagcgaaaactaaacacaccattccacctgtttagatacaagcgctactaccattctcccgtatgtacgacgtacgattagcacgtccatttaaacttctactgttcacggaatggaaaaacaataagaacgtagatagaaaagacagccaaaaaatatagatctataaaaatggacggttattttctacaatataaatatgaaatatattagttcatatatatatatatatgtatatatatgtatgtatgtatatatgcatatatacatatatgtatatgtatatatgtatatatacatatatatatacatatatgtatatatacatatatatatacatatatgtatatatacatatatatatatatacatatacatacatacatacatacatacatacatacatacatacatacatacatacatacatacatacatacatacatacatacatacatacatacatacatacatacatacatacatacatacatacatacatacatatacatatacatacatacatatatatatatatatatacatatatataataaatatagttaaactatgatctataattaaaaatataaaatacccaataaatgttctttaaaccaccttctaaaatattttttaacttatatatccaattggtgatcatgttgtatttctttaattaaattataaaagttatattatggtcctcaatacaccacaacaccaacacatgaggccgacctatgtatgatagttttttttaaaaaaatcacatcacattttaggaagtgaaatatcacttcacaaatatacaacactactttagatctacatacttaaaaaataaaaacaacacaatttagttgtgtttttcaagttgatctaattaaattataatttgtttgtgattaagattctcaaagtatttttgtatttttagaactatttgactatacatatttgtcaaaatataaacaataacatgatgctctaggtattatcgtggtggtatatctcacatccatactaaacaaatcctaaaaatcaaacattctcatgccgccacgtggcactctacaaatactcctataccgccacgtggcactctaataaatttagagaaattaaagaaaatctaactgtcggttttcatttaatctggtgaacccattatttttaaccactagattataaaaaaaacaaccaatttaatctatccttaaaaggcccacatacgtgcatgaacgtacgtacttcatgcactgggcccacgttcctcttttcttttttctctttttcgtgcacacaagataaaaaccgaattaattattattgttagtgtgaacacaaaatatgatcttgcggctaaacctaaagtcggcaaagagatattttgtttagggcgatcgctacagtgatcgatctctcatgaacatccctgatcgggggataaccgccataccctagtgtcggtttcccctgcagtggctataaatagagatcaatacctaagtgttaaaccttaagagatttctctcgctacccgatcaagcaacccactgaaacacagggaaaaaccaagacatgattctctctgtgcttccaaactagaagagaagaaagaagaacaaaggcagagagatgggaactccaggagataaaggtatgatctaatcccatttcaatttgtagttccactttgtgccaaaccgatccaaagcaatccaacaatggtatcagagcaccgggttggcctcaaattggaactcaataagtgtttatgttcaaattgttcttcgtgttcatgcccaaatccctctgttaatgttgaattgagcccaaatcatgcaatcccgaagtataagaaatggaattaggccttctagggtttcgggttgaagaaattagaagaaggggaaagcaaaaattcatgcaaatctcaaacaaatccctaagaaccgaaaccctagctgcagtaagaccccaaaaattccccaaatcatggaaccctaaccctaaaatcatggggaaaaggagagcggcgggcttacctaagggcatgatggccggcggcgaccttcgtgtcgccccgacgcaataagaggcgagcacgcacccgaggacttggtccccgagcggcctcgcgacccgccgtgccggcccggctcctcctcctcgcgtgctccttgctgaggtcaccgtcgccgcctcgctgaggtagccgtcgccgctcgtctcgccgtcgccgccgtgggtcttccttgcgcgagcgaccggctacttagggcaccgtcgagcaacgctcgacggggatgcgcgccggatatggcggcacgcagccccggcgagcaaggctcggcggcgccatctccaccccgtcgtgcgccgcttcgccgtcgtcgtcgtctcgctcaccgtcgccgcgggcgtgagagaaagaggggaggagagaatgggggctagggttttcgcgggggcggccgccgcgccggttttgttccgcatgggagcgatcccggccgtccgatgaagatggacggctcggatcgggtcgctcccgacgcgggctgatgaggccgcacagagaggcagcaaacgccggcccaggcccaggttgatgggcctggagcccaggcgggaggcggcgcggctgtgatgggccaggccgaatgcggcctggctcggggagaaaggcccagctcaagatttccattaaaaaaatgtgtggctgcatagtaacgggctgtatagtaatgggcctaattaaagattgggctaagataatattacaattaacttttttccttttaaagaattatgattatgatcattgtgttcaaacattaaagatattttattatgttttaattaatgataataagaataataagtgactttgttatgtgataaaattcactttcatttatttatttgttttatgatcattatattatatttattacttaaagttattattgttttatgcattatgagtttatttccgctacaaataaatattacaattaagtgtgacaaataattgtcattctggccaaagctgattgacttttatttgattacaaaaattttattaattcaattcaaatctggccaaagctgttttgattgaattaataaaaggagttttaaacaaactgataaagtgtggtttgtatttattattctggccaaagctgattaataaatacttattcacaaaattttattgttcatttccttctctggccaaagccgttttggatttaatcaataaaagaaggtatttatttagctgctgattctctcttatgcagcatcttatgcctcacaaattgccggaataataggcaatattgaacaacttaatggaagtaattatgcttcatggaaggagaagctggaaattactctagctcagttggatattgattatgccctccataatgatcctccggttgagcctataccggaaaatgaaaattatgagaccctaaaaaggagatatgatgaagtaaaggcaaaatgggatatttcaaaccgtaaatgccttatgattattaagagctccattattgacgcaataagaggagcagttccagatactcagacagccagagaatatcttgctaaagttgaggagcagtttaaaggctcttctaaggtttatgccaccactcttattaaaagattggtcaatgaaagatatgattttactggaaatctgagggaacatattatgaagaaatatcacatggcttctaagcttaaatcaatggaaatggaaatctctaaaggttttcttgtccatttcattatgtcatctctgcctcaggagttttctccatttacgatcaattataatgcaatgaagatcaagtggggcattgatgaattaatagccatgtgtgtacaagaagaggaaaggcttaaggcagaaagagttgaccatgcaaatttatttaaacactccgagaagaaaaggtataagaaatttaagaaggagtatttgaagcctaagcctattcaatttaaagaaaaagggcaatcttcgaatcaatcccagcaaaataaatctggaggaaatccctatacagaagaaaagggaaaagaaaaggatgggtgctacttttgtggaaagagtggacaccgccaaaaggactgtattggatttatgagatggctcagtaagaaaggtactgatgttatttcttttgttgatgaatccctgaatattgattatgccaccaattcttggtggattgactcaggagcgacaattcatgttgcaaattccttgcagggattcgctatgaggaggaccctaagaagaggggaaagaagaattagagttgctaatggagttgaaactgaagttgaggccattggagacttcactctcacacttcatactggcttcaaacttcagctgcatgatgttctttatgtaccctctatgaaaaggaacttagtttcagtttcacgtttagataatggtggttactattgtacttttggaaacaatagatgtataattatgcatgataataaagaggttggtctcgccgttggatgggaacaactttatcaaatctctgtgtgcgatgccacctataatgttgattcctcctcaaatgcaaatgtcagtaccaaacgaaaacataacgataa

SEQ ID NO: 60440 - DNA, 1076 bp, Oryza sativa
ctacacacattcttaacagggttcccagtaaatcagtccctaagacaccttttgaattatggactgggaagaaaccaaccctaaattattttcatgtgtggggttgtcctgctgaagcacaagttttcaatccaaatatgggaaaattagacctcaaaacaatcagttgtcattttatcggttatcctgataagtcaaaggcatatagattctactgcccaaatcagtttacaaagttcattgagacaagacacgctgtgttcttggaaaatgacataatcaaggggagtatgacacccagagaagttgttctggaagagaaacggaattatgttccaatgcctataattgaagaacccgttttctcaacacatactcatgttgcaccttcaatagaaagaaataatgatgcaacacctgctgaagctcctgcaactacttctagtagtgtatcaaatgatgagaataatgaggatgctcagcagccccagattatgatagatgagcaaaataacgaacccgtcagaagatcacaacgagttagaaagtcagcgattccaagtgactatgtcacttacatgaatgaagaggtgaatgaacctatgagtgaagaggtgaatgagcctatacttgataatgatcccatctcatttaaagaagcaatgaagagtgaacattcatctgaatggctaaaagctatgaaagatgaaatgaaatccatgagtacaaataaggtctgggacttagtagaaattcccgaaggagccaaaacagttggctgcaaatgggtctataagactaaacgtgaccccaagggaaatatcgaaaggttcaaatcaaggcttgtagcaaaaggatttacgcaaagagaagggattgattataatgaaacattttctccagtgtctactaaggattcattcagaattattatggcactagttgctcattatgatttggaattacaccaaatggatgttaagacggcattcctaaacggtgatctgtatgaagatgtatacatggcacaaccataaggttttgttatgaaaggaaaagaacatatgggatgtcat

SEQ ID NO: 60441 - DNA, 1053 bp, Oryza sativa
atccgacgtgacacccaaaaatttccttttcgcgaagtaaacaggccgtaaattccatgatgtttgactcagaagccaagtaggagtagctcgaataactggagaaggaaacgcgattatttatatttggaaaaagtacgaaatctatcgcggtcgaccgaattaccccctgaaccacaaaaccggacattcttcacccccaactttgcaaaccagacaaataacccccctggctcaatccgcggtggttttaatcctatatggcagtccagtcaacaattcatttataaaaaataggtggcccccacctgtcagtttctctctcttctatctctttcccaatatctcactctctctctctctctctcttcatcagtgttccatgagaggccgcacctgttagggccgtcgccgccgccgacgtccagaccggccgccgcgccatgctcaacctcatcgccaccgggatcaccggcggcgccctcgcataggcggcgctcgccaaggccgccaagcccatcaagctcggccccccaccaccgccctccggtgaaggagaggttctacatgcagccactgccaccagcggaggcggcggcgagggtgaaggaggcgaggcggcagcgggcgcgggctattggcggggcgtgatgagctaaggtcggcgctgggggtgggtgcggaggcgggcgcgggcggcgggcgggcgcggaggcagctgcaggtggcggggcggaggtgggtgaggaaccgatgacgacaactgggcggggcagaggcgggtgcgggcggcgggcgaggagctgaggacggcagcggggatggttgcgagcggcgggcgggcgacgaggcatcttctggcggcgggcgggcgaggagcggacgccgatgggtggccggcggcgggtgatgcaagcggctcttccgcaatcgcgcctccgtgaggcgcctgccgatcccgggcgccgatgacgagcacgtcggactccatcgacgacgacgatgagaagctctgcccgcggttgtacctcttcttgacactggcggcggtgc

SEQ ID NO: 60442 - DNA, 7997 bp, Oryza sativa
aagattttcccaaattgaggatatataaacatagcaaccgctcctagcgaggtggtaaaacaagccatgccgcggcgctgcctcacgccacccattgcttcactcccatctcgtcatttttctttaaagtatttttttactaataatgtaaaagtcaatcatatgagctcatataaatatgtgcagatgcacactatgaatacatatacatgcaccatatccctatattagaaaaatattcattcagaaaaaggaaaaacaaacgtatgtacaagagactaatattcgctagaaaaaaaaacaacatataactacattatatctatttttatgtcatcctcatccaaataattttaacaaattagctcaaattccaacgcatattaacccccgtgtacatgcataggtgaattagatgtataatataagaaaaaaaatcaaaacttatattaacttgtaagttagcataggataactgcgtgagcaaatattttttacgtggtcctcatcactggagctattagatagtcgaatgatcaaccctgcttttttaaaaaaaatatctatactactgaaatttagtactattgattaaatgcttaaacaaattatgtctaccctatacaataaatcaactctaagacacataaagactttcttatcacctccatcttgtttcacttcttccataaaagatgccaagtatgaatctcaactggctacattatagtaattatataggagtatacattattcggttaaggtgatccgagtaagatgctaccgttgataataatgcttaactggcctgctacttaccgataaaattatgttaccattgagaagcacgattatatcaatgcgggacccatgaatcaaggcattagagctaaatccttagcggctatagtcggattcatccgatcgtcagaggagcattcatattcatatataagtttaattgttttatcctattaattggtagaagcggtatttttaaatatttatatatagatttggacctgtgagacatggcacttggtatgatgtggatattaactttttatggtattaatgatgtattgggtattttttatgtaactgcaattccatcgattaaaaagacactcatacttcaaaacaatggtaataagttatggcgaatggtgaatttatatataattgggataaaatgatttttggttggatatgatagccattctgatcatttactacatcaaaattaatggtctattcaaggtaaaaaaaaattaatggtctatttcttatagtgaatagtgaatatggcgagatatgatttcttttagtattctttttataggcaataaataaattgtccgcgtatccgcgcgggcttcctttctagttagtctaataaagctcaaaatgtgctgctcatattctagatagtgtaccaattttaatttttaaacaaaattggtgtttttttaaagtacgttttaaactaaaaacaaagatataaccgcaagtaccgtgtgggagcgtcacaaaaattcaacgtagaaattcgcttgtaaaagcatgggtgcacgaacactgacaattatcacataaactatattttgagaaacatagtactaacgttacgctcaaaacacgcgcacactcatccctataaacacacactcacatcctacccattatccatttgagtatcttcagaagactggaccgacaaattttgtgtttgacaaaatcaccacggacgctttattgttaatgggtacatcacgtactacttaaaaattaattaaccataaataaaagcactcgtgttaactataggacttgaatttgataggatagttccaccataataaacttatagttgagctatagtcacttcgcaacttatatttgttaatcacgagtggcatgcctagataattattaatttgaatctgaatttttaagttaagggaatcaacaaaataagaaacctgctgctgactattaataccgaatccaggaattactaaatcatgagaaaatataactgagaatctttgtatttaggctatgtttagatttaggggtgaaaatttttgccgtgtcacatcggatatacggacacatatttgaaatattatacgtagtctaataacaaaacaaattacagattaatttcgcccgtaaactgcgagacgaatttattaagtctaattaattcgtcattagcaaatgtttagtgtaacaccacattgtcaaatcatatagcaattaggtttaaaagattcatctcgtaatttacacgcaatctgtataattagtttcttttttatatttaatacttaatatatatatgtccaaacatttactagaagatctaaacagtctcatacttaggttccgcttgcgaataccaatgagattatgtacgtgccgacgtcgatcaagccccagaactatactaaagcccagttggtgaaaagaagatatgagatcaagacgctgaggagaaattgacttgcactgaccttagacacgggcacacggcgatcgagattaactcgaattttccacgggcgcgtacaagcggataaggacagggtgtgcgcagcgacaagcaaggccggttaagagcaggtataataaagtacgataagccggcgacacaagcatccacgtcataaaaatcataggtggaagagagagaaaaccagagagagaagacagcgggtgctaatgcaatcgccgagctctagcacaggaaatgatgcaagtcctgagaaccagccctcagtcctagcttttgcccaataacttaacaattgctccatcaaagattgagtagaaggaaacaagtctcattaaaaaaaatcaactgcttagggatgtgtgggtaggtaacttaacagctagttattatacgtatcatctattagtaacatctattacttacgtgtataaatttttaacccatcaacggacgatactattaaacttaaacttgctctaaagaagtagtagagggaggccgggacagatatcacaaagaataaagagatcagggacagattccacgagaaggtttgccgatatgccgtggccgcaagcgtccaagcgcaagcctacagctgcttacgcgatgccgctcgtgttaccgcctgcgacagaaaccgccatgcacgcgcggcggccgagagagatagagagagagaaaaaaaaaagagaaaaagaagaaggcggcaaccaccagccgcccagccagcgacgctcgctgccgctgcttcgtccgcctgcgtgctgggctgctgccgctgccggtcttcctcctttaatttgttccatgcccttgtcgcgtggctgtgctttgcatgcgttcgttgcggctaggtcagagtcagggtcaaagtaggagtagtgcgctggtggggtggtaggagtaacctgtgactcgtctgcgagaaaggctgctcctcgggagaggtgcgttgagtgtgcgcgcgcgcgcgatgcatgggcatggcaatggcaattttgacagcggtacgtgtggctgcgtcccatgcggcggccgtaagcgtgcggtcgtccatgtgcgagtgtcggttggcgcattttggcaaaaatgccacggccggccggccggcgccgcgcttgtgtccgcttgcgttggccggccggcgccacccgccgagctgttgtgctgcacatgcgtacgaacgcgcgtgcatatcgtggagctctctttctacgcctctctacctacaactacaacagggctagtacagctactgttccatggtggtgcagatgcaaaagaaatcaaatgcaaatatgcgacgcgacacgtcggctcggcggtgaggtccaggtggcgagagagagagagagagagagagagatcgatccgggagttgatggcgcgtgctgcgccccgcgggaaaggcaaggtgggggcagacagcgccgtcgtgtcccgcgagccacgaccagccctgtcgccccgccaaagccgtcgtcacgtcgatcgatccatcggtattacttctacgcgcctgcgctgcaggccaggccagcggaaagtcagcgacgtactactacccctacgtgccgacgtcaccccggcccggtgaggcgatccacgacgtggcgtcagtactgatcaagttcatgcatgcgtgcgtcaccccggtgagagcacagcattcctagtgcatgcatgcgcgcgctcttcttgtccatcaagttcgatcgcctcgcgcaggaccatgccctcctcacctagcttccagcctgctttattcttatggacgatcgcccacggactactacataccgaccctgcagctcatgatacagagtaccctgttcgtgataactccagttaaagtatgcatttgtgtaaataaggatcttagagcagctccaataatctacctaaatcaaatcaagatttagtttttcaaagctctccaactgatttaacaagttaaacttattgctcactccaaccgtctctctattaaccctatcaaaaataacaagacccatatattaacctctagttccttttttccttccctttttactacccaacaagctagagaaccggaggtggggacagcgacgctaggaggggtcggagtttaggacggtggcgctaggtggggccggaggcggggacgatagtgcaaatcgatagtgagagttctcctatacggattgtagcatgaggagccgctcgatgccgtggatatgatgtcatcgggccacatggctgccaggtgcccacctacatcgaagtcagagacctagtccccttgccctagagagcttgatgtgctcagcagagaggatgggtgggaggacggcaaggggaagagcttgttggctaaggtgtggaggtgggcaaggaagacgtagaaagaagctatgtgcagcgacttgcgaagacggcgtacggcaaggaagatgacttcccatccgcgccgccataggagcacgtgttgatgccgtccctatccatggccacgggtgtcgctgaggtcctgcttgtcgcaggcgtgcccacagccggtgtcaggcaagtcgcagggatgtgcctcgagctgctgtccatgcctatgaagatcgacgaggcggggttccgacgtaaaggaggtggttgatagccggcactgaagaacgtaaagtgatgacactttggtgatggaggcgaagtcggtcattgacagacgctggagcacaagaaagataagaggggcgtagccacgtgggaaggaaaaatagtacgtgtggcccactgttggcaagtgattttggttggccaaatttggtcagtgaggagagacatttggtcggtcggatggcttagcaatccacttggcgagattattcgagcacaatttttcgttagaattgtctaattttagcttaaacagtgattcggagagaggttgttggaaattctctcggatcagatccagttaattgtacgtgtgacatagggactggtaagcaagaaacatgcaaacaaaatcatgcgctgcctatcactactgttggacgtaattgtcggcagtattaattcagttcagttcagttcaattgaagaagagtaaagagttgaatcgcagcgcagcagtacagtagggccagccgcgcgcccagccggccggtagcccggtaggcaggagggggccctatacgtgcaggggcactcgtacaaacggccgcatgcatgcataaatgtgagccctttttggagccgatcgatcatatcgtacgtgccgaaagccgattcgccggagcccttgcgcccttttcccccaacacccataaatatggcagtcataccgttgctgttcctgtttcttgctccatcatgatccatcgatcgatcgatgctggagtactgcaagggtgtggctggagtctgtctgtctcgatcctgctagcagtactacgaattaaacccagccataagatatacaattgaaattctttatatttcaaaatggaggttgtagcttactgatattttaacgagttcagttttagttggatgcaaaatttgtactcctgtatgcactatatatttggattgatcatccaaggtgtctcaagattcgtcttattaaattgacaacaaaggttactatggtccggctcatttctcccacaagagctggattaagataaagattttcatggcacgttttttaaactgctaaactgcacgtttcgtgcgaaaactttatatataaaagttgctctaaaatatcatattaatttatttttcaagtttgtaataattaaaactcaatcaatcatactccctttattccaaattgatcatcgtactccctccattccaaaatataggacacaactactttttaaagatgtttcataatataaggcgtgcatgtatgtatggcaattaattagcatctcttctctcctaaattattattatttaaatcatacactcacaagatgcttaattctagggtgcatgtattgtgttagttggattgattcaaacaaagagataataataattgtttcttgttctttgagtcaagtgtggttacgccttatattttggaatgaagggagtataatttatttgaaaatattcctaaatgatcatcatatttatgttcattcattaagtctattcgttatttgtgcattggggtaaatgagcattgatgcaggcatccatacacacaagtgttttgatttgctattggctagaaaatagtggggattgtgcatgcatcaagtttattgctaaagtaaatgtagcatgagagagttattatattttcttggtcttggtgcactcatataatatgaagatcaattaggaataaagggagtacgttaataccacctcgttttgcataaaaaaataatcttcatcttcatcttcaggagaaaagaacaccacctatgtctcacgataattttaatttgcttttgttcgtcaatcataattcatactccatatattaatatcatattcttgtacaatactccctccattccaaattgatctacatataattttttctaggttattcctaaatgatctacatatttgtgttcatttattaagtctattcgttattctattttgcattagagtaaatggacattgatgcatgcatccatgcacacaactattgataacccacatgcaatatcttgatttgctatttgctacaaaatagtggggatggtgcatatatcgaatttgttgctatagtaaatacagtatgagagagatattagtatttcttggtcttagtgtacctatgaaatatgtagatcaatttggaatggagggagtaccatttactcataagaatttgtttctccgtccttgaatataaacatttatattcttggctttgtaatgataatgcccccttatttaatgtgctaaccgcttaaacttttttaaaaaaagaaagaggggggggggggggggaatccccacctgagttccataaaccatcgtaagagagagtttacacagtttgagattaaaaaatacagattacagatcatcttagggaggacgatagagtttccttccaggaggaaacgaccactttgtcctaaacactctgtgctagcagttgaaactttgctgagacaattgataaacttgtacatttcgtcctccatatataaacttgtacgtttctgtttccagcaaaagttttaatcagctttcaacaatttataatggtaaaatggtctttttatatccctcaacggaggaatgctaacgaaaacctgacggctatgataattttggaacaaagattgtacgatgaaattttcgggaagttgggttcgtcgatggtactttttagatgggacgtttatcgatggaatttctttgattttctaaaaagaatatactccatccgtcccataatgtagcaacctaggatgggattaggctcatcctatgactgaatctggacaca

SEQ ID NO: 60443 - DNA, 24024 bp, Oryza sativa
attcctgcagcccgtatgggacctagattgttacattatgggacaaagggagtagcaaataatagtccttttggcctctatataaacagtcattgataatatgcctgcgactaacaatcgaattgggatccagtgcagtcacgatagggactgcaagttaacaattgcacacaacttcaaccatccatttttatgatcaacggttcatatctaaagctacagtacccatgtgaacagtattcaacgctacagtattactgctacagtactgtgaacagtaccgtgtgtgacctgagccacccgatttgtatatactgctactgcttaagctgcagtcacacaaatccctaacaatcatacaaactgcctatgatttaggcacctagcatgacctcttctgtatcatttgcaagtgtcctttagcactctggtctaggagatcataaataacacaaagatcataataagagaaacattttattaagctcaccgcatgcatgaggcaacggggacgatcgatgagctggcaaaaaaaaaatggcccatgtgggggccagatcgaccaacatgatagccaaggtacgtaatgataggttttataggcggcagatgttgcgatttgcatgggaataattttgatccacatccagaccgatagatctttccaaatcaacacttttaggccctccatatgtcatcatgttaattaaccacggtccttttgttatgtcagtaacagtaattgtacatgtaactacatctttggactttagcttttacatgcatgcatgcctataccttttccttgtacatgctacatttttatgcagcggtggtggtactactgcaaagtgagagtatcttcaaagtacaatttgtttggtcggataggagatcaggagagaccgtcagtacaagcaaaaggacgttacgcaagcagacacaggagacgtaaaacagtgcagagttgttacctcgaacggagagatgaagagaaaacaaaaacagaacgggggaagaaggcccagctagctagtgaagacattaagaaatgaattaagcaaagaaaaaaaaactatagtaattaaacgtggtcataaaagggcagtagtagtttagtgtatttgattgattcttgcactgtttgttgagccttgatagtcgcataatcaaaagtagcaggaatgtcgtaggagctacatacatgcttctgttctgctctgcactcattctgaactagattcgagaatgtttcattctttcagtttcagatggcgatgagaatatgctgactgtttctatgttgagtttaagtattcgaactgtaactaattaatttaccatacatactgacggatggtcaaagactcagatagttttgacgaaataagcagaattaattaaggggagatgaaataaataaaacactggtagtagtaatttcagtagctagcaatagcatgcagcatcaaagcaagcaaatccagcgcacgcgccaacaaacaaccacatgcgcgcgcgcgcgcgcgaagcatgcacgagacggacagaggcagtcgtcgtgaagaaaaaagcacacacacaccaacctcgatctctcttcttctagctctagctcactcactctcaaacacacactcactcacacactgattaattagctagcaccgtgtaaatgggctgtatctcgatcgatggatatcctattagcagcagctaaatcaatcaactacttgctagtcatcatcatcatcttcatcttcttcattagcagcagcagcagcagcagcaggtaaagctttttgcgtgctaggtatactaggggggctaagccagagcacgccaatggcgggcgggcgaggcctagagccagagcgcgccggcctccttgaggagggggacgagggagccgttgatgtgcgcggccatgacgcggtccatggcgccgacgagcttgccgccgatgaagacgacggggacgacgggcggcgacgcggcggcggggccgccgtacccgacgaggcgcgccagggcgcgctccagctcgcggccgcgcgggtcgaggtccagctcgtgcaccgtcgggtgcacccccatgccgcagaagaggcgcttcacggcgtggcacatgcagcagctgctcacgctgaacaccaccaccgcgctctccgacgccagccgctccacccgcgccaccgcgctctccaccatcggtgccggcgccgccgccggcatgtaccacgcctgctcggccgccgctccgtactgcattctcgccgacgacctggccggtgatctgatgcacaaatggagatgtgtgtgcttccttcgcctgaaaacgattagcttagctagagaagcacagagagctgagctagctagctgtgtgcttgtgtgttgctaagctagaatcaactgaggtgagcttgaacacttggagaagggagtgaagggtgctgggtatgtatatatagagaggagggtgaggggtacaatggtaaatttaggggggcagggaaggaaggctaggccacttccaagccaatgaggtccttttggggttccaacccaatattactcggttttacttatgtttttttggggggtagcactagctcaccactttgtttatttttcacctgtctagtttagtttattgtcaatctgttggtgatgtgaattctttgacttgcttgtatgccgctggtagcttgactcatgcattactcgttgtacatgcatgttttttcacctagctagtggtagctcctccattcatatatttgagccttgtccattgtgctccctttcctggttaattcagcccaaatgaacattgaacaatcccaaatcaagcacaatacgtattgatcatttgatcagagacatattctgcaattaacagaagcatctggtcaacttctatggcaaacaagtcattcactactaaagtttagtataggtgaatgttagtaagtactttccctttacctggaattagtcatatatattatatactaaaagttcattaaacttcctacaaacgcttctaaaccgccatgtgtcaccctataaacgctcctaagccaccacgtggcgctttaataaattagagaaaaaatatgaaaaaagaaaaatatctgaccgtcaattttcatttaaaacggtggacccgatactattaacctttagatcaaaacttaaaccccccccccccctcaccctttccttggctgtcaccacatgtgtacgtacgtacgtacaaattcctcccccatcaatctcttcttttctttcctaattaattaaggcagttaaaaatacacaccataatttgttaccgtggagtcaaaagatctgtttttccatagagttttagccgggagcgaacacacaatcactgttatataaaggagtggtctcgatgctaccgtaaatagaaaatgtgttttcatgggtctcatattttacaggaaaaaatatatatttgaaatatgaggatggcatgagctgtcaattatatgggattcttaatttgcaacgagcataattgtgacccattacatataatctgatgagtaatttcaatgtagtctagagtttatggattttaatgtagtctatgaagagtataattttaattttatatataatatttgtaacacaatatataatctatgatgataacatcagttatcttattaaaaataactttctaaaatagatataatctaacggtctaaaataatgggtccactaatttaaatgaaaatcgacagagaactttttaaatagatataatctagcagtctaaaataacaagtccaccaatttaaatgaaaatcaacgatgggattgtagaatgccacgtgacggcctaggagagtttgtaggaaatttaaatgtcctacaaacgctcctaagccacgacatggcattttaaattagagaaatttctaaaaattctaagaaataaaaacaaaacatctagccattgattttcattaaattaggtggacccattatttaccaccgttagatttatctaaagaaaaaaaaactccctaaccccaatcaagggtccacctaggcctatacgtacagtacgtacgtacgttttctttttacaggtaacaagtgcgtacgttcgtaatgtacttccaccccttcttccctcaatttttttcatattgcacatatttcttctattcatactttattagttacaaaagcaaaaaattggtgttaaacaattcagcaactataacatctaattagaactattttttgatccacttatatctttaaatttatttatgactaaatttacagctaaagccaaatgttcactataattcaactttgagaaaaaaaaagtcaatttggattttattttcagacggtcacgtgccattcaagcaattataaaaaatatgaaataataatgatattatagactcaatcatcgtgcataacttcataataattaaataatatctacaatcataaaggtaaaaataaacataccaaaatatattagttagaaagcaagagttatgctaaagaaataagcaactataacatctacatcatggatccctaaatcagataaataatatttctgcttatgtattttgattactatacatttaaagacccatatttggggttatattttctggctttgtgtgccattcaaacaactacactactggagaatgtctctattctcccggttcggaataattcaattagatatgtaatgacaaaagtaaaataaatctaataactctgagtattgttccaaaaaattactcctcccattttgatattataataaatccaaaataacattagtaaatctgtagtgttcatattttcagtatctcctatatacgaaaagatgagtaaaaatgatatatcttaatcaatcaataaaacttttattctatttttagttaataaagtaatggtaactaaaacactacaaatgtaaaaaatataattatatgtgggtgtactttgtccccttctactttgtgttcttttcctttctcactcaactcctccttataatttctaactaattgacaacataatacaaaaagatcaataattacaaagcaatataattatgattcttatgttatatattttttaagagaacacagcaggggaggcccccgatgttaatataattttattaaaatagaaaagaacatagttacaacagattaatccactttttcttatgttatatctgatttttagtttatttgaattgttattttatttataattaaataaaaaattcaagacgcatattattcatatttcactgtataaaactaaaaatacaccatttgagcatacacacctatctttgcatgataaccaaatagaaaaaaaatacagaatattataaataaaaaatgacaataggtttatatgacctcaaatcattgtgcattctctgtatgtgtcacgtgttatgtcttaattaaaaataaaacctcagaaactgtaaataaagacatctgaccattagtttccacttaataggtggatccatttttttaccagtagatataattttagagaaaatcttaagccgccatgcgctacgtcttaaaatttagaaaaaaaaggatattagaaattttgacaaaaaaatcatcggttttcacttaaatcatttaggaaaagaacacccctccacttcgccctcccgtcacatatgcacagcacaacactacccgtcccctctcctctcagctctaactcaccactctctcctctacccatcaattttttattgcaagaaataatcaataatattaaaacatgtatatttttaagctacacatttgatttttaatctgactattgctctatccataacccctatattttgaactggaataaaataaaatttacaatttaaaatatcaatagggactaaattgaactatttggagaaaatcaaataagtttgaacttttcactaaaattgaaccaaccattacatgttccatttttctaacaattattaaatgcttaaatattagtggtcttgcatctatccaataccatattattacgagtttgtctgcatattaagccacactaagatattaatatatagttggttatatttgttactattatatttaaatttttggactcatgtcgactatattttcctatagatcacacatattaaaaggaagcgaggttctaagatatgtttttgttaatttatatgtaagtatgtaaaacatgcatattgaaccaactaaaaagatgactaacttgatggtacaaataaagcatgtttactaacaataatagttctttaggatttattaaaaaaggccactaaacaatcaattaaacaagacaaaacattttactttatgtttattttgttaggcacgtttttcaaacaaattaaataggtatttttgaaacattgcaggtgtttatacagatcatacataattgtttataccgatggattaaatattatatattttaaaagctaacaaatagcatggaaaaattatctaagtaatgttgatgaagaaaaattacggagaaatagtacttttgaaacatggcatgtgtcatccggttgatattccgcgtatataagcttttcaaatgcaatctaaatacatgcccgcgcaatacaagtttttcaatcatggcaatataagtttttcgaagtagtacttttgaaaaacttgcaggtgtcatcggttgatattccacctatgtaagtttttcaaacacagtctaaaatacatagcgctaccttcctagttaagatgaaaagttgcatgcaattgtacatgcactgtttggtttctgaaaatgtatgtgttgtgctgcacggagacaggcaatgcaaccggacggattaaacgcaaggctttttctttcatggcaatgcagcagcaaacactgcgagtgtattacatcaccaagatgtttctttgtcccccctggcttttgtgcgtgctagcgtagtaccaccacttttccggggcacagcctgtctttatcaatgcaaaggagtggccggcgcccctgcgttgttgttctagtactgctgagaagagaattggctacgagatttgatttgatggtgacagagagaaattaaaagccatcctccaaaagaccggcttttgcttcagcatactactcccaggctgtgtttagtttagcgtaaagtttggcttttggttaaaattagagatgatgtgactgaaaagttgtatgtatgacatgttgatgcgatggaaaaggactaaactttaaatccaaactttgaatctatacacggctatgtgtgtttccagaatcattcctagtcaacaattcaaaaaagcttatgcgtgcatggatggaagcaaaagatcgatcacctcattctgtcatacatatccgttatggaattggttcctattcatactgatctactacttttcgaatcttataaagattcagattaaatactagcacgtaaaaaattattacgtatgattaattgagttttaattattataaacctggaaacgatatatttaatattgaccaaacaagtgcactaacgaccatgccattgcctaaaatatctcctatttataaccagagggagtaccaaattaaaccccgggtgaaattctgagcaaaattaagagctttcaaaggagaagatcgatttaacgaagaatttccctgcctttggaggaaagaaaaaatcaaacaactttgaaaccccagcagaacaacaactactactacggcctttggaagattcaacggccgggcatgcccatgcaatgcaaatgcaagagatatgcaattgcaactttgacagcgagagtgggggtaatagcggctgtcctcgtccttcctgtcgggacgagacgactgtaccgtgcatgcatacaggagtagtaggacctacaaagccagagcaagagcaactcacatgcgttacatatatatggccaaaacgagctttttggtcgacccccagccaaagcaaaatcaaacgaagccagccacgcactgttctctgttcgcgtttgctgtgctatagctgtgatcacccatagtgccccacactagctttggctttgctttcttccccacctaacatgcaaggagatatcatgcgtgtctctgtttgttttcctcgtcacactagggtttgcacagtgggcgttgtctccggccgggccattgcatggtgctctgctagcttgttgttggctttatgtggcagctatagcacacattcatgggacatagttattgtcttctgtggtgttgaaatgttgagaccggccgggttagaccataatatctgatggaataatagtagttgtggagatctatatatattgcgaaaacgctaagtaccgcgtatctgatcgtgcgctgaaaaatcggtcgccacacgcgccatgaggtcgagccgcgtggatcggacggctatccatcggactgtgacgttgccgttggatgttatccaacacaaatgctcccatctctcatttcttcaaaagatttttttcttgtaaaccatttatctaatctacgttctgattacaccattaaatttgttacaattaaatctttacaacaagaccacacatgattatatttcgacaaaaaaatattttagcttttttattgatatttttttagaatgctgcatatggttcttttgatgtttcaaccagtagttttacgatgtttcagctagtgtactcgtgatgtttcactaagtacgaatcaaatattgcagtggattttgatattatggaacgtcgttgtaacaaatcacccatatattttggaaaccctctattaagggaattcgtttctttttttctaccaaaaatgttttacctagtgtacccatgatgtttcactatgtattgatctaatgttacagtgaactgaaacattcttttgcaacgaatcacccatatattttggaaaccctctattaagagaattcgtttcattttttgttctaccaaaaatattttacttagtgtactcacgatgtttcaatatgtatagatctaatgttgcagtgaactgaaacattctttcgctatttgctgaaacattgtttttatgtaaggtgaaacaacgctcgatttaaacgattgaaacattttcgacctacttagtgaaacaattccgatatatttggtggaacatcgtgcaacatttaaaaataatttaataataagctaaacaaatttcatcggaatatatccatgtgtggtcttgttttgaagatttaattgcaacgaatttaatggtgcaatcgaatcatgatttggataaataatttaagagaaagttagtttaaagtggttttgcacgcatgcgtggtgctgacatcagacgtcagcacccgaattttacatgtttggatcgggttcccgatgggtagtcccctcctatatattgggcacccccatctcctataccccctgcccctaaaacagaatgtaatgggcaactagattactagagttatctccctcttggggttgctctcaaaaggaaaacaatatttaagttttaaacaaagtcataaaacctagctgcttccttagttgtttggtgttacagaatataagctacaatactagcttgtgcatagaatggagaaattttgaaatgctgttcaagttaaaaatggaatttccttttatttttgtgtgttttgtgtattcctcttcatgatgtttggagtctaagtagtactcgtgtatcttttggctagctgtatatcctttgtgaatataaagaccagattaatgaaaaattcattatctaaaaaatctatggcctgttatatttatataatgtgcaaatataacacattatatggtttgtcaaacgtgtgttgcacccactattttggtattataaatctaaaattgaaattatatgttacttcaaaactaatcattatatgatccttattttagattatatctggtagctagattaataaagaatacatatcaattacatctagctaattaataatttcaaaactaaataatgaagtgagaatccagtactacaggtacaactttatatttatcaattttaaaagtttaaatcactaaattttgaaagaagaaaaacataaaactagagagtccataatattaacaaagacgtgtgaatggtcaaccgactctctcttttgttgttttcttttgctacattaattaatcggtggcgtcaactctagatgggttacgtgctcaatctgatttggttttgagttagggagatcgtgtcagacgtcctgaatcgctgatttctccataaatgtagagccgtcagccgtgacctccacactatacatgccaaaaaacaattttagcttatgttggagtgggacgcgaattctggctcgggcacctgatgggaggaggtaaaaatcggatgctgatgtcagaatgatgtcagaacccgatttacgtgcaaaattaatttaaacttatttttctcttaaattacttatccaaattatgatccgattacaccattaaattcgttgcaattaaatcttcaaaacaagaccacacatggatatattctgacggaaaaaattagcgtattattgaattatttgtaaatgttgcacgatattccaccaggtatatcgtaattgtttcactaagtagatcgaaaatgtttcactcgcttaaatcgggtgttatttcaccttatataaaaacaatgtttcagcaaatagcgaaggaatgttttagttcactgcatcatttgattcatatatagtgaaacattataagtgcattaggtgaaacatttttggtggaaaaaaaatgaaacaaattcccttaatagggggtttccaaaatatgtggatgattcgttgtaaaagaatattttaattcattgcaatattagatctatacatagtgaaacattgtaagtataaggtgaaacatcttttgtggaaaaggggagggacaagtgggtgggtccagtgggggtgcgcacgtggggggagggggagcgaccgattttcccacctcccctggtcgaccgatcctatttattctccattggagtggcgtaatatttggcggggttacgcttcctatccaatttggttccaatgactaccgagctaactctccatgcaacacatcgtaaaagaatttatgattttgcctcctcctccgtactgtcatcccgctcgtcggtgtgcactggtaattatcattagagcatatcttcggaacttattaaaaataatactattttaatagaaaattgcaaaaatagagatcgaccgactaaaatcacaaatttaataccctatcgaacaatcattattcgataagataaatattgaacaactgttgtttgacagaggttacatgctaaaaagtaaaaatataaaagctcatcgtgcagtgcacatgctgccattgcagttgggtcgaaggacctatcgaacagctatagttcgatagacgtctcttttcatattttttttattttatttaaatatactaacaaacctgtcgaagaatagttgttcgataggctatctattattgtatgttcagtactaatcgtgccgtagttgtttgatatgtagttcgacagggtattaaacttgtgatttcagtcgagtgacttctatttttacaattttctattaaaatagtattatttatagggcaaaaccgttctttttagaagcgttatattgctacgtttgactgctcaagttcgtccactatggttcgtccctcctctaagttcggacgctgcacacgtcatcatcgacacttggtatcatacatcgtcaatgcacatctgctgagcccacaaacctccaccatcatataactagtgctttcccgtaaagtgatattttcttatgtttttggcaaaaatagggtggtgtattcttattataaagatgaggaaaatcgagccgaggatcaaattaatcaatcggagggaaatattcatcttgccagtggagattctctacagtaccactgatgtagtagtagacattgacgtgcgagtctatatccacatgtcaaccaaggctgcggcatcagtagtactgcaaagggcatgcatcctccacttacatgtttgagcatatatatttttatggcggtgcacttcatcgatcccaatgcaaaaataaaaataaaattgtaaggcgtatctctcttaaaaaaaggtccaatccgtggctacaaaatctgcatactccctccgttccatataaacatttttttagcacagtgacaagtcaaacatttttaattttgactattaataaaaaaaataaaaaaaagatcaatcatgcaaaattgatgttactagatttatcattaaacaacttactatcataatatacaactttttttatttaaaacattttacttctatagatatcgttaatcaaagtagtatcttagagaccggatcagagtccaaaaattcttagggcctgtttagatccagggactaaaatttagttcctgtcacatcggatgtttgacactaattaaaaatattaaatgtagactaataataaaacatatctcataactatgtactaattcgtgagacgaacctattgaacctaattaattcatgattagtctatatgatgctacagtaaacatgtgctaattatagattatttaggcttaaaaaattagattaattggatccatgccactgcaactttgccaaattaaaaaaaatacaccactactattcccgatatctactgggtgccatatgtattttgcaaatttttaaccatgccactgtatacgtcttggacccagttggaccaggttttttcataccatatttttgtaaggaccaaaataccctcagtccatagaggatgacaagtaggacccaccttatcatacttgttttcatcctatcttatattttggtatggagggagtacatactttggtcaagatttatagcatccgtaactttggttcgaaatcttggcttttcctacgtcctacgacgactattcttttgtattcaaacttctaactttttcatcacatcaaatgtttggacatatgtatggagcattaaatatggacgaaaaaaaatcaattacacaatttgcatgtaaatcgcgagacgaatctgttgagcctaattacgccatgatttgataacatgatgctacattaaacaattgctaataacggattaattaagcttaataaattcgtctcgcagtttacaggtgaaatctgtaacttgttttgttattagtttacgtttaatacttcaaatgtgtatccgtatactttaaaaaaaatttgacacacagactaaagcgcagccaaacacagcctttaatttgttcttcgtcagagaaggggacagtgtggaggctgcatgcggatctccatgcacacgcgctgtacttcctcccaggcgaactgtagtagagtagctattcgctcgatcgatctatagctagcatcgatccgtggcgcggcgggcgatgcatgggcgaaaggtgctctcgatcgcacgagaaaaaagcaaggcgtgagcaagtaacatgggagcctgtactacctagcactatagattctactgccccatgtctgcatttctagtccggtgcgctgactcagtttatactttttttcattccttaaatccctttgaacaaaaatttctttctatatactaacttttgcacaatatttgatcgttcatattattcaaaaatttaatatagatacttaatagtataagttaagattatattttatttgatgataaaacaaatcacagtaaaataaataatatttatatttttaataagacgaattgtcaaacattatatgtgaaaatcaacgacgtcgtccatttaaaaatggaggtagtatatctaaatcatttttccacgtcgtctatgtaacattatatgtacataaaaaaaaactttgcactgccaaggccaaaatgcctattttctttaaaaaataatgttaagggtacggtattctaattttatcaattaaagaatttaaaaaaaaaatcctcgattggtagatcgatcgagttggacgcaggtgatagatgcctgttctgaactttttttccgagggcggtgatacgtatcttccgatcgctcctttgggagtttatttatttggtttttgtccaatcgctttgtactttcttgatcctttggatgcatgcttgtgctttgtgctaactatccggccgggcctcgacagaaatggctaaaagcttggggcctcgttactctcatcgatctctccatctgaatcctgtccatatccaggttaagatcacgtccacaggcacagcacactagcacaggcggcgactgcatgcgatgcttttcgggctttttgactataccttcttgatcgatcactcctctgcttactttcatggcttttcatgtcatgctcctgcatactcatcgatcgacctctcgtagcatgtaatccttccgtctctaaatacaataaattttagtggagtgtgacacatcttaataaaacagagggagtactacgaagcgtagctatgctgccgtacgtgaaggaggggagagcgcgcatgcaagctagcccaagaagtgaaggggtgagaggcatgtacttggaatatctactcaaaaatatttaatatttaagataagatggtgttatacttttaaaatttcctatcatcaataactcatcaaatgcttattttaaaatcaaaagatgtggtacacatatatttcatttttgcctcgaaaagtactattgtaataacataaacttgttactccacccgtcccatgggattatgctatttcttcatacaaattgagacaccaaaaggacaagtaaagaaaatgattgtgggaaaatagactagtacgtataatagtataaaagttataggtgaaaaaacaatttctagcgatgaatatggacatagcctatatccaaatttctagtcataaattattttttattttttgatcgatggtgtagtacaaaagttggtaggtaattgctgaaatacctttgtcataaaataatttactttgtttatgtgataaacaagatttgtgcgatgcttttcttatatccatgccacaactagtgaatggacatgttaattatatagttgagccatcatgtgttgagtttaagcatgttattcacattgctagcgagaataaagagtttaaattactatcttttttaaatacttggggctatattcaattcgatgatctttgtccactcaactgtttagagaataaattatttgctagatctgaattgccatgtccttctgatatgattttgcatgttattggcaatttataatagtaaagcagaatataatgtgcatcgagtatatatttgttcgaatttaactatacctccttttcacgatgaatgtattgtctagagaaccacatgcgtataaataattctctatctagtttctctacttgtttaaatgagctatatgttggtttgcaagaaggggggtgctgtggttttccaagtggcaaaatttcagaatccaaccatatagcaatcaagaaatgttccttacctgatgttgtgatagataaagataagttcagtaggctcaataacaaggtgaaaccgaggacggtttccaaacaagaagatgagtatgataaggacacaactagatcagatatgaccatgactaccatatgtattcatcaaccaaaagtgcatatgttctatattagatttacttgttatatatttgaacaaatattgctacacaatgagtttagtgtgttttcttttgcagaggtacttgcataggcaaaagaaatgagaccgagcataagaaatgcatggataaatcaaataagttgattggggaccaaatcaataccttctccaagtccattcaaacctcaccacgtcacttttggtccatagatgataagagataaagttctacacgttttggattcggatttgggcctcttgacagcattaacttcaaacggagctaaccgctgatctagaaagaatctcggggatcatgagtacttgttggaaagcctatggagtctactttcagatggttttggtcccacgtcaaaattcgcaccaagctgtcgggaatcagcaaaacaagccacgtacctcatccactccgaatctgatttgggtcttgggcctcataacgatgtcgtgggttaagcccaagggggtgtgcgccatagggcaatcttaggacgtcccaaatcatatttttttaatagtcgtcatagtttagagtcaggttttgcttagattatttctgccatcacagttttgccgctagtttggtttgtgaaaccctaaattcgagtgcttaatcattcatatgcaattgtgttgcaatctatgttgttcttacttgtgttctttgattcgcatgcagagattagccttctcggcgaggtcaacctagcagtgcacggttgataaccaaagaaaacgtggtgctatgattgcaggatttgaatcatgttgatcagaagccggatcatgtttattaagttttcacaaaatcgagagttatcaatatctatcagaagatcgagacctactatcctcatcgatcgtattgtatagcacacgtacaaattgacccttagtaataattaagtgaaaaaagtgcggtaaaattgttaagttaatatatatagtaccgctaataataatatagtacaaattgaccctagtaataattattatgtaaacaaagtgatgttaaacttgtaatatactagtaccactagcttgagcccacaatagctagtgctagtctcatgcatggctgcagttgcctgtacattccacgcatacatatggacacatgcaatggattgttattatttgtacctgtacgagaacgtacgtaatacaagtgtgtacaaccatacacatacacaatggcaggttatgtgtggaattaattaagttagctttattgggcagagaaacaggcaaacagcagtgtggaccatcagaagaaatatcagccacaaaactaactaattaactgccggtaactaaccgaaaagctactagtctgaataaaagtgagagcagcctcctgtctagcacgcttcatcagtacgcgccactcaactccatgaaaaagatcacaaagttatacttactctccccttttagtaacgtgggtcaatgttttacaaggttagtgtaaagaagacgtttagaatgaagtgttacaatggtctattttgatataataagctactccctccattccataatataagacacaaccatttttttatatttcataatattataagacatcatgcatgtaggcaattaactatgacctcttcttcattaaattattactttttaaaatcctccactctcatgttctctaactctattggatacatgcattgtatttattagaataatcgatctaaactacatgatgataataattattttcttggttattgggtaaggggtggttatgccttatattttggaatggagggagtagctcctgctgatttcaaatatagataattacttcaaactcgctataattggcattcgatcggtggttaaataatactttttttaaggagtactccctctgtttcacaatgtaagtcattctagcatttcccacattcatattgatgttaatctatctagattcattaatatctatatgaatgtggaaaatgctaaaatgacttacattatgaaaaggaggaagtaattttcatccgcagctttgctaatttatcaatcgcctgattctttttttaatcgtccgtcacctatactttcccaaggtgtcaagcaaagctgcacaagttgtacactaaatttgatatagaaaagtgtaactttaaaatagatgaattgcaacttctattttttctttttttattaattgatgaatgaatctagacacatttttatatatgcttatataatcatagaaaatttcctctattagcaagaataaatcagcaagtgcaatttttttgtaagtttaggttagaatattttttgtgtcaaaaagaagaaaaaaataatatatgaaatatttggatatatattgatctaggccatgttcgacagcctgttacaatcctactacaatgcaacgctttatggctagtccattcgcagtagcaagtaagcggcagcgggtctatcaagcagcgttgtactagtaacacatagccaagcactaccttactgttgattattgacaaggtgattgataatattcgctccatttcaaaatgcaggatatacactataaaaaacgattttgtcatagcattaccctttttattttttttcaagcggattaaaaatagtgccaccagtaaacatcacgtttatttttactagcggatgaccttaagtgtccgccagagaaaatcgattttcactggccgatgcttaagacgttcgttagtgaaaatcaattttagaaaaacatatatttgtacctaaatttttcatataaagtcagatgaaaataaaatttgtaccaaacttgttaattaatctcaatttgatctacaactttttagttcaaaacttttccatttgagatcacgtagggttcaaaatattcgttatacgattcaagatctattttacaaaatttcagatatatgaatcacataacctcctatggacatatgatctgagtcaaagttgtagatacaaagtagttcatgactttttttttaattcgaaatcatttagagaggaaaaaacgaattttaagtttcgaacaatgaaaatcaaaacaatagcattctgactatggataataagtacttcatagtaagatggtaatgtaatacatgtgtggagagagaggtctttgcgtttgaatcctatacaaatcacaaagttgtgaatttaatctaaaaatttgcctaaattgtcaattaggatgcatagttgtgttacagatgcccggtaaaaaaatcaaaatatttttgttattttatttctgattttcgttggtagctgcattatgtcgccgccagcaaaaattgatattcgctggcaatcggatgccgccagcgaagatagttgattttcacttacctttagttgctgacgaaatgtctggctgctaggaaaaatatgttttagccatcaaggaaaaatgtatttttacagcgatattttgtttcgttaggataacactttcatgaaggattactctattataatataagttttgaaaatcaaatttgatgttattatattcatcttcaaaagtaatttaatatgattatacttttgtactccctccattccaaaatataaggcacaaccaccattaactcaatgaccaagaaataattattatcacctttttgtttgaatcatcccaactaatacaatacatgcacccaatagaattaaacatattgatttaaaaaaataataatttaggagagagaatgtgctattaattgtcatgcatgcacgcacgcattatattatgaaacatctttaaaaaaaagtagttatgccatatattttggaatggagggagtacaacataagcaattgttgatcaaacctttatcctatcaaaaacaaattccgcaatatattttgaaatagacggaatacctccgttccaaaatatctataattctaggagtcgaagcacaaattaggagaaaggtaaaataacgtatatgtccctcattataagatgggtggatgaaagtgagatgggtaagatgtgaaaagaattgaataagaggtgaccaatgacacaactactactctagaattacactcctatggagggagtacttattttgggacgagtttaaatcctaaatttgtaattattttgggaccaattgaaacctaattcttttattacttaaaaatcagtcaactgaacaactctttgatttggctggggtttcagaattgaactttcacactgttaaccttgtggtgtggtggtgggccgggagcgtcgtgtgcatgggcaagatatgatcgatcaaaaaagggtttagcaaaggcgaaggtaattaagcacctggagagaataatgctccccgttaagagcaagttagccaactgttggcttcaaatcatctataaccaatttaatagctcattcatataatagttacctataaaaatatattacatcattaatacccgatcctacctctcatacactcgtaacgtattagagtccgtgttgcagccagctacaaatctgtagcccgctttcttctctctcttctcttttcttctcgatatatggttatagctggtttatagactgctattatacctgctctaagccaacctttggcgtaacagtagatggctaaaagaggcatgcacgaggatgttaggacgcgtttgtctgttggtcgcccgctgccgtcgtcgtgcatgcaaagttgcgaacgccgcgcgaaagcgaaagaaaagggcgcatccttgcatctactctctctctctatctttatagtttatctctcagttcactcatatagtaattaactcttcgttataaatatatggtccacctgactgtctcatagatttttttggttactgtgtctaagtcggttgtaaacttatagtccgcttctcatcgctctcctctcctctctcatctatctcagtattcagccttcttagagcaagtttaatagtatagcccactgctacctctaaatcatctatagctaatgtaataaccaatttatacaatagttacttactatactattcacatctggtctcacctgttatacacatattacgtcttggaattcgtgctttagctggctacagacttgtagaccgctatttttctctctcttcctttatctttttaaaatatgtttatagttggtttatagtctgatgttgtacctgctcgaatggatggttggatggatgcagctagtctagtgcgatgcccaagaaattaaagaagctagcatggcgatggccatgcatgctgcgctcatttacgtttggggagagggcggccgggagaccggctagcagatggggacgacgaacgcacgcaacgcggtgatcgatgatggtggcgagcatgcggcttcccgaggctgacgctatgccgccgcccggccggcctcacgctgacctataccttctcttcagtctcaggccaatagcgcccatcaccctcctcctcttgctcgtcccgtacgtacgcataccagggatttacttcctatgtggctccgtcttcatttttaaatctcttttaattattttagtttatttttaaagtaatcattacattataaaaataataaatagttgtattcagaaaagataaagtgagaaatagttgtattgggatttagtctttttctattactatattggtaatttggtatgtatgagatggactcaaataatctaaattctcatcccagattaatttcgtgaacatatagttataaaataaaaaaaatggattactgctaactctattaaaaaatataagtatttttgctttttttttgaaaaaaatatatatttgggcatccttcctaaatacaatcaaggttgtaggggttcagacggaagtctcacccggtggatcactaggccagcaccggctatgtcttaaggcgtcgtaaccccttgaggcactgtcgagggtacatctctttctttctcgacgattttctctaggtgaaaaccgcatgtttcttaaatgggcgatgtcgacatccatgatgtcatgacctatatgatggcaccattttcggagtctcatttttgtgatgttgtcataggctcggcatgatttgccacgctttgcgggggacgttttgatgttataggctcctctctctcagtggtttgtgctagcttgtgtggttagcgtgtggttcttggacatattctttggtgcacatataacctcgatagcttttgtcgtgtttttcttgtaacttttcttcttcttaatacatgtcgttgaccttatttggtcttatcagcaaaaagaaaatatgtttttggaaatccttccgttcaaatacattttgagaaacacacataaatattgtttatattttcaaacggagggagtagaaatcagaaacccatgttctcaccaactgcctcttaagaggtcttgatgcacaaatcttgtgattgtagatataagtaatttagatttttgtattttctttctgtaaagaaatgtcattctagtcgatcgctctagctaggcagagttggatcttacaacactaagtgcatgtgcaatcgtttgattctcactctttaaatatcaaataattataaaaaacactaaaagaattcacaatgttgatataataaacatataccattacgcaaaatctcatggccaaaatggcaaaatcaatctatacaacaaaaagaaaatcgtaagttttttaaaacctttgataggataaatcaattattagtcatgtatgtatataacggtattttcggtgtttttagaatgacctagcccgatgatatattgtagaacaaatgataaagtcgtcggtatattataaaataaataatattaatgataaattgttgaactgagacgaaatcaatggtatttgagtagattttctcttacaagtaatattaaaaagatttgtgatgtatactagctggctagatacgtatatatacagtgtgccacactagttttgatttttattatcttagatcaaaattattatcagttgctaagtgcttagtactactccactagctactgcctaagatgtgaaaggggaaaaaaagggcaaaggctgcgtacaatgtgttcccacatgttctttgcggtacccacaccttcttcaagcacaatgaaaattgtctttctcctctaccgatgcctttgtccctgttggcatcatatccatgtactagtagggtctaactaaatctatgatcaagatatttggattaagaaataaacctaataagatcgtggaacaaatggagtaatattctagccgttttagaagcttaggtttggatagggattatcttggtcggtttactgtgttgattacgtgtaccatttcttcagttctgattcctacatactatttcctccatcccaaaatataaatcttggtcggtttactgtgttgattacgtgtatcatttctttagttctgattcctacatactatttcctccatcctaaaatataaaagattttggacagatgagacactttctagaatgagtactatgaatctggataagtaagtgtctcattcgtctaaaatctcttatattttaagacggagggagtaatagacacgtacctacgtactcacctttttttttttgccaattcttgcattaaaattttgcaaaaggaaattatactctagagtactttttccccctccaaccacactcaaccaatttttctttcatcttatcccagaccgccgatgaatccctaataatttatcaattaaattccacaattgctttttttggagggagtaaaatatttaaaatcatttagatgacttaataacttgtaccatcttaattaaattaaatttttccaaaaataaatatcatattactatttctgacttttattattctagtactaatatagtgtgtttataacatagaacctcattgctaacagcatgtgtaacatactttgggaacaatcttaaactgatccatctgttctaatgaatatatataatatatatacttacccgcgagtgagaagtgacttagctaggagtaatattttctaaagctggggatgagcgtgttgagtattctctcaatcctaaaa

SEQ ID NO: 60444 - DNA, 13877 bp, Oryza sativa
acaacatcctggacctgtcataggcgtcatagaatgccctaaactccaagctctaaagtcagctgtacgggcacttgatgatttcccgtgtgtaaccattccttgcaatgcacgggataacaactatcaggtacataatgggacaccatttcttacacttctactttcatttctttctacctatcttgtttttcttaatcgtattcgtccaggctcttggttggcaagcgacagctggtagaacaagcatgcaacgttgtgctgcatcaacccaatggtttaatgaaagaatttcacttgctagatatgcacatgtaagcatatagtctagtatgaattccagtaagttatttaagtacatataaaaatgagatgaccatcaatgcttatggaaacaggtcccattgggaaactttgaactggattggcttcttttcaccgctgacgtgttcttttcaagggcattgcgtgatcaacagcaggtttgtcatatatggagtcaatgcaaatttgtgtttcttttttccctttctagatgtatgtgtgcatttcccacattcatatatatgttaatgaatctagacatatatatttatttagattcattaacatcaatatgaatgtgggaaatgttagaatgacttacatcgtgaaacggagggagtactatctagatacagctctagatcttttttaaaacggaagtaggattttgaaacagagaaagcagtaggagtacgtaattagttgcgctgtggaacagaaggtgcagtgcccaagggctgtgccctgcaatctctcgatcgatctacctgatcaacgatcatgggagcattatggggcaacagcgtctgggaattcaggaggagaccaaaaccgcatcgaaacggctccgatcgaaatgacaacgacagtgtgggggcccgcatgtcctttccctgtccatgacatcatgcatgagcgctttggactggggcccaccaccctctcccttcgacctccacaccggcgattgagatgagcgagagccgagagactgcttgctgaataaaaagtccatcgacaccatctaaaggtgcaggataagaaagcaaaggccatgcaaactccgctggacatgcaaacaaagaccaatatagatagttggtcatgcttcttgtgatacctatctgaattcgggtctttgactcaatatagatagttctcaaaaagaaaagaatcaatgtagataatcacactcatggctaataagttttagttatagataatataactatccacaatgagacgtctatcacgattttgttatttttaatttttaaacatatggatttagtctcctaaaaatatttataagatatgatgtatctgtgttcatatagatgagtctacttatgtgcacatgtatttgcgtttgtgatgtgttttggaaaacaaaaacatgacagattttgctttaacctacatataagttattaatagtagtttttttttattacgtgtgagtgcacacgcgaaaaccacactcacgcctacacacccgtacaccatggtcagtagtgtggtgcagcattgttgctaactaaagaattctgctaactattgcatccgttctattttaagtatagttgtgagtttacgtatccaatggttgaccgtccatcttattaggaaattttatgaaaaaaataaataaaataatcatacaaagtattattcatgttttatcatctaataataaaatactaatcatatttttttcaaataagacgaaataccaaacgttaagtataaacggtacaaactacagtcctttctagtacagaagtagggcaaaactatatgactattgacgttgccaaatggtaacctagtatcataaaacagtataaatttcttaaaacagtatcttaaaatatccttttaatttgtaatagttaatttattagtttgtactctcaaaatattatccccaaattggataatggttaaggtttagggttaatggctaaggttttaaaagaatcttatcctaactataaaatatttatggtagaagggaatagattttggatgcaattctgtcaagatgctaatcatagcctcaagctatatttcttacgggagggagggaaccaagtagcagcttgcagtttagcggttcaattatttacatgggcttttatctagctccggcagacagttgcactggaagtggacttctggaagagaatggaaaccgaaaaaaactggtataattcaaggtcatttctggactttggaccatacatggcagattggcagatgactcttaaagataagctaccgtggacaaggacgtggcctgcttgtaagttgtaactggtgagatcaaaatatgcttacctttttccgcatggatttcttgccttacatgtttgtgctgccaactgcgaacatacgaacgcatgagatctaaagatggagcatgctgtgaagcaagcaaagttaacccctacaactgatcattgcacatgacttcgagtaatctttagatttctaagataagctatttaacatccaaaatgacagtatattaaagcatgcaagctttggagaaaaagaggtacgataaaaatacagctacaacactatctagattctagcgcttcttgctagaaaatgcagtatgggcgcatacactgtttatgtgcatatcaaacaaatcataaacttagcaaaatttgagccttcgggcaggtgggctgaccgtactagtatccatgaaagataatcatgatttcaacttcttcctcgacacattatcaaggaaggcccaatcaggatatgggcattcgtagctccaatcaggaccagtatatcgcacacagtgcagccacaatgcctcctcatctgcatcataactgcccaaagaacaaaatattacgaaggcctgaagaattcctaactacaaacttgataactgtaagcactcaccctactggagcaagatttgggcaattcgtacacatcggatcgatgctgaactcctcatcggcttctgtatcttcgtttgtatcattgttcccaaggtcagcacaactgtcaggatctgaagatggcaatgaacaagctagcgtggttgctctgttgattcttgttccctttgacgaacgtggagaaaaattctcggaaaggtacacctcgtcattggctattgggtaaccaatgtgttttagatgtacccttatctacatttgtcaaacaaaaagctgtatcagaaatatagataagtaactgaaaaaacaaaaccataggacaagagggcatactattggcacaaagaatcagcagaaaaattatgaccacatctatctcatcttgcatcagagacatgctatggtgaacagatgtctgataatttgattattttggaagtaacggattgggcatgaagcatgttatcaaaacagggacaagggagctatgagtaaataaagaggcactcaacagtttgcgtgtcacctgtgtgcacctaaaatgcattttgccaagctctagcaggattaagatttccattatgattcagatagtgcagtaagtttaaaggccacttgaactttttctatgtagtaggcttttagattcatttttttttgggaaatttccaggtcgtttcgattgtttgaagtttgaacgagcaaatcaatgttgatgtgtataaggtagtgtgacctgatgagtccggccagtcacaggtttgcacaggacaatgctgtggattccatcagtacagatcctctgaaacttggtgcaggcttgttttccaattggagctttaccatcaccatcacaaacctgcatttcatttcagtaattgaactcagatatgttcttcaaaccagaattatatcctactgagtacacttgctctaccgaatttctgaaaatagttcatgcataaatgaatgcattgttcaatctacttgtacaagaagaactctataggacccatatcaactatttcttttgcttattataatcaattatctcttatttctttggtacagatagccatatgcactgttaccattaaagagcacacaccacattacactgtacaatcctacaattgctcagcaccagtatatcacatgcgggataaacctataattgctcaggcaaatacattgcatgagaagagaggtgcgaggcagtcaataattgccgaaagagatggcaatatcttcagtatatgcagtttcacacacaacaaaacataccaaccacaagcaggattactaattacatacctctgcagtgctccttccttcccgtgcgttgaagtgcacatttgcattaacagtttgctgaaaaagaattatttcagacagatatttgtgggaaatcagcagttatgtatgaaattatgaaatcaaatactaaatgaaatgcttttagttcacaagaaaattccacggagtcgtttcctaggtggtagatccaagccttcattctcacaacatgggaaaaataacaaaaccctacgggtgacttcagtataagaaatggtctacaagccttcgcagagtatattcaagttattttacattggcaaaatcttccgctcttggatccagcaaatttattgacatgttgagctgttgacaccaaataagtgacgtacctcaccatcaggaaacaccccaacaaccttggccacatattctttctgcagcaaactagcttcgatctgcagttatagtattcaattaagaaataagtgtgaaaagataaaagtgttaaagtaacatacataagttgagtgcagacagcagacacaaggaataaacaggacaatagaaaggtgaattcaaattgacaatgtcacctgttgcctgaaactttcagctttgtcagcatttttagcaaaaattaaggagacctgaaactaaccgatctagccgatgcacggctgtcaaaataataatggtggttaaggaatttgagtacaaatataaataaaggtcaaagttcaatcatacagggaagagaataaacaggatagtgaaaggcactagcaataatggcacaattgaggcaaaggatacgaaataggggcaccaatccatgttcagcttgcagaataccgacaacagtattcttgcggtattgaccacacggatgaacctacagaaagaaaacacctccattttttgtagttaacaataaacgactacagtcaaatatagctgaaccagatcaagttataactaaaccttacaaacaatggaattaacacttgcatttccaaagctactgaaatctcaaaggtgttgttgatcttaataggccagaaacatcattcaaccaaactgttcagattaactgctaccagaataagatctcacacttaacaacaaatttatgaattcaagaaggaaaaccttaggtactaatttcatctggtagagaatgttttaataacttcaaaatcacataatcctatagtagctatgcgtgtaccttgacagtttccattctacagatgtttcgcacagctcaaacaatccgtatcacatattaacatataactttcagggcacatgttggctatgaacctataactttagacttgatagttgaatagtcgatacaaccttacacttacaaagttcaggtaacatattttgactaatggatctaagtgaccaaaaaaattccggaagacttaatattaaggataaattaaagtgaaaacagttatattataaaaaggatggcccatgcatgtatatcttttttatacatcacatagtatttgaaggtttctgaacaaaatgatatgaactcactggaacagatgcaggtttgcaaactgtaacaacatcagcttcattttgaaggattgtaatatcaccacccaaaactggaggttcatgcctgtcagagtgacaaccatgaagaatttgacaattaattgtaattgaaagtatgtttctttctttttttacaaagaataaagagcttcagtagttagagagctaacgaaaccatgcaagcagaacgtctacacctagcatgggaaaataaaaactatagacaacattagagctgactcaggaaccaatcaagctattgtttctgtgcattttacagttcccatcaccattaaattaaaacccgatctattactattaacttagaagccaaagtatcagtaataactgcaaaaactgatgaagtaagtggagaaattatataagagatggttgtaattggttgagatgagggagtaggtggaaaggtagccatattttgggatgaagggagtaatatttttgtcaaatgaccatctcaatgtacctttgaaactgatgaagttgactcacctgtgcaagaaatggcttatcttttgtgatgattgcacaacatagtctgcgtgaaccatttggtcatccacctgaagcctcccacacttcactgcatgaacctagaattttgttttttttttaaatcaattctagatacatcagaattttgttttttttaaatcaattctagatacatcattgtagataatgccaaagaaccaagagagcttatctagttccaaacgtgcaagggttgaatcataagattaatttgcaattctaaatggcggaatacataaaacaggacgaaccacattcagaacccaagttttgtgtgtgtatttctacagttaggacccgatgactccatatgcaaaggtaaatcataataaagaaaaaggaacttataggacacatggtaatattcaaaagagatactggtggcatacataatattcacgaggccggcccttgaactcatcggtgaagaggtcaacaatggtcttcccagcccatctgtttttcacctgcaaaccaaatgaaaaaataaactactccctccgatcttgaaaacatgtcgtcttggaacattaatatctttttgcatatttaggttggatgcatgagaagcatatctatagaattgtttcaaaaaactactttcataaaattaaaatatcttcaggctacataaaccaatggtcaaaggtgtattttaaagaccatctccatgtccaaaatgacatgtttccaagactagagggtatggatttggttgaagtaaaactcgacaggatcgcttggagataatagaaacataacccaaattgccccataatgcagagtgacagcttttgtatattgcgcagtggtgtagaggaaagggagaacttggaggtgccaataagttacagcttgcaattaagtagtaatatatttgatggagcagataaaagattaagaaaaaatgttaggccaaaacccagtaacatctgattctatagattttcagtgcacaatatatttattctcgaaacaacaattttcagtagacattataactaataacaagcaggaatcacctgatccaagcaactaaaaaaacctatgttcccaacataaatatgtaataaaatgcaggcaaaaccgaggaggttggttacatgggagatgaactcgaagtagtagggcctcacgtagcgccgccctgcgaagcaaaatggggggggaataaccaaccgcgtcagtccggggcctccggggagggggtttggcgggcagaaagaaagatgcgcgcgttggggacgagacggaggccgggctgcgggttgctactaccgtcgcggaagatgtagtcctgccgctccggcgggttcgccggcgtctgccacacgatccccgccggccccgccgccatatatatatatcccgggcgagacacccctcgatcgggcttgtggcggcggaggagggggcggcggggcggctgctcagctcggcggttcagcgcccgaggagaggaaggaggatgggcggcggcggcggcggcggtgggcgaggagaggacggagtggttcggcggcgcgactggctcggcagtggaggattttagtgagggtgtgcttccgagggcgtatgaccgtaggatccacatctaacgttcgtgggctcctggcattgtcgtgctcgaatcgtttcggcccatttgcagcgttactcacctgcttatccgtatcacttatattggtaaatagtaaatcatttgtgagtgtaaataatgtaaaataaactatgatgaaaaataaatttaaaattaaattctaaaatttaaattttagctttataagtataagcataagtggcccttgaagtatttaaagaatttaagttcactgtaagagcatgcatagtgatttagacggtacccatctatataatcttatcattttcctggcaatatgtccgtatattacaacggacttgtacctatcttcgaagcttttactgtttttcccaaagaagagcgtgctacactcaagggagagagaacggatggacaactctcctttttaaatagtagagatgtgtagacggcacatagacaactttaaattaggttgtctatttagttagctatattagattgtacaatttcgctatgtaattttataccagctaattgaattggatttgttatacaactcctagtttatatttcaatatatgtaattatattgtatgtataatagatactaaaagtagggttgaatttaatatacaactctaactcttttcttcttcctcttatgtacagttgtatttcgtatataaattttgatatcaatctacactataatttagttccataacaatctaatggcttatattttttttagtaatgtaataatttttagcccttaaaaaacaaacatagtatcatctttatgattcaatacatctatactttttataaagttatagtccactaagtctaaagctcagcatgcaaccatgccacatcatcacccgctagcaataattacatatttaatctcatgcaagcataaaacatcatctacaatttatttaatgtacaaatcaacatgcaagcatgtccaatcatcacccctcgcatcatttgcacaatattttaacaactctatctattattcttataatatttaacatatacttatcaatatgtttcacattaaagcgcgggtatcatttgattggttcatgataaatagtgataaaccctgatgttcattattttttttctttttactcctagcttgattgtaaaaaaatatatattgagaattggttagtgcagggaatcacctagtttaataatatgacattatttaaaatgaactccatagaggacgccagatccagtaactcgaggaatgctcgatgacgccttgcttctgaattccaatccccctccctcttgctcgaacggcggcgagtggccagccagcctaaacacgtcaagatcctctgtagtattgcatgtgcactactacggaggtcccccaaactactcaatgtggtgatgaggctaccactattctctttttctttcttgtcttttagaaacaccctacaagtgtaatgcttgcaacatgcacacttgcccttataaacacacacatataccctacatctatgagcaccttcaaaagaccagaccgacatatcttaaaattaatgaagtcactacgagcgccatactatccacacatgtatgttgtctaccactgaaatactgtaataattagccgtaaatactagcatacatgccaagtctatgacttagcttgggtgggcaaattctaccacaaagaacctagcggctagttgcgctcacttcgattttttttttgtttttttgttactaggtcagatgcaacaaaatgattttataaagtgatatattagagctaaaggttagttccaattagtacataagttttattataatagaatattttgaaactacacagtatttctatatatgagatataaatgcaagcctcgccattgaaaaacgatcaaacaaacaaaatcccatctgtacagatgtttatatcaggccaccaaacaacattctgcattatccaagcttaactaaggctgagttcgtttggatgtttggaggtggcaaccttgtggcaggtaaacaagacaagtcattagtgtgtgtgtatatgattaattaagcattaattattataatataaaaaaatatgtttatttaatttttaagaagcaatttaggaaacatactaactgctatggctaagttcttatccctatttttctaactcacctccttctttttctgcgcatacgctttttaaactgctaaatgaggtgtgttttaaaattttctacatggaagatactttaaacaatcatattaatctattttttaaatttatttttattaatacttacttaattatgtgctaaaccctgcttcgttttacgtgctagggagtgagggttagtctacatgactaaacaggccctacatctcgtagcctaaatcgcttgtcaagcctttccttcaattgtggccgctaagcaaggcccgtgtacaccgcagaggcccagacctgcctaaataggcgggctctcctcgcctgcataattagctagcatcgatccacgcctctttgggctctctcgccgtgctgatacgatcgaccgacgacgcctcttgttgccacccacaagagccccggcccctggtagaggaccgaatcccggtgcgaagaatcgattgatgagatgcatggtcgacctagtagttctagtttgttctagctagggccctggaatctggatagctctgtgtctagggcctgtttgtttagttcacgaaatgataatttttaggtgtcacatcaaacgtttgatcggatgtcggaaggggtttttggacacgaatgaaaaaactaatttcataactcgcttgaaaaccacgaaatgaatcttttgagactaattaatccgtcattagcacatgtaggttactgtagcacttatggctaatcatagactaattaggctcaaaagattcgtctcgtgatttcttccctaactgtgcaattaattttttcttttaatctacatttaatgttttatgcatgtgtccaaatattcgatgtgatgtttttggggaaaaaattttaggaactaaagggggcctagtttgtagcagctacgttgtactacctctgttctaaaataagcgcactcgtgaatatccatatccaatgtttgaccgtccgttttatttgaaaaattataaaaattagtcacacataaaatactatttatgttttatcatctaataacaacaaaaaaatactaatcatatttttttttaaataagacggatggtcaaatgttacacataaacagcgtaaaactacacttcttttaggacggtgggagtacttggtactatttcatatgcttcggttctattgttgtggtgtcgcggatcgacagccctaacacgttggccaagacgtatagtacgtcccatttaatatttgtagttcttttatttcttttgatatatagtactttcttcactataaaaatgatttttagagatacccttttaatttctacagaccggctaaaataatatttatatgcaaaatgattttaggtgtctaataaagacccgtctacaaaatttgatttttatatgcgggcgtattaagtggtctacctacgaaaatagggttatttttacagacatatctcttaaaaaatctatatgcaaaaatatagcaccgaccagtcacacatcatctctctaaccttgtggagctacccggaagatcgctggacgtttctcaattactctcctacctctctgcgtcttctcacttctctctaagtcctttctactctcactctctctcttctccctcatctccactactctccttcgagcggcatggacaagaggcggtggtggaggcgacaacggcgagcttctaccgacgactgcttcgggtggtggagacggaggccccctacggcttcaggcgatggtaatagcagaatcaattaatggtagtgtccacatattgaagtggcggatctggcttcaaggagctccacgatggaggatccgtcgctaggaaacttggtgatgacgggtgcaacattgggagctctgtggtggcgggtacaacattgagagctcggcaacggcgggtgcagccgctcaggagatcgaagatgacaaatccgacactcgggagctcagcggtggctgatccaacaacgctggcctcgggagaagcaaatctgccaccagcctccaaagctggagggccttagcgacagcgatgacgatggtggatccgagctcggcgacaacagatccgacggcgccggtctcgataggggtagatttgcgaacgacgaccttgggagctgtggggcctcagcaccaatgacaatggcagcggactacgacagtggcaatgacggactgcagtgacgaggatgatggcagtggcggttgatcagagctagctagggttttaattttgggggttttttttgaattttttcgcagacagttggtttaactgatcacttgtgaaaatcaattttcgagcatactcattttcataagcaactaagcaagtgtgctgcccgattagaaaaatgcatactcatttttactacactatgggaaacgagtcacctaaggttggatatcgagctagctcggctcagggtagctcgttaggataacgagctgctcggctcgactcgctatcttaacgaggtaaaaacccagcttggctcggctcgttgattagctcgagctcgctcgtttacctcgtgagcttgtgactaaaaaacatatatacatgcaaattagtgaatcaataagagtataatacgagtataagacagtcaatcaacaagaaacaactgccaagttccatccattcatacattacttcaagtttcagcacaaatcagtaccacttccacaagcacaagtgctccaacctttggttagttcagaagttcagaaatatgcagtacaaacgatggacataccatcagtaaatcatcaaaaatacacatcagcaggggcaatgcttagctaaacacttgccaagtgcaaaaacacacgccattcttaagtaattaatcaggaaacaacaaaaattaacaagtttgatggctgaaaacaaaagatctgtctcacacttacacatgcaaaagcaatcaagcacaaaatagtccaacaagaagcaatcaagcatgaaaaaccagaaagattagtggcaactaatcagccatggcacaacgtgcaatagctgtagcagcgggccgccgcgtggagtagtcgaccagaagaggatgggagcgcaagatctgcttggagacaacaacagcggcgtgtcgaggtctcgcggaagctcggcatgcatgtggcggcgcagcttggaggctcgtggatgtcgcgcggaggaccgtggaaggcgcagccggcggctggctgcctcgccgtcgccgccccctggccgattggatctaggatgagaaaggggatcaggagagtgaaagactgagctaggttttcttctcttcttatatatgaacggttaattgggccgcctaagtgggctgtatttcggccatgggctgagggggatacatgtgaggaaatatgtctgcaaacttgctctagctcgttaagctcacgagcagttcgcgagccagctcgagctggcttgttatctctaacaagctgaaatgacagctcggctcgttaggaaaatcaaacgagccgagccgaaccgagcttgttacgagccgagcgagctaacgagccacgagctttatgtccatccctatagtcacctagccgtttgcggaaatggattttagctgtttacaaaaatcatttctgttgcagtgcttttagcttgtcatttacatcatagtctaataggaacatgt

SEQ ID NO: 60445 - DNA, 7946 bp, Oryza sativa
tcctgcagccctcaaataagtaaaacccgtgaaaaccatatctaaaagttttgtaaattcataaaaaaattactagaggtaggtataggcatgaaatacattcataccagatctcaagtccaaacttaacttcatttgagagaaaaaaaaagacaaatttcgtatgaatagtgttatgttattattcacctcaaatttgtttttttgtttttcccaaatgaagttgagtttggacttgagatttggtatgaatgtactttatgtgtatacctatctcttataattttttcatgaatttaaaaacttttagatatggtttcacgggctttcacttatttgatggttttcaccggatatgtccccatatatttatactatcatatcaactactgatataaacgtagtagaatattttctttcattggtactacaacttagaaaataactaccaaaactatttctaagaccataatactggtataatatatagtaatacaagtagagtacttattatatcttaaagaagtttaattttaaaaaataaaaatacagtgtctaactacctagctgttgtatgctcacgagtatatacatggatccatttagcagagctacagctcttaaaaataacttcaagagcatacttagagtagaatttgtgaagcgcgccaaacccttgcttcacctagctctctagtttattttactgagatcagtaaagcctgctccacttctctcctttatatggatttaaaattgtttggttatgccacggctctagaaaagatggatctgaacctagatccggccatattatataggagtacgtagctagtactagcgtatacgtccttgccgcttagctcaaagtcgtcgccctcctccctctatttattcgccccacccctcgctcgagctcgctcgcacctttgccaccccccaccctcgatccagagacgcacgagccaaccttgctctcaaccgttaatttcctctctccacgactcgacgccgcacgacaaaccagcggaggcgctcgcgcgctcgccttctcctcgccctccatttgaacaaccccttcaattaactcctcctcgatcgctagctctctctctctcgttgcctcctcgatctccttgaatcgatcagcggcaaccagcctgatcgttgtttgctagttagttaatttccgtcgccgatgccgacgacgcctcgtcgcaaggagccatgaaccgctgcaccgacgtcgagatcaggaacgcgctgcgcctcctcgcgcccaagcccaccgaggacatgtcccgcctccaccaggcctacgaccgcggctagcttagcgagtagctgctactagcgttcataatcattctgtgttccatcgctcgagttcttgaacacgaagaggagcttagtagtttgtgtcagctgttagtttaatttgtgcatagttcgctgcgcgcggcgacgacgacgatgaaggaaggaggaggaggaggaggggagaggaggaacatcctggccaagacgatcgacaggtgccggtcgtcgctggggcaccggacaacgaggcgccccgcctccgccgccggcggcggcggctacggcggcgcggccgtgccggcggggttcttcgcggtgctggtggggccggagaaggagcggttcgcggtgcgggcgcggtgcgccaaccacccgctgttccgggctctgctggaccaggcggagacggagtacgggttcgccgggtgcgagggccccctcgagctcccctgcgacgtcgacgccttcatggacgtcatgtgggagatggagcaggccgaccccgccgcgtccccgcgctgcggcgcgcgcttcggcggtcccgccgccgccggcagcggcaggggctacgggggccacggccaccaccaccaacaccaggggtaccagatgatgagcaccccggcgaggctcctcgtcgccggccgctcgtgatcgatgtctcggcatctctcgcgacgccggccatcgccggcgatctcgtcgtgcccgtccttagttaatcaatttgctgtctgcttgtaagtactatagtaggcacgtgttgggcgcatgcagagagaggtttgttcacctgcttgcttgctttgctatgctatgactgtgatagggtaggggtgttcaagttcaactgttcatgtcaacgtttgtttccatgtcgcgttcgatgtatctctgtaatcgtagttttgtatgtgtgagtgatctcatgcgtgttcaaccaacccctaagtcgataaaagatcgatgcatgtacatgcatggtgttttgttcagtgttaactgtgaatcactatgaataaaaagactatagtgaatctcagttctgaatttcaactagttttactctatcttttgtggtgatgtgcgcccttttgcatctgatttcaagcaagctgccaaaaaaaaaactatttagaagctagctcttcatttgatgaatgcgtgcatcggttttttcttcttggatctcaaggtcaaccgtttggtgagcctccccggagtctgaactcgacaactcagcctcgaccaggagagactacgcaaaatgaaaggcttttcttgagctagccgtctcctactctgcttcgagagccaatagcaaaaaaaataatactaccaatatgaacaagtcaatatcacacgaaagtctaatctaaagacaacttgatccgtataaaatctgaagaccagttgatcatcttctgcggttgagttgggcctcgtgcatgaggcacaggttattctgacctgccacttgctgcccttggagatgctctggatttctaaaacggtagcaggacacaatcattgccattatgatacaataaaaatgacctcagcgttctctgtcctctacagaaatgtcagagacatcaacaaatcgtcatcgcaaacaagaggacaagtttgacaatgctcacagaaatacttctagcagggatctagtataaatggattcgggaaataagacaaggaattacaatatggcttggggcaagttgcggctgaggtcagattgcatgccgacctgaagaaaatccaggcctagcctgccgggattacatttccctgtgtacagtaatgatagcccacccaaccaaacaaccatgacgtctggacgccacaactcgacaggtgttaacttcagaggcatataagatggctacacaattatatcggcatcaactttttttgatggcaatatatctgcatcaatcaaacaattaaaaaaaggaacacaaatccaacataaagatgaatcagctcacatttaaatatgtgaaacagacaaattctcgatatacaatcagggttgaaggctggcactaacgttacagctacatacaccttgagtaaccctcgataccacttctggcaggtcaagccccatccaaacaggatgggacaatctagttctactgaacagcatgaaagagccaaaataaaaaatacagtacaatatggaaaactgcaagtgtactgctatacacccatttctgtacaatgtttgctgcactggtctatgtaagctggtcaaaatcagagatcaactatattatgtcaagttaactaatgtagtgataaacatcatctgacctctagaatccattggacaacatcctgaagcagctcgaacttttgactgaccgcaacatttaggaaaacccgcatcttgctgaggaattgcgatgattcttccttgcaccggaatgcacctccacaggagcactgctcagataagtgtgccgctttcacttgcctgcagcggaggcagaccaaatcctgcaagtgatagagcctctctcgctgacggactacctgtagaagtgcattttccatctgttcacgatggtatggctgcccgcactgcggcacagcacacctccactcctgaccttggagtgttgaatcacggcagagatcaagatcccgacaatcattgcaatagctgcaaacacgatgttgttacgtaagaattagtaacatcaagggttgatgaaaactagtgcttattcaccagcccaatacttacaaacttgtgaattttacgaattggaataagccatggtaggcaggtagtacaaaatagtagctagtacatgattacatatagtcaaaagcatgccatattttggaaaaaataattttgacctagtttattttccttcttccaaaacattaccatgttttcaataatattgttatccataactttctttgactcttaaaaaaatggcaatcaataatgcttttacagcaaatggcatcacctacacctgacctaagtgaatcggtcacagttgtatccatagacgtatgtttacatcttaaaatgttgattatatggaaatcaaataaacagtttctacaatttatcttagaggtaatacctgcaaatcacattggggagagtgaatgaggcacatggatcttggaactgtgcttctggagcaaactcctttacacgaactaactttaacaagttcttcctcattctctgtcagatatttttcaagtcaggtcgtggcacagttttcttagaatttagatacttcaattttgtaataaaaactgtcaaaaatcaaggcaggaaactcctatgttttgaagagatagaaatatgggtgtgaaaagatatacatgcagttccacaaaaccacaacatatattttgaacagtggatcctcatttagcacatcagtgaaagaaaatattatatttttggatacaagttctacagtaaaagcagttaccatcagttcacaatggattaagaggcgaattaccagaatatcatgctgaacattctgatcaagagcaagaacagcacatatatgcttaatgaactctaatgcagcatctcccttatgtgtgtgaggatcaggttctctgtttgtaagttcaactgattcggacttgccttttcctttgaaatgatgaagtatatcacttacaatcctgagaagcttgtctgcaaagtaattacttatctgcaatatcagatatggaattcagattaaagttgtgtatgttagtcgcactagatgataatcccagtcccaatgttaatatatactccctccgtcccaaaacataacaacttttagccttcaggacttgtcccaaaatataacttcttcaccaacattctctccgcaaccaatcacaaccctccaccattcaattttgccacctacctccacttctcatccaatcacattgtgtgtttaatggcgcttccccatgcttggccgatgtcctccgagacatcgctaatgagggcgctctttggtgcctagcaggagctgctaggcttcgtgatctctttactaggacttggctgctattgcactagtttgtgtttttttttcctttgggtgtatggtattctgttgtatccttgatgggtgggtgtcagagtttttttctaaccccgtacccctttttttttctatcttaatgaagtgatacgcagatctcctgcatgttctaaaaaaaaccatgtccaaccctaaaaatccttatattctaggacggaggtagtatatactttgacattgagcaacatgcatttcaaatttgaactttttaacagactattaagattgaccttggatagtttcatcataacccatcatatatatttcttataacctttgactaacaaattgttataaaaactatctgaattacccacactagatactgcagtatttacattttattttttatacaactctaattgctatgattgaaaatatatttcaactgaaacagatcagatgtcaaaatctgaccaattttcaaataatctagatttttctcctttttttttccaattgacataacagtttctaacctctcagaattgaatgtggtagctcctaccaagtcattttcatttaactgggagatggttactggttaccaatttaagattgcactatagagccacaaaatcacctgatcacggagatatcctatgacttgaacctcaaggttttcagcagccatgattgttatagatggtgtgcatgaggtctcatcccttgtagttgatcgaagagctacttgttctttcatgtatttccatggaacatacaaaaactccgatacaattaagacaaagtgatcctgaaatttttggaaggaaatgttacagaaaagtagcaaatactctaattccaggatagtcgccaaagttgcagtcagcaagcagaagcaaacaagtgttagaatgacttaaaaaaactgacttgtgtagctttaggcaggtattctgctatgttccagcttgagacgatgtcgatatcgttatcaccatctgagctgccctcagatgttgcattttgcattttagcctgaataccaccatagttatactgaaccaaaacaaaatatggaaggtgaaaacatactctataagggcaaaatgaataaaacaattcatttgtggcagcaacgaaatgaacaaacctggtccatgaaaagtaaggagtgccaataatgcaaaggttccagctccacccactcaaaaatatccctaaaacaaataactttagtttcacctaagagataccccattcaaatttgcagggggaggtcaaacagtaccttgtctgcaatgttttcagtaagctatcacagtatgcacgtgctgacaacaggtcaacttttccagtatctattattatcttagaaaagttcgcaaagatgacattagctccaagctttcgaaactctgccaacatgagagcaaagaccttcttcatgacctgattaagtttgataatccaaaagagaagacatgataagaaaagttagacaagaaaactaataaaggtaagatgattatgaatagaaaaagatatttattgtaaccagaacgacaagaagattcgcaatatcaacaaaagaaaggacagtgcacttagttacatagcttacattatgaagaagatgatggagagctgggtcatgaagtttcgatcgtgggctgaaaaaacacacacatcaacatgctaagaacacataaagttaaaaaaaaaattcactccctctggtcatgaatacatttcatattcagtatcaacgcagtatccaaagtccaactttcataactaattgatattgtatacattcataaaacccaataaaatcataatatttttagagactaatctctagatatgatttttcgtgtttctagcttaaatatttaagatattgatactcaaagtttcaaaagtacagctgcatgtttgttcaaatggcatgcattttttactagagggaataataactggtccagtgcaaacacataaataattacctgcaaagccaacggtagagatgttgcaatattgcatcagcaaacacatttccagaagatactgcatctgaaatgcatcgctgaatgagttgcttcagcacttggaaagcaggtagacataaggtagcatcatcgaattcagtttcagtgccatttggaccagcaggcatgtcatttgcaaagctaccgatcggccctccttccatttcatctacttgactgctctttaggagagaattgacagccaaatgatggatctggggaagaaatatgtgcacatgtaattcaattgccagaagatacaaaataagcatgccatactttattgtatgttgaaaaggcttaccttaagctcaacagcaactcgtctatacgcaccaggataagtaagagcaggctggatgacctgtaaaattaagtcatatttagtaaagcagcacagaaacagtaaatgataagcaccatgcaaccttaggaaataaaggcttcttacttcatcagcaaagcaagtatctccttcatatgtgcctcctaaatcgggaataccatcgtcagatatccatagtaccta

SEQ ID NO: 60446 - DNA, 1672 bp, Oryza sativa
acctggtaaatgcaaaaaggaaacataaacattgacttccctccattagctgtttagtttacttagtgtaatctccattatattaacagtgacaatacaaagaaaaatagtcaccagtccatcatatcaatgtaacttaggatttataaggtaatgcgatgctcaaaaggctgattcacgctggcaaaatgtaagcttactatcatcagcctaaaaccgctacatattactatgacaaacttgaagtcaagtccaggattagtctagtagtctgtttgagagctaggagaggaacaaaatgctaaatgaactgaatctataagtccttcctccgtttcacattgtaagatgttttgggttttgaatagatatgcatagatcctatgttcatgtgtccaaatttacatggatgttagtgaatctagacaaggatgaagagaccaaaacatcttaaaatgtagaacggagtatcatttacaagcataaattagttggaatttgtgtacaacataaatttgtatacctttgacgctttttttgctcacgaacatatttccattttctcttcttagcatcaagccatccttgataatcagtacttctatcaacttgttcatcagcagcatcattttgaatatgtacggcaaggggttcatttgacctagttatagatttttgtttattcttgctatgctttgaaccagcttctgttgatggtgcgtcgtttggtttattttcttttccaaaaccattgggtacatgactttttctcataccaccatccagcgttaataaatcttccatatctcctgtcccatccaaattctgcacccccctgtccttctccaaaggattgaacatatcacgtagtttgcgctggcgaaatcgatcatctttctctctgacctttttgtgcaaccaatcaggatgaagaactcgaggaacaggattcgaaatctgtagcaacatgatttcacaaatgtcatggaaaatcaaaggggacaagtaaaaagtatataatataatcaaagtaacaagtaaaaaatatattgccttttgcattgctgcaggaatcgttataatcttctgaatagcagagcttaggcgttgcttatagtaagaccagtcaacaatagatcggatgctcgcttcagaggagattttacaccattttcttaaataaaactttgcaatttctgtaagatacaaggatagcaagagaatgtaagtgattgaaaagtttggctcttgcaaaaacatgatttgaaggtaaaataataccagcatccgtctcaaagatagctactggaatagcacgctcactcactggagtgccctacatgatttcagcaagtcaacaaagcagtaggaatattggaaaaaagcaagccaaatcatgaaaactagaataaacaaattccatgaaaacaaaataaagggaatatttgcccactgaaaggaacatgccgtgactatccaaaattgaaatatggtaccgtaactatcaaaatttaaaggaatgggtaagtgcatgatgttaattgttgaactattcagtacttacctgtggctcccgggcaactatgtattggcaatgcagccctttgtcttttaccattgaatccccgaggaattcagctagtctttttgctgttgttacgcacatgatttt

SEQ ID NO: 60447 - DNA, 872 bp, Oryza sativa
caccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtttttgggaagcgcttcgcgtgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcaatgatttatttatggaatagattaaatcattctatgtctataatctcaa

SEQ ID NO: 60448 - DNA, 5721 bp, Oryza sativa
  unsure (1)..(5721): unsure at all n locations
ttcctgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcatcatcggctgcaaaataatcagcaacgccgtcgtcgtcgttgaactccggtgacaaaccaataaaccattgtgtggagtatacgcgaacaggacattaggctcggtgttttcgaccaccctagcgccgcggatgggcggcggctgatcagcacgttgcagcctatgcagcagttcggcgtcggctggctgccggcagtggccgtacgtgacggccatcaatgtcaagcaaaacacagctcgctgttgctcggacatgacgatggactgatcactggccatccgtgagcaattccgtggccaatcatagcggcgtcctccgtctttctacttgatcaccaagcgcgtgggcgtgggcaggatgagacgatgagtcctccatagtagacatgaaacgatttatataggagggggtggcgaagtggagtaggattaatccgattccgattcaagatggatgttatcttggtgggtatcgccgtttgcaccttctggttgggatccccctcggattcgttccttctggcttctattctggccacttggcgctgcgtccctgctgctgatcactcttttagttcaactcgaaatgctgaccttcaattcagaagttctcggtactgtacaaccgtaggttggtctcacgattaatttcttacagtaatagttttgcaatactcatatgtcaaacaattatttattattgtcttattgtaaatacggttttcaaatatgaattatacactgcatatcccaaaacgtcctggatgttcaaccttaagtcaggctccaccaagaaacccagaacatcctccagatgcactaaacggaaccatgttttttctggacggaaaaaccatgtttcaacaagcacatactccttgctgggaatgtgaaacatagaaccatcggatatgaaaacccaaaaggaagtcaagactcattctgtggtttgaactctttggctttcagatacttcactactagccttgatagccccaacaaaactggacatcttgttcagggcactcaggtaagctcgcacactggaaacaacaatatccagtgcggcaccactcccactgagatcaataggcaaagaaattattagttcatgtgaaaaattaaattgataataacaattatagatgttggaaacaacatagaaggaaggtgcccagtgaaaaaaaaaaggtagtataaaggactataacctgaatgcccggctgaaggagtgaccagtcaaagcatgtttagagtcgctaacatctccagtgacaaccactctagtagttgcaattgcatcaatgccttctgtgaccgatgtcatgctatattctcgaagaacagttgggatctgtgaattgcaaattattcttagatgtttcaaaatttctccagttttactaaaatgaatgcagatagtttacaaatcaagaaagtagatgtaggtaatttctctgttaacatcaaaatagtgcattcattttgttgaaagcatgctcataagtcgtaacacatcacacgctaatccttattaagtatggaatctcctattcttgtgattcttgtatatttatcatggaggcaacatgctgaaagttatgttaccagatgcaggatgtttcattctcatatattgaaaaaacacatccatattccatcccattaaactggtatattagtgcaagaaccatcaagaatattgcaactgtcacctgtattatatcatcaacagccttgtaagctgcatcaactggacctgttccaactgcacatgcaatcttctcctctccatccggacctatcagtttgacagttgctgtagacagaccaagtgttccacaagttgcctgcaaaaaggcttcatatcaattttaacatatcaacttctccattagccaaatagtaaaatgtggcaaaattatacctgtacatcagcaagggaccaaaaaaccttgggctgaaatatctcatcagacaacagcgcctcaatgtcttcatcagttacacgctacaatgatttaaaacacataagctagaagttatcaaaatgcttactgttttacagaaaaaaaatggttgaatatgtcaatcgagcaacagagcactcaggaaactgtcacctttttcttctctgcaacctctttgtagcgtttaaagaaatcctcaaattccttgtcagtgatttcatatccaagctacgtgttggatgacaaggtagtgttcagcaacgataactgaaaagaaggcatttagtcctaactagaaaaataaagacaaatacaatacctccactagtttagatctcacagcatgccttccactgaaaaaaaaaagacaagaaagcataattatgaacttgagtttgataatctcaaatcagatttaagtaataattgcaagcctatcgtaagtatttgagcaggattgctgcatcaacctcacctaatatacaagagtaaagatgaaaaagaatatctctattctagagaagtacagaaaaacatatgataaatagataaaaaaaatgaccaggccaggtagaggtttcctcaatgtcaagtgagcaaggtttaacctaaaaaatttaaaaagaaaagcaaattcactaactttaagcaaaggatggcatcacacaatttctcaagtaaaaattgtactgtgacatgatctgcatacatatctctaggaatttagaccttacatggagtatccatatgatatggccattcgacataaagtgtttgatagttggaaagtgtattttgcaccaaattagcagaaagtgcataaagtagaaaaaatatctcctcgagaaacactcagggagaatgttgcaacttgcaagaaatcaaattatgggggaacatatgtatggatgatacctgagtttcccaagaacaataccaaactcgtttgcacgtgttagaccaatatcatcaggagaaattatttcataagttcctttgtatttaagcatcccatcctgaaaacagaataacaaaagtgaatatcaagatcacttcactctagaaccaacacagttaatatgagaatatgcaaggcaaggttcatataaaaccatgattgatctatcatatatcagaaaatgaattcctcggagctgagattaaaaaaaggtatccataaaaataatttgacttccctcagtatgtgatactataaaaatgtgagcaaaactttttcctagtgcaaatatgcaaactgagaactagaaacatttctgaaacttccaaattttagataggaaataaacagtaatgctaatcaattccttagtcctaaaatgtaaattgatggcaagaaacacttttagagttataaaatatagataaatgaaaaacagaaacaagaacctagatgtgacattgtggtaccaccttcagcactacggagaacccagtcaagaaatttgatggcaatattaggacaagaatgcaaatttagttacctgatgaattccactttcatgtgcaaaggcattggcaccgacaatagctttatgtggttgtacatgaagtccactgtgctcttgtacctagaataggcagagcatttgcagaagtgcatgaaattttcagtcacctgaaaaagacaaaagataaaaaaaaaagagcaagaaaacaaacataattgtaccattttgcttgacatagtgatatgttgggtattgattccagtatacagacctcctaagagctctcggcgacatttaattgccatcacaacctgaaaaagattttttttttaaaaaaaagttgcacatataggaaatcaatattacttgcattcattcttctacaaaccatttagatgaacatgtgcaaaataccaacaaacaacataaacatagtatacgagctcacctcttccaaagaagcatttccagccctttcaccaataccgttgatagtcacctctaattgccgtgctcctgcatgagcgccctaaaggttaagtcacattagtgacatgattaaaccaatgataatggatcaaagagacatggaaaaggtagtaccgctaatgtattggcggttgctagaccaaggtcattctggcaatgagtagaaataatagcattttcaattcctggagtgtttgcttttatatcagcaattagcttcccaaattcataaggaagagtgtatccaacagtgtctgggatattgagtgttgttgctccagcttttatgacttcctctagaatatgatatagaaactctctgtttgacctgcaagacagagtgaataatatcatgccacagtcttttgcgcataaaaaaggaggctaattgattgtgactaataaaccacagacaatagcttggcatgagctaatgtttagtcattcattttgcaccaacatgtttgaaagcaaagaatgtacagtaaatgatatgcaacaataagcttcgtgtgtagatttaaagatgaacacaaccacaaaatttcagtagctggcagacatctaccagcagtacaaggatgaaggtatccaagatacaatatacataatactttcctttacagaccaaagtatattcagtacttgatagtaagcaactaggcatacactgcacgcctcaaaatcaaccccacttcactaaagttggatggacctcttacatgcacagtacttaggcatatatattactaggtatggtgtcaattccaacccacatcataatgactgaaattgttggacatttcaacgctgactattttaaaagtagcctaatgatcgaacgaatttgcaattaaaagttggatagacctctttcattcacagtactttccaatatctagattattagctaattagtcagatgccagttccgaaccacattgtaattactactccaggtatgaaacttttggtcatttcaagggttacagtttaagggcccctttgaaacgcaggatagaaaaaacacaggaataggaaaaacacaggaattgaagtggtgtgttttcctaatcctacaggaatggaaaacacaggaaatatgaaaagggtccctttgatagcatcataggaaacaaacaaagaaaatgatagtttccaagaggttgaacctcttgcttattttcctatgaaattgagctataggaatgcaatcctaaggaaaatttcctatactttcctatgaatcaaagggtttcgtaggaaaaattccttgggaaattaaatcttccaaaattctgacaatcctccaattcaaaggggccaaaaatagtgcctaaaaatcaaacaaatttgcagttagaagtgatacatgccagcatcactgagtcaatgatgaatgtgttcaaagtagggggtacatgatgc

SEQ ID NO: 60449 - DNA, 23541 bp, Oryza sativa
  unsure (1)..(23541): unsure at all n locations
atgccagttccaaccaacattgtaattctactccaggtatgaaacttttggtcattttaaggcttacaatttcaaaaattggacctaaaggttgaacaaatttacaattagaagtgatacctgccagcgtcttcagggctgaactcgacatcagggcagcctaggctgcgggcgtaggccaccatttccttggcaatggccaccacctgctcgggcgtcttccttagcttgtgctgcatatggatctcgctggtggcaatgaaggtgtggatgcgcggccgccgcgcgtgccgcacggcctcccaggcagcatcaatgtctcgcttattgcatctcgagaggccacagatgaccggcacgtggccgtcctccccgacgggcgtgttcccgacctcgatggcgatggagcgcacggcgtcgaggtcgtcgggggaggaggccgggaacccggcctcgatgatgtcgacgccgaggcgggcgagctggcgcgcgacgacgagcttctcggcgctggtcatggtggccccgggggactgctccccgtcgcggagggtggtgtcgaagatgcggacgtagttggggtcgtcgatgcggttggggacgtactccgggcgccgcggctgcgccatggacgcccggacggggcgggcgaaggcgcggtggtagcagcggcgggaggcgctagggtttgcggcggcggcggcggtggcgaggccatgggagaagcgtggggcggcggcgcggaagggggagagagtttgggcgcgtgggcgtggagtggaggtggggtttgcggaggagaaggaggagggttttggggaggagaggagggaggaggccatggtggtcgccggggtttgtggcgtcgacgactcgggggtttaggggaatcgaatcaaatggtgggagagggagatgcacttgctctgcttctcggtgatgtgtgtgtgagtcagagggggagctcttatctggacatgacaacgggggtttcgtgggatgcacgaatgctgtgatggcggcgtggtttttgcggcgaagaagacaagtcggacttgcacacaaggctcgggggagaaatggagcatgcgagagtggtgatgctggtgacttggggagtgaccacatgacatgagcaattggcaagcttgtgtaaaacaaccaaaccaaccaacttctttttgaagctctgaagtctgaagatggatgacaggagtagcctagcttgccaaggtaaggttgtttgtcacatacgcatatcaaaggcagaatttgggagaaaggatgttgttcacagcacagtagtgtgaggcttttgctgtgtttcttttggttcacattgtgatcttatacaatacaaataaacaaatccacttttgatcgctcaaatatggccttttaatctgattttggctttatcttttgttcgacggttttaagacttgagggccaaaggtaaatttttttcttaaaatcagtcaggctcgagttcttcacaaaataattacacgcaatggaaattgtgcttatgctaagtttaagtagcataaaaaattcaaaaggaaatcaacacaatctacgtcataattcatattttgattagttaaagaaaaaaagagcaatcaaaactttacgatacaaaccagactcaatatcttatcgaataggtgaaaaaaaaactcataaacaacctaacattactgcacaatacatagctttctaattagaaatatagagttgttcaggtggttttttattcataccattgtaatcttaagtctcgttgctggtaatgatgatagacattagctttttcaataaaaattggcaaccattattttgaacactcactaaatgctagatctattattttgttacatatgcttcatatcataacaccacgcttgtatactattatcttcactacctttataacttatgcattctctctctatgtattaaactatatacgataaagcccaagaaaaggtgacaaaacagatcctatccagaggttcccatccttttcttcaacttcgctaatagacttgaacaacttcctgacatcaccatgaacactcattgcttctatggtcttcccatcctcactcaacctcaaagctatcacttgacgaccaaatcctgtcaagaacgatgtgatgcgttgaatgcgttgagctggtagcttaaagattagtttccttagccaaggataagaaattgaccactcagcgatcttccctctcttggcatgaagaccaacccaaaaccctcctctaggactcatcttaatgttgtctggaaacccaggtagttgcgcaacttcttcaatagttgatgcttttggtgttttaatccaatatcttaggatcttacccgttgtggtttccgcaagtagcaaataagaaccatcgatgctcatagccaaaccattaggaaaacgtaggccatcaactaagacttcaaccttgttttcttttggatcgtatttcaacaatcttccagtgttgtcacccgttataactatgtttagaaactccctacaaataatttgaatgaaaaattatatatatatatatatatatattacatgaattgtcattaaaaaataacaaactgatgagtgataataataaatntatnntatttattggtccagtaccttctctgaaaccttgtactggtctcggtgaagtagattactccagtttcatggtcaatctcaacgccgttggagaagctgaatgggcttcctgtcctcttaggaacaagcggcctagacacgttctcacccggactgaccactctcagcccaaggtacgcatctgcgacgtacagctcactcagtcttgctattgaacttgaagcccagtggacgcccacacttctgctcccgtttcgtgtccttggatcctctgcgatctatccaaccttgcacagttcaggtcaacgaccaatcaatcgataaatgccgttccaacaattcaggacggaatctgccatactataaatattatttggaccatagcataaatgatagtcaaaaaggagtagtgaaaatgaaatgaactgaacaataacattgttgatgatatgaactctgaagttgaattataccaagaacttttcagttgttttctatatgtacagatgtaactcacagcctcacaggccatattaagctcacaattaatcatcaattaattggggatttggacagtgcaactgtatttgtccggtccctggacctggatcgtaaactaaccaaccaactactactaaccaaatcatgagaacaacagagaactatactaggcagctagcaacacgggtgaatactgaatagtttccaaaagtggaaaaagacttacagctccggcacggagcaggagtgctcgacccaccggcgctccggcggcggcagccacttgaggatcctcccgtcagacacgctcgtgtacggcccatcgccggcgtcgccgaacactatgctctccggccccgcggcgccgtcgagcagagggatcagctcgacgtcgccgtcccttatctccagctgcctcacgtcgctccgcgagtccagcgacaagatcgccgccgccgcgaagacggcgagcgccaagagcttggccgtggtgttcatcgtagctaagtaagctaggcttttggtgagctacccacaaatgggagtgttcccccactaggcagagtatgggttggttttatgctacctgcaaaccgatcctaacttcctaggtgttgatttattgatcatggtaggatagtaaatgcattgccatctccatatctacaaccattaaaattttaatggtgaaagagaaagaaagatccaagaccagtgtacggtccaatagttgccactgtgtccatgctgacaggcgtgttcctgtctcacggttgcaactcgcaactactacctgaaatacgagtatgtttcacatttttttagagtttcttattactcattctctgcaattttacatgaagagcagcaggctaatcttaggtacaacatcaactattcctgaaagatgcttctctattcagcgttaaatagtgatgactactactactttgtaatgtacgtcgattgaataagacgttcttttaagagaacagatagtgtatgaaaagtggacatctatctctgaactttgaaaaaagaagatcgacattgtgtattttaagttcggtgccccataaccatcccatgatcccatcgtgtacaaacgacaaccgttgttgacctaaaacaacattttttttcagaagaaactaaaaaatgcataaaaaaggaaccaatctcaacataggctgtgtttagttcacacaaaaattggaagtttggttgaaattggaacgatgtaacggaaattggaagtttatgtgtgtagaaaagttttgatgtgatggaaaagtttgaagtttggaaaaaaaaactttggtactaaacacggcgataacttatttgaacttaccctacctagttcagatttcagaacgttagtcttacagaatgatgcgccaatatgttggcatggtcccaaaagagcttccaattatatccattaaaagtaaacagcataaggtagatgagaccataagtgagttttcagtagattggcaaagcaaatgtaagactaccatgtgcccatgaagataacatgtcgttagagttgcagtacatgtatgatgtatcaagatactttgcgcttggttggttagctaatcaagctgccataggtgtgttggaaaaggaaagaaagctacaggcgacggccggtgaccgtccatgaagacagagaagatggatagtgtagtatttgggtggatgcgggttgagcatcgtggtattgttttcagtgaatatgattattactatgagatttcagctaccagcatcgtgcaatcttatcgaagaagaatcatatgcaatggaagtgtgccgaaagccattgcaaatcaatgatgcggcagctctgctacataaattgatttactttctgtaggacaggggaataatagacttaagtacacatgccaagaattatcattgctgagaggagttgcaactgtacttagatctgagtagcatcacacgcaagtaaatgcatgcagaacgagggaacagtactatgggatgaatcgcaggatcaaccagcattcattcaacagaaacagatagagattaaagcttacagttgtggctcgatgacggcggacgagtgttcgacccagcggcgctccaggggaagccacttgagcaccctcccgtccgacacgcccgtgtacgggccctcgccgtcgccgtcgaacgccacgctctccggcccgaccgcgccgccggcgtccacggtgatcagctcgacgtcgcgctcccgtatctccagcactggcacgtcgtcgctccgggggtccagggacaccaacaacgccgccgccgccgccacggcggccgcgagcaccacgagactggctttcatcggaaccagaagtccagaacctatgtgaataactgcgattaatgaaattgcaacgcgtgaacggctccggatttgtttatgtagagtagagatatggttgattgccttgtcacatttgctccttgacatgatactccaccaaaacgtataccatgttgtctgaagagagggacatcctagtacgaagctcaaaggaccgtgttcggtacgtgtatgactctgtctgccagttgggatttgaaacggccggtgaggcggtgaccaacaccgctgagagcaagtttaatagtatagcccactacaagcttcaatttatctatatccgatttaatagccaattcatacaatagttgcttactatactgctccctctgttttttaatagatgacgccgttgattttttctcaaatgtttgaccattcgtcttatttaaaaattttatgcaaatgtataagatataaatcacacttaaagtactatgagtgataaaacaattcataacaaaataaattataattacgtaaatttttgaataagacgaatggtcaaacatgtgataaaaagtcaacggcgtcatctattaaaaaacggaggtagtattataatatatggccccacctgtcatacacatattgtgtcttagagtccgtgctacagctggctataaatttgtagcccactcctctttttttttatcttttatcttattaaaatatatttataactggtagtctagtattgtacctgctcttagcgcctcggctcaatctggttgcggcgcgcacgctattttgtccccgaaaagcggtctaaaaccgcacgaaatcctggtgtttgcgcgagttccaggttggtgggtagcggtcggacacgggctgatccagcaaggacgggagcactcgttccgcatacggggcctgcggttttctgcgtgtgggctgggctggagcccgcggttgcagcggccgttagctttcccctcttctgggcctcgcaccactggagcgcgtgcgctgcgaagcctggaaccaggccgtccgttcgatctggctacctgcaaagcccaatacttaggcagagtggtgttggctcgaccaggcgcttctttcgagtgagacaggaacaaagcaacacgtttcgtgcgagggagacacggggttttcaggctagaaatccagtcgctgaaaaccagcaccaaagtccaaaggctatttgtgtcatgcatgccgggggttagctactcggctcatgctcagctagctgaacaaacatcccaaggccttgtttgcagcttgtttgctgaagaaagcctagaagaaaaggtagtaggagtacatcgatcatcagtgcagtcgatcgagagactctgaccacgcaccggtgcaaatgtgagaggtgcgacacaaaaaggaaaggaggcagctagctgcaaacgcaaagcaatcaagtgcagagaaaaagtcatgggcctcctgtcttgacgtgacacctcctcctcctgagtccagactcctctgtcctgggcggcttctgcctctgctgtgcgtgccatcagcaaggcctgcctgcagctatctgcggccgctgcagcatattattggttcgttaatcttacagcaatgcgagtttagcagcttttcagtagcccggccatcaacgcatgcgttttctcgtcagtcaagagtgaacgaagagtgggtttccatgcgacaccctaccctagcgctggatcctaaaacaatactttatccctttaattgacctatataaacactggagtgctactgtttaattactgcttgagttgagtacttggggattttcttttcatgtgaaatggcaaaattagagcatgtacaatagcagactattagtcagctacaaatatattttaataagataaaaaatgagagagaaaaatagcgggctacagatatgtagccagctgtagcacggacttaagacacaatgtgtgtatgacaggtgagaccgtatattaatagtatagtaagcaactattgtatgaattgactattaaattggctataaatgaatttgagctagtagtggactgtactattaaacttgctcttatacattaggtcaaggggatgttggaattaatgaatgggccttagcccactcgaagattaattctttgaaaaatcacaaaagcccacctcatgagatggcatgcatgtggagtttagtaccaccttgcttattctaggagagggggacctccttaaaatggaggatgccctcctagtcgcttgaagcatgtgtggtggagagaagaggggaaacacacgcgcgcgctcgctcgccgggccgggccgggggcgcgcgtgcacgacgtacgcgtcgaatggtccgaaaaattggctcctcacccttgcgcagatgcagcttctttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatacaaaaaaatcaatctagggtttgcttcctactctatactgcgccgtcgctcgtagactactccatcccgctcgccggcgtgcaccggcgatcgggagagcaggtctccggaacctctgccttcgacgttctgcaccgggagaaggctgcaaatgtaaggtttttgggaagcgcttcgcgtgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaagaagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactataaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaatgggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggtaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcaacatgtcccttctatcgacaggaatcttgttagtggctcccgtctgactagagacggatttaagttggtttttgagtctaataaagtagtcgtgtctaaacatggatattttattggtaaaggttatgagtacggaggcctgttccgcttttccctttctgatttctgcaataagtctgtgaaccatatttgtggtactgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttaaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggtgaaagtcaatgtaccaataacgaagaagcgcaaacttggacctaagactgtggactgtgtttttctgggatatgctcatcatagcattgcctacagatttttaatagttaaatccgaggtaccggacatgcatgttggtacaattatggagtctcgtgatgctaccttctttgagagctttttcccaatgaaggatacaaatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaatggaggatgccctcctagtcgcttgaagcatgtgtggtggagagaagaggggaaacacacgcgcgcgctcgctcgcctcgcctggccgggccgggccgggccgggccgggccgggcagggggcgcgcgtgcacgacgtacgcgtcgaatggtccgaaaaattggctcctcacccttgcgcagatgcagcttctttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgtgggcgccctgatcaagcgacccttctctatataaaccgacctgccgtcttcacgcaacatacaaaaaaatcaatctagggtttgcttcctactctgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaggggaagtatgaaatatagtacaccgtctatttctttatcaatagctgaatacccgtattttgctatgggtaaaataaaattttcatgaagtgtgctttgctatgaaaaatatattgatcttgttttaattttatatgtagctatctatttagatttgattttttatattaagaagtttaaggcttgatttgcaaaatttataattagaggtggctgagttcactgccaccatcagtaatatgattgacaataaaccgacggtaatatgctggtagggattgcacaattgttctagtgcttgtcataatgaaatgaaatacgccttgtctttttcaaaagagggagtatatttctgatgagacatgcatgaaaggtctgttttataaagtttgcatacgctaaattaatagtatggtctaaacctccaatttttagttagtatgggctaaattaatacatcaataatttttaattagtgcaaacatgattaataatatatatactactagctcacataaacagtaactcacaagtacatcttgcccttttgcatctgcatgctggaactcaattgggttttcatgggatactaccctggacatttatcagatggtgcaggatcagagacatggttttcgaaattcctgttttatggaaatctttctggtagcctgctggttgatctggaaacaaagaaatgatctcatttttaacaacatcagtgtttccatttctcgctggaaggggaacttgaggaaagagttaagcctacatttaactaggtttaaagtagctaacagatcttcttttcaatcatggattgatgctttgtaattcttcttcttctgtacagattcttttttttcctctatataaatgaaaattaaccgtgggggcttcccccactgtttcccggtcaaaaaaaaaaattagctcaattttttttttgctagatccattgagcttgtactagtagtatattctagcagagaatgtgcatgatgccaaacggagaattcgatagatcgcagtgatatgatatgacgcactgcagcgtgcttggtggtccttctttgtgtgtgttctcccattggcatggaaatatgtatacacacttggcgatatgatatgcacgcacgcatgtttattgttcttttccctttcctgttctctcgatcttctctaatagctaggcgccaccatcaggcacagtcagctcaggtcaaaagctttaaaacactactaccaaatgatcagctggagatagagctagcactattccagcatggcacaaagtgttgagctatattattccttttcctgcttgaacaaaaaaaaagggcatctattcatgccatgcctccctgtttcccaaactctctgaacatgagtaataaaagagatggatcagcattagatgtactgttcatcaccatctttgggtctatttgggagagcttccagccgctgcaacttctccgagaatcagaagctcccccaatcagtacagctttgggtccagattctgagaagctgtaattgtagaattcataaaatgaactagaagctaaaagctgggaaacccagcttttccagattctcataggctgactacgaaccagctgcttcttagaatcttaacctctcgcaaacatacccttttatctcattcgttctccaagataaaatatatatggagctcatcgtcagacaggccggatggagctaagcttaggtaacaccattcaattgatgggacgttggatcactgtaaagattctcagcatggaaacagcatgtactactactataagcaaacaggcaaccaaaagaaagaagaggaagaagaacagtgccacatgtttgcgtgcacggacaattagctggaaacaaaaggaattatcggggctcgatctgacgctaattaaatccccagctcttgctaatcgatgaacaaaacatgaactcgatcgccgtattgcagcagttgatagacgatcaatagatccaggcagtggtaccaaaagtctagcagaaaacaggtgaagcgagcgagagagagtacgacaaagaaaggatcgatatcgatggagataattggattcgtcacgacataattaagattcatggatcatggccacactagctaatcaatttgacaaatcaagaactgtatatacagcatgaaatgaaggcgctgtagggccggccatgagagcgaacagctaagctcagctagctctcatccatggtgtcattggcgtttgtgtgtgtatgcgatgaaggaaagagagattaataatcaattaatattggcaatatgatgagaggggagcatgcataagaggacaggggcaggcaaacagtggaaatccaagccgggaacagttgggggaggaacccaccatgggagacaacgcttttattgcgagatgtttttaacagttgcagtgactgatgagagcatggtaccgtgggcctctcctctacagtattctatacagcgaagacgagcgagaagtacgtaccagccggtacgtacgtatacgtagctaatagccattgttaactgttacctatagcagtagctgtaatgcatgtcatgtctatgatctccactgctgctggtcatatgcatatggatggacagtaattaattaaccgcgcgcgcagttttactggtgttgagtcacagatactcactctgctatctaatacaagagattttaacattttatttacacgatttgaccaatcattttattcaaaaaaattagtgcaaatataaaaaataaaaagttgtgcttaaagtattttgataataaagtaagtcaaaataataataataatttcaattttgttaataagacgaatgataaaaaatacaaataaaatatcaaaatcccttacattatggaccgaagggagtaaaaattaaagacatcatgcatgcatgtcgatctctcttcaaggaatctactgcgcagttgtcctcatgcacacatatctgcaggaacaattgaagggatcgatataattggagagaaaaaggcaaggggtagctggatatattcatccatatgctcaatcgtcatgcacgtatatatactccctctcatttttaatgtataatgccgttcggcttttaagatacatttgaacatttatcttattaaaaaattatataatttatttattttattgtgacttgatttatcataaaacattctttaagcatgatttaaatatttttatttttttataaaaattttgaataaaacgaatagccaaactttgataaaaagttaacatcgcactgacatgagcaatgtacaaagtgaattgtgtgcagtacgatactgcatgcatataaagtgtagtttatctttatttatatattgagtacaactaacattgggatgtagacttgcagtagaataaatctctgtactagatttttttttgattttttctaaaaaaatttcaaggataaactccctgaatttgaacttttctgccatattattttaattagtgtgacagaacaacgacactatcatgctgataaaaaaaaatcaaggcgtgttactctatactagccacaccattgttcatggtgtcatggtgtggtagagtatgggggtgtttggatcagggtgtaaagttttggcgtgtcacattggatattatatagggtgtcgcatggggtgtttgggcacgtcattagcaaatgtttacggtagcaccatattgtcaaatcatggagcaatctatctggagtatctattatatactaaaagtctattaaacttcctacaaacgctcttaaaccgccacgtgggactcctaaaaacgctcctaaatcgccacatggcattctaatatattagaaatatctagcctttaattttcacttaaataggtgggtccattattttagaccattagattagcttagattaaaaaaagtcaattagtcctcccctcatctcacgagcgcatatgtacgccccaatggcacgcatgtaacatacgtgaaagtgtgccccacctttttttttactcccccccaaacttttacaatatatttatatcacctcatttttatgccattggtatttttgagcgtatatttgctgaaaccacaaaatatttcagcaggttgttacatagacagtcccaaaataaatcattcgatcctcgattttcatgttaaatcagatggacaagttattttatacattagattagatctataaaaaaaataccatccaaaccaaaaagaatatcctatgtattatatagcactattcacgtgaaaaaagccaaaaagaatcttcctgtgtacgtatacttactccattatattattcaccgaataaaaatatttttattatatgagatataaattggtgagtccattattttagatttagattaaattaaaagaagagttagtccctccctctcatctcacccgcgtgtacgtacacctgcttcatcccgtttgtacccaggtaaggtatgtgccctcatttctttccctccccccatttaccccttttttaccctacaacctctacttttttagatgttttaaatagtgggctaagccataaatagtgggctaagccatttagcggttagttctcaaacagatatagcggcagctatagcgggctaaatagagctatagtggctaaattgtacatgagagcaaatagctaaacccttttcaaacaactatagcgggagatttaaaaccctacttttttatgctattgacattgtttgagtgagtgtatatttgatcattcatcttcgtattaaaattatgtaattataataggagattctagaaattccgaccttcgatttttatttaaattggtgaaccagttattttatagcattagatcacatctattaaaaatatttcatatgtacatatgttgtacatatgaatacatagtactgacaagaaaaaaagccaaaaagaatatcttgtgtatatatgttaccctccttaaaaaaaattgcatggatttcaaagaaaatgaatggcctatattagagggcacctaacccctaaacttcctacaaactctctcaagccgacacgtgggactcctaagagcatgtacaatgtaaatgctctaaaaacgctcctaagttgtcacatggcgttataataaattagaaaagtttattgattttccattaaatcggtgaacacattaattttaaccattagatctctctaaaattcaaaattccggtagccagcacgtactccctcctagccaccctccaactcttcccttctctcttatttttagctaactttttctattatttagctaacatagatctatcttaagattttgaaattacgctcatctggaaaaaagaatcacgtgtagaaaaagtcctctatctctccatggacgtgcacgtacatatgtacctaccctctttgttttctttcctctttttttcccttcaggttagatgagatagaaaatcaaaattcgtattaaatatattttaagttgtaaaaatacactctaataaattagaaaaacatctagaaaatgtgagaaaaaaaacctaaaatatctagccatcaatttttatttaaattgatggatctgttatctccgaccattagattaaatcctattaataatctctctcctaatctccctcagcgcactgacgagagaaatgtacgtacgtacgacttgtaaaaaagccgaaaatacatatacaattgtaacatacatttaaaaatataaagtggaaaaacataaaaatataattatgtcattaaaaacgtgcatttgcttccttcttcttccttctcttctacatgtatagacgaaattgtaattattaggagtggtaataaatttgaagaaattataacttcataaacatagattatatatatcatctatatatgtctaaattagctccacaaatttttgaaaataaattttataaaactatattattttaccctttatattaacaatataatatattttttacttaaaccgatgtatctattatatcaaatcattattttatatcaaaattttaaaaacatgttgttcaatataaatgttacgcaataatattctctaccagtaaattgccaatttatgatctatattaactaatattttacattaattactgagcccactattttatattatttttaataaaaatattttgacatcggttttcagttaaactgatggacctattaactagacctattaaggacctattaacaaccattccatatctatcttttataaaagtaaaatgaaacttctaaagacctcgcacatgtgcatgtttgctttctgcacgtatgacgaagcatcgtacctaaggcagctaaggtgatccgataaacactattcataccaattaaatttatataatttttctcttatttcaaacaaatatttttccaaagaaaacaaacaaacatgagaaaaagaaataaaaagaaaagcttcaaacaattgctgatattttgcactatccaaccaagcaattctgcaaatgatttgtgtcctaacaaaaattctttaaaactttagaaaagaatatgaaaattttgaacttctacgaagggaaaaacaatctaaccgttaatctatccttaatttggttgtcactaaatcacgcatcttcatgagacgattcgatcacaataactttgagtccttgctatcgcaatttttacttgtagcaatattgtatggtatgtgttcaaatagtatacatgatatttacttttcgcaaacgcgtatacatgatatttacttttcgcaaacgcatatacatgatatttactcactcagtcaaaagtaaattcaaatgtcatatgatcttgatctatcttctaagtcaatgaatatggttttcagatatatccaacctatgatttgcccttataagatataatttctaaagaaattataatattacgttatgatagtacggatgcccgcgcatcgcgtgggccaccttcctagttatatactaaaagtccgtccatgaaacttcctacaaacgctctcaagccgccacgtggcctcctaaaagcgctcctaaactgccatgtggcattctaattaaccggtggacccactattttagatttttatatattagatttacacttatatggtggacccggcattatatgtcattagatctatttttcaaaaaaaagaaaatcacatcctcaccgataccacttatgtacgtgtccgtgtacgtgatcttcttccatgtacgctctcccctctgttccttttctctcctattttcgtgctattttagtttgatggaaatcacaaatatttataatattttttagaaaataaaactaattcactgtcctatacacttacgtagaaacgtacgtatgccctcctcccccatgttctaaggccggtgtgcaccctccttctttttgatattatttaaattcaaattagaccaaatatttttaaccattaaattattagttttcaccattagatcttatctttgagaaaagaaatatattgatggaccctgagttccactcgacactcaagactgttgttggcccgatctttcggtgagttgagataactacgatttgggagaaatgttgacgacccgactacaaccgtacgagacgttgtattgcgccttagcgatcgatacagctctccgtgagttgttgatcttgccggtgcagatcaaccctattcctgcaagcaaatcgaagaaacaagtaagaacaagataaaagcaatctgatattgcaaataagaatttaatacaaatgataagttggggttccgaagaacaagcagacggacggtctagccgacacgcgcgctgcaagcaagtagcaatggctaaactttaatctatcaaaaacccaagaaactgtaaaggggtacctaactatttaaggaggtgggaggacgacctaaggggatcctagggtcgtgctccacctggttggggcacaccccacatgggccccacttgggccggggtcccagacgaagttacaagcccatagtcccattataggtgacgcaacaccttgttgcttcaattgcggctcaataagatggaatttcgcaatgaggctggatccattggaaagaggactccaagagcttttcatcaagtactcacggtccgaaaacggaggtcgtatgcagattcggcggccgtttgaagtcagcagtgtagtaggtggccgaatcggattccagcacttggaggacttgatcttgatatcttcttgttcatccatgatgtgagcaatggttgcatccgtggtagccatggtcacatcatcctccccttcttcacggaaaaccgtcctcggtttttccatatggtgctctttgcgtagtccatttacaataacctgtttcttctagtcaaaacaaggcaaactcgagacaatttggttagcaataacatttcactctagcttgcatgttttatccacatgtataggaggttctaaatctgaacatatgtaaactctatgcaccaaatatattcctctatcatcagattcgccaaatatatgaaaaatagcactagttggacaaggcaaatcagacttagcaaataatttcttcttcaaattatcgagctcacaaaaatcatcaaactgaacatagcccaaagtatttaaagaagatagcaattcacgttcctgtacttcattagcaatgtgaacaacatgcttaaaattggcacacaaagaaacactagaaatagcatgttcattcaccagttgtggcatagatataaatgaagcattatcacacaactcttctttatcacaaggaacagcaagtaaatcaacttgtgacaaaggcatctcagcaattggttccactaatggttgctcttctctagcatgaaaagttgacatgttcaattcattaacagcacactcaccttgattaattgcagcaccattaagattacctgtggttctctgttcggatgatgtagctgcatcagtcttctcttcttccttcgtgagtgatggagatggcacctcgatcctattgctcttctcctcgtgaatgttctgagctccctgcaaaatgtcagtaataggaggcacaagcatagcttgtttctcccttgggttctttaaaatattgctctcaacactgcaagcaagcatgaacaagtggcctatatgattatatgtcacattaataagcccagcctgaacatcggaattaagccctctaaaaaatctagtcattgtgttctcattgctttcttttaaaccactataagtgatactaattttaaagttgtgaaagtactcccgcacggttttgtcaccttgttttaaatgttgtaatttctcaaggagagtacgtttataatataaaaacacaaaacttttcctcat

SEQ ID NO: 60450 - DNA, 14924 bp, Oryza sativa
  unsure (1)..(14924): unsure at all n locations
attgtcttgggtatccctgccattgtttagtagaaaacaagaaacatgcacaaaaatatgtacgctcctatcaactactaggtagtggtagctcgaatatcacacacactcaagcttttaaccaagctcttacaagttcttaccaaagcaagcggaatggtgacatacaccgactcaatcaagcatcccaatggaggttggatgtatcgatgccttggcaaacacctgttgtacggctgcaatcaaatctgtggagctctgggtaggcttaaatatgtagcaaaggaatagcaaatgctcaaatcagagaatgcaaagttgaataattgttcaaagtcaagcaccgtgctggtcctaggctagaacgtacttgagacgcgagcctagacacaaacggtaccacaaaatagcaccagaaacaactcaagcacactctgatgtatgaaagcaaactcaaagatacaactaatttttccttttgcttctttctttccttttctttcttttctattttcttttctttttcttttctcttttttttggtgcggcttttcttctctttgtttttttatgcacctttctgcctttttttctttcttttttttgattattttttttaccaaaaacagactcaaggacctcaatgtaagatcacagggactcaaatgtaaatatgaaaattacagggactcaactgtaaagtccaaactcaaaattaaaattatacaaaaatggaatgtactcgtcccgaaggttccgtttttgcaaacggatctccaatccgacacttcaaaaattctcacctagctatgtgggaagacacggtatggatctaaaccgagagaagagagacaaggagtcgactccaccgaagtgggatggtaatatgggaatcacgtgggggtggggacttggaggaaacagactcggctatagatggaagcaaaccaaccgagaaggaaacaaaccaaccgactgatctaatatgcaaaacttcctccaaaaaccgatctgttatcctttctttctccttcctcgcgcgtttcttcctcctcgcgcgcaatagaaaaaataacacgggacagtgcgcaaccactcaactggaacccagatacagctccacaacttcaaaaactaaccgacagaaacttatgaaaactacaaaaatagaaccgtggcagcgagccgattccgttttcgtaggtcccgacgataacagagacacggaggcgacgacgactctggtataaaacgtgaccagaactcgaaactctaaacgaactagatgctaagaccagcaacacgacgagacgatgcaacacaaaattcaacaaagcaaaaactgtaaagaacaatgcaatggcacaatatggctaggtaaatgatacgaatttttttgtatggctattttctggttataggaagataaaaaaaaactcaccgagcaacgaaagctctgataccacctgatggaccctgagttccactcgacactcaaggctgttgttggcccgatctttcggtgagttgagataactacgatttgggagaaatgttgacgacccgactacaaccgtacgagacgttgtgttgcgccttagcgatcgatacagctctccgtgagttgttgatcttgccggtgcagatcaaccctattcctgcaagcaaatcgaagaaacaagtaagaacaagataaaagcaatctgatattgcaaataggaatttaatacaaatgataagttggggttccgaagaacaagcagacggacggtctagccgacacgcgcgctgcaagcaagtagcaatggctaaactttaatctatcaaaaacccaagaaactgtaaaggggtacctaactatttaaggaggtgggaggacgacctaaggggatcctagggtcgtgctccacctggttggggcgcaccccacatgggccccacttgggccagggtcccagacgaagttacaagcccataggcccattataggtgacgcaacaccttgttgcttcaattgcggctcaataagatggaatttcgaatgaggctggatccattggaaagaggactccaagagctttccatcaagtactcacggtccgaaaacggaggtcgtatgcagattcggcggccgtttgaagtcagcagtgtagtaggtggccgaatcggattccagtacttgtaagacttgatcttgatatcttcttgttcatccatgatgtgagcaatggttgcatccgtggtagccatggtcacatcatatatatgtttcctttccctgtgcatgagaaaagaaatatgtatgtttccctctccctgtgcatgtatataagtttcagaaagaaaaaaaaatcatcccatccatctgaagagggatcccatctcccttctgtctctcctatttctcttcttctttttagctatcaaccaaatatataaaaaataataattatatagataaataatcataactcctgagtatatatatatatatatatatatatccaatttttaatttgtttaaactaatatttatttaaatgttatcatatgtttctgtaaaaaaatataatacgccacctagatatggcgaacccaagaaaagaattatcagggaatcactttcatatatacctttctttcagtggtgaatgtagcaaaaaattatcagggtactacacatataaattatgtaattgttgattgatatatactccctccgtcccataatataagtgattttgactttttgtgaccactcgtcttattcaaaaaaattgtgcaaatataaaaaacgaaaagttgtgtttaaagtactttggataataaagtaagtcacaaataaaataaataataattctaattttttttgaataagacgaatggtcaaacagtgtaagcaaaatatcaaaattccttatattatgggacggagggagtattgattaatatgacatgaatatagctagaatcgaattcgaataatctacccaggaaggtgaatgtagttaggccatgtatcttttgcatatcaatcaaacaacaataagatattataaaaatgtacatatattttgttatcttaaaccatttaacaaacatacaccggaataaattttcatataaaagaataatttatctagcgggcacaatgaaacaataaatataaaataaatatgtattatgtgatcttaagttattccacaaaactgcatagctatattagatcgacggtgttaaaataaaaattataaatgcaaccatgaaaataaatttatgcataaatttaatttatgtagggaccacactcctacactttgaatgtcatccaaattgtcatacaaaattgtaaaataatttaacaacatatattgcatgatcatacattactttgcaagcatggatagaaaaattagatatataatatgtaagtgaaaagaacaaatttaactatgaataacataacaattataaaaaaaagattttacctttagttggatgcaacaatagctaattaattatgtcttttgaaatatgctcaactgacgagataaattaaataggttgatttgtacataagcgttctaaaatatagtatacattatcatttaatggacttagaggtaaaagaaacaaatgaatattactatgacttccatatcttgtagatacaaagataaatttgtctattttatatgcgtagaccattaaaaatgtgaatactcctgtatatgaatattaataggctacgagcatgttcattgttcgtacgcatgcataactaactttaaaatccatttatatttctcttatgcaagctcccctcctcctgtatagaaaatatattttgtgataatataaatcatatagctaatattttacgtacatcattagattatttactacaaaatttataattcaagacccaaaccattggatctatctcaaaggaaacaaaactcctcccctcctcatgctgtacgtacatgtgcatgtctcccggaagaaaaatcaggatttatctactctatctttattgatccatatgtaaaaatatataacaaattaattacgttaatatgaaccaattaaaaggagggctagcttgatggtacattattaacaataatattttttgagatttattaaaaaaatccccaaaacattcaattaaaaagaaaaaaaaacacattacttttaatttgaacttaatttgttacacatgatttctaaacgaaccaagtctacctccattttaaatggtgaaaaagaaaataataattacggatgcattaaatatttcatagtataaacatatttctgaagtttggcaagtatggttaatattcatccctggtaagtttctcaaatatagcctatggtatacatgcccgcgcggatacgcgggctaccatcctagttaggcttaaaagatttgtctcacaaattagtcgcaatctatgcaattagttatttttttagcctatatttaatccttcatgcaagtgttcaaatgttcgatatgacagggtgtaaaatttttgtgtgagaactaaacaaggcttaccataccactacatcaaatggcgtggtcaaaaagtttatttacataatagcctagatggtttattttttaagtagtttttagatcgataaaagttcaaacaataaataattcatgaaatttctgcttttcagagggattggtatcccatctatcgtatctgatcatggaaagatatatatacatgatcctctaaaagtctcaatgcataaatgaagagaaggccagagaagcttgatttttttcaagttaagtttatatatatgagaataaaaactagagaaggaatatttttgtgaagaaaattacagataaaagctaggtttgtgcatgtgattggtacacatgtactgtttgatgacataattgtatgagtagtacttactgtgtgtacagggtacatgtcatctcagcagaattaggcagcgagcattcaaatacgacacgattgagacagaaaagttgcaacagcaaaatgaaaataggaatatgcctttacactattcatgaaaattcaaataaagttgtgaattttataatttccgatagtggaagctatatgtattacttaaataatttgacgattactgatgttgtgtatagttttattattttttacgctatcaataggggagcaaaatagatgagttaaggaatattttgattgtacgcaattattttgacttttttgttttgaaaaacagaaagagaaataaatttaggaataacgtgggtgtaccaaaatgaaccaagtgaaacaccagtccctatcattttaatatttcattcgctatatgcgtctagatcataataagatgaaatatcctatttttcttgtcaaggtggcaattaatggaggtggtggtggtagccggttggccaacttgggatcaacgatggcaaccgtggacgtacaatggttagattgtagggaagacggtgggttgttagcggtgtcggtggtgattgaggtgaattgattccacctaattaccatatccaatttactttttgtttgctaggcgggtatagcaaggagcaacatcaacatgacaaaggaaggctagctggcattgttggcgatggattgatagggggtgcgacgctggatctaggacccaaatgctgttcagtctggggtgtctatgcttgtatctatttgtgtagcggcaaatgtgggttacgttggaggggttcttctcttcgaaggcactagatgctgggagtcgctaaatttggatcgattggatccatccagtgatagggatatggtgcaaaggagctggtcaaaggtggatgtaaaacaaataagggtgtaagagttcagactgcacataagatcgactcagtgtggtttttggtgtggcaggcttgttagggagaagaaaactgaagcttagtcttctagtatttttgttttattttcttgtttctcaattatgagacctaaaatataagtatttttataacctttggctatttatattcgcttgtggatagataggccaaatttccttcttacgcctcaattttcaccttttggaatgtgcatccttaattataagagaaaatatgattatacaatgtactcccaatgtgttgcacaaattattttttgaggatatatatgtcgtacttaattactaaagttaaataaaaaaatgcacgctttatgaatcaacagtaggaacctaattcggtttgagaaaatatgtgccgtgctgtaaactgaattataaaaacatgctaagttcaaaattaatatattcctttaataattggtggctaacttgggtcgtataaatagagtgagttccctaatagaattagttcacttaatgtaccttttttttatattcatttcttcagatgggaaaagccatctgaaatgtataccaccacatgcatatatacaaatgtaatgaatgtatcggtacatttttggtttactacggatgatctgtaaagagagaaataaataaaactagtaatgcaaataatatccttgccacgcctaattatagaaaattaattaaaatggtactaattttattattaataatatatatattttggatactagtatatgaaggtatacatttagctaaccctagagtctcatcaaacaatgggcccatgcactaatcagtgaccggtccctacatggatatataggagtatatatatgaggccacggtcgtcaaattttcttttttgaggactactctaaaggtttaattaatcaagaaataatattaataatgacacaatgaattagcaggagctaggatatcgtctttatacatctattaacttaataaagtaatagaaaaaggagctatcatgttcgctctcaagatctaaaaattaccacgttaatcgaagaaaataagaaaacgttcgctctcaaggtatagaaattaccacgttaatcgaagaaaataagaaaaataaaaaaggcaagcggagaaggatatgttaatcggatgaaaatatgaaaagaaatagtaaagcaatcggacacggattcatggaaactgtcaaagtgtcaaacatcaatcagaaacaaacttattgtggaaatggaaatacaactatacaagtgtaaaaacagactctggtcacaatgcattagtatcgtttagagtccaaaagtaaaaaaaaacaaaactatttaaaatatctgaaattcaaaatataactaactattgcaagaagaaactatgcataaatacaatttagactaatctgaaattacatttttttagaaaatctaatattgagaccatagttgtatagaatttacttaaaaaagagtcaatataaaaatataatttaaaaatatctaaaatccctaattaaaaaaagaaatattcgaagagaagactagactccatacatgtatgcaatgtagaactaattaaaatttggaactaaagttagagtccataaagaaataaaatttaaaaataactaatattcgaaattaaaaaatattgaaaaaatagtttagagtcattatagaaatacaatttacaaacaacagaaattcagaactaataaaaatatatattggaagaggagtctagagatcaaataggaataaaatttaaaaataattgaaattcagaattaaaaataagaaatacttattgaaagaaaggtttagagcccatatggaaataaaatttataaataacagaacattgaattagaaaagaaataaatattagaagatgagtctagagtccatatagaaatccaatttagaaatatcaaaaatttaaaatttaaaaatagttaataactatcacgtatatacaatacaatatgaatattacatattggttggtgcggttaagttagtacaaaatttaaaactatgttgctattttaatatattttaattatattatgtgaaaatatatatgctactatgtgaaaaaaaaaatataacgttactagccacgtatgtaatttgcgcgagccaccatactagttttaataaaaatgaaaaacacacacatatatacacatgctttgactaacagagtctgtcgatcatatagatatgcaaaagttcatggtgttctaacaggaggtttgtaatttgtcgcctcatgttagacaaaaatcacgtactgccggtactaattgtacaagatcagtacaggatcgagagcatgcatgccatcaaaaagccattcttaaagagacacagagaaaaacgaccttaccagtagatattacttcatccatgcaaaaggatcgatctgggccgtccaatcctccaggatatatactgtggcgaatttttatatatatatatatatatatcccagagaaaatgtcgtcacacaggagaaatgcatgtgcaaacccagtgtcattcaattgcttgcacacttagattcgccttgtcgaacgccactcgatccccattccttcacatgatcttgcaccccgctttcctatcgtccaaagcctactacagttatcaaaagctgcactgcataaagacattgtaaaaacaccaacagctaaaatcctcttcttcaggccatcaacactagtagctgcagctggatcgagcatgctcatctcctggtggatcgatcacattggagactacagctccaatattacaagatgaacattgcttgatggtttgaaactttttgaacaaattagctagcatgcaacagtttgctgcgcgcgcaagcgaatcaatcatgcgaaagatcgaacaatccacatcaaataccactaaattgttgcccattatcctagctatatagtagctagctacaccatttgctgctcatcttgtcaaccatgcataaccccacaaatctcaacacggctagtagaagagaaggatagggaataatattacttatgcgaagccattggggaagtacatggcgggcggcgggctccctcggccgttattgcttttcctcccctcgccggcggccacggccgccgccatttcctggccctggtacatgagcgtcgagttcatcgtcaggctcaccaagctgtcgtcggcgtcgctcctcgggaagttgccgccgtcgcttccgccggcctcggcgccgccggtgacaggcgcgccgtcgtcacgcgtggtcaccatcaccgccgactgcacgagctcgaggcagagcctgagcttgttgggctcgatgtgcgtcagccccggcacggcgcccttgaagaggaactcggaggtgaggctgcggagcacgtcgagcggcgtgacgccgtcgagcgtcctggagttcgggtcggcgtggtggtcgagcagcacggacaccatgtccggggagaccatctccgccgccaggtgcagggcggttttgcctgtcgggccggcgcgggagttgacgtcggcggcgccgagctcgagcagcgccttgacgacgtcgcggttgcagtgctgcacggcgtagtggacggcgagcgcgtcgtcgaggtccaggccctcgcccatgaccatcagtttgacgagctcgatgtcggcggcgtcgagggcgcgccgcatgcgccggatcttgttgtcgcggtccgccgcggaggacgccgggttcatggggaggtagtggtgcgtcaggaacggcgagcgcggcgcggccaccgcggcgagcggcgacttggcgcggatctcctcgatcttggcgaccacatcgatggggaggtgcttggcgaggagatcggcggagaggccggagcgcgcgacgaggtgggagcaagtcgcccacagctcctgcatctcgaacttgcgcgacgccatcagcaccttcatcacgtcgtccaccgacgcctccttcaccatgctctccagctgcttctgcattaacacattgcattgtgcaactcgccattagttcaattaagatgcttaattaatcaccctcaaatgcacgacagctaattagcagcatgaaatgttgttcttagcatgtagtagtagtactttcttcagttctgttcagagagatatgcaaaaatgtatgatgagcttaactgtactttgcttagaacacagcatgcatgctgtacactaagaattatttttggaaatgatgctagttaggatcgaagtggccaccccgggttggatctccaagaaaccctagcaatggaaatgccgaaatgatgcgaattaagaaatcaggaaagcaagcatggggatggatgtgatgtaaggaagggacagacacaacaagagcttgaaaagacccttcctagtaaagatgagttagaagctccatgacaagtgatgacagaagcagcaagggcgaagcagcagaaaagcaatcgagactagagacgactcagtcctattagtacactataccccatctatctcactcccgaaaaaaaaaagaacacaagaaaaaatgttaaaaaattgcgatgaatgaagtgagggcatgcactagattctgctgcagctactgcgcatggatcagatgccacagttgagagcagtagtgcatgaatcgtgcagctcagctcgctcagtaatcggaaaaaaaggcaaagggggcatgcaacctagggatctaggcaagcatgcagcaggatcagctcagacttgaacattgcttctgctgactccttaatgtcaccaaaaagatgctccaatcatgccagcctaactaccatcatgtactcttaatcaatacccagtgttagcagcagatcccaagatcgaattgcaagcacatggaagaggaatttcaaattatttgcagctgcaggatgcatgacgcgtatatactacgtcgtgttcctgaattttccgcgcagtacctgaaccagcagggcgagctgctcgacgccgaaggagcgcgcagcggcgagcgtgtcgagggcgaggtcgacggcggcgccgcaccgcgtgtgccagcaaccccgggcgccgcaccccgggagcggcccgctcttgggcgccgccaccgacgcctgcccgctgtacaggaactgcagcacgagcacgagcacctcgtaccggatcgagctgacggggatgacaagctccagcgtggcatgcgctcctccaccaccaccggggccgncacgcccttcaccaccagagccgccgccgcctcccccggccatcggccagtttaacggcggcggtggcggcggcggctggtgattcggatcgagcccgcagaacaacttcctgaagaacaagctccgcgccgccagcacgcagcggtgggcgtgcacgaggcggccctcgacgctgaaggcgacgtcgctgaaggcctggccattgatgagcaggctgaggtagtcaagcgacaaggatttgagcgagtcctcggagctcatgatctcatgtgcagcttatcaccaccagataaaagcgccggattggccccaacttttcaggcgcaggaaggtgaggaggagggatttggatagagattttgaggaagcaaaccaagcaagagaggtggaggggaaagggagggagcaacacaaggtagaagcaactgttgcaagaggaaaaagaaaaggttagggtgaaggagaggtgtgtgtgaggagagaaatggaggagaggggagcatgcggatgctatcaatcccctttgtgctacagctacagtgagcaatggtaccgtacccgtcgtctcttttgtggcaagcttgtgggtggggacgcatacagctgatggccatactgttctggctacagtatcaatggtccatggatgatcgatgcattgttgcagctcactgtgcgttttgatcgtcactgacagaaagggcactgctcttggtagaccccatctgccaatgacactataggcactagtaactggtttgcactttgtatatactgtgcgcaactttcatgaacattagattttttatgtggtaaaaaagcgaggaagtgaatgggcagagcttgtgattggttagtttttaggttcgtagagattcagacgttaaatgattccgacctacttatttatactccctttatttgttaatactcctatatgatactatattatatactgatttaaacaatacatttgatgatttatctcatttaataattacgtaaatatgaaaaatataaaacatgtttaaagtacttcaatgataaaataaattataagaaaataaacgataagtgcaacttataaataatacaaatgatcaaacgcaaggtcatatattaaaaaaatgaatggagtatttttttaaaaaaaatatttaaattcggtgacatcccagctaatgtatgcatatgtatgtgtgtatgtgtggcagatatgcacgcatgtcacacagtgtttcatcccgagccactgtatttgcgtgtggatattagcctttttcccgatggctagttgattatgccagcagggtttagttcgacttcagtcaattcatgaagcgcaaaatacatctcaattaactgattttctgtcgctcttcacataaattattgggtattgacctcgcaccaattcaccatattgccgacctgtttagaaagcgctatttttagagttgcgtatagaccgtatttgattgtgaggttagttgttatattgtagattattctaattttatgataactttaatattaaaagttagaaatggatttatttgatttttaaagaaacttttatatagataccagtatttttttaaaaaaagtacaccgtttagcggtatgagagatgtgtccgtgataatctagtagccagtagttgaatcaaacaagaccttcaagctgatatattacatatggctgaaattaattttaaggtaagacttttagggtccaaaagttaaggctaaaaatagaaatccacaaagaaaaccctaaataaattctaaatttaaattctaatgtttaaatttggttgcagccatctcaaagcatcttccccattaatccgaccactgcacactttcatttcatcagatatcattgcccattgccgtgcctcgaaaaccttcaaatttaaagcacaatttaggttagtatatatacattctaggtatgactactagtagcaattttaattgcaaagtttgaaactccgagctgtaaggtttagtatgtactagttccaattgtaattaatctgtcatattatttaagtctagttgaaatttatctggtgagaaatgcgcgcgcacacacatggattatccaaaccaaaagaaaacataaatgattaacatcgccattttttgttctctggaataatgtcgtgtgccattttcctttattccatcaaaatgttactatcatcaatttattgcacgaataaatatgacgcgcagattttattgaacactgttcgtttatattaggtactcgtacttgtcacctttgattaatactgcacaaatcacaaacatataataggattatgttttataaacccaaaaagttattatatcatgttaatattttttacaacaaatttatccctatgaattgtcattttcatgtatccaattgcaacttaatatttaaaaacatattcttaattaactaatatatctttctttaatatacaacgttgataactttttgagatacttttggccatttatcttattcaaaaaatatatgtaaatatcatttattttgttaggacttgatttatcatcaaaagttctttgagcatggcttatattttttatgtttgcacaattttttttaataaaacgaatgatcaaacttatgtctaaaagttaacagcatcacatattaaaaaccggagagagtataaaccgtgttgaaacgcatgtgcatttggaaatgaagggagagttctgttttaaacattaatttattcagaaaaataattattattcgtggtttgcagatcgatcgtgtcgctccaactatatataattaaatgtgggaacaatcatgtttggaagattaattgatagtgtatggtttcgccagcatatttatttgacttcctatataggaaaacaggacaacatattgaagcaatcatctactctctctctctctctcctcgttcttttcctcttttctgctttataatcctgccatctctagctttgagcaaacagtcaccggtaaagaaaccatcttcgatcggtcagccaagatccacaatagtctcgattgcaataaaaacctttagtcccggttcaaaaggttagagctacttttttatctttagtcccggttggtgttctcaaccggaactaaagatatatttttaaaaaagatccctatctatttctagtctcggttggtagcctaaactggaacaaaatatcggcatgcgcgcatgcgtggcggagaggacaaggcgtgcgtgagattgaggaattaataaattctattctttatctcttcctcctcccatctcttcctcttcctcctctccccattctattcctcccctctcttccgtcagcagtcgggcggaggcggaggcggcctcgcgccgcggcggcggggccctcgtgcggcggggcggaggcggcctcgcgccgcagcagccgggcgaaggcggatcaggaggggaggcggccggctgccgccggatctgaagggggaggcggccgggcggcggcccgagcggagggctgcgcccggcggcggtcggtgcagcggcaggcggtggaggccggcgttgccgtggatttttttttctttttttcctttaatgtgcgattcaatctgtgtgttgattgatacgttctgtgttgaatgtgtgatttgatctgtgttattgttgtgaatgatttggggatgaactattgctgtgaattaatgatttggatgaactatgttgctgtgtgttgtgactgtttgatct

SEQ ID NO: 60451 - DNA, 37195 bp, Oryza sativa
ggttggaaaaccaggactataggtgggttcccacccgggagtaaaactcgtttatccaccagtgagtggaagcctctgatatatatacttgcattgcatatagtagcggattctcactttctcagttgatcttcattcggtgcacgctgacagaatattttacatgcacgtacacggctgtcttaattagcacactactacagaacatcatgtcgccactatagtgtcgccagtataggttccggtaatgctaaaacctgtatttatagacctttttccatcttcgtgggttgaaatcgtaaaaaactgacactttaagtaattataggtgacacaaaatataatagacgtcggtttttatttagaacagacacctttaatatattataggtgccggttaattaaaaccgacatctataatatattataggtgcactacaagaaaatgctttgtagagacatttttctagtactatagagacacttttcaaatgcttttacaatactatagaggcgttttaaaaaatgtctaataaatgtcttatggtgaattgtctctacaaatgaagaggtattttataaaatgtctataaagtggtagaggcattttctagagacattaaattataccacaaccatatgaaaccaatgtaaaaatgagaataaaatattttcccttgtttttgccaatccttgaactcatgatctcttgaacaaatcattcttatcttcaagacactaaccaactcaacccatgtcattcattgtatatgtttatgccttaagttacttatatttagccatttagtatacttttattgtaagaagtgtctctacagagtttaaagtgtctcaagcaaatgtctttacatgttagacacattttaaagtgctgaaagaatgcctctacaagataaaatctaataaaatgtgctgaaaatatttctaaagtgtctctagagtaaaattttctagacaattttgaaagtgcctctataaagtgtctctacgctataaaactcctgatcttagaggcaacttgcaaaatgcctctacaaaagtgtctttatataatgtttttgttgtagtggtgcccgtatcttttaaaaaaaccgacgcctattgaaatcgagtcgagccggcatcggatgagccgaccggcgggccccaccaagacgaggcgaggaggagataaggttcgatcgtcgtctcactctcttctctctctccctcccttctctctcgtctcactctcttctctctcgtctcgctctcttctctctctccctcccgtctctcccgcgcactccgacggttggccggcggaggcggcagtggtgaccgcgccctcccctccgccagatccgggcatccggtgggaggggaggcggcggcagggagctagaggggagcccgtggctgcagctgcccggcggccggacgggaggcggcggcgacaccctcccctccaccagatccggccggaggggaggcagtggtgcctccgctccaccagatccggccgggaggggagtcaacgacgacaggaggggtggcagcagcaagtggcgtggctcacgggcggtggcggcgacgacctcccctctgccagatctggcgggaggggaggtaatggcggcggcggagccctcccctctgccaaatccggcgaggagtaggtagcggcaacgacggcggtgggctccccacgggcgacagtggtgggctcccttgtctctcctgccaccagtgagcacccccaaccgtctccttcgcttgccggctgtgccattgttgatgtttgattcgatgatttaatgatgtttgatgtttgattcagtgatgtaaacttgttgatgaatatttgattgtgtgatgcatgaatttgttgattatgtgatatgtcctttttctagatttttgatttattctgtgagatgaatattgccaaattttgtgattgtgtgatgtgttcgttctgttcttgcggatgtgggaggagggactgcgatcgagccagctttttttttattcgtcgaaaaaaaggtgccggttctaaggaatcggcaccttttttatttttaaatcagtgccgcctcccttatgccggttggaaaaaccggcactgaaggggtttcccaaccggcacttaatccttttctgtagtagtggcacccaagcctggaaaagatcgacgaattcgatctgtgcgtgatcgattgccaacgttttctgaagatcgatctttcatttcaattcgcatatcgttaggtcccgtattttgattaattgctactactagctgctgctatacaagctactagcaagcttgtccggtcgtcagtgcaaaagtatatacgtccatgcaaagcatcccggcatgcagctgctcagctcctccatgcctccatgctcgctatctctctgcaatctgcagctatgagaattatttatttttatatatcgatctgaacctgaagatagctaacagcatgtatgctggtaatactttgaccacagttgaagtgtacagaagaccaacagccttttattagtggtggttcaattcaattacttcagcatcttatttgccagagagaccagcaacagtggttgatgtcaactgtacagtagcacacatgtgcagacaacacaataaaatgtacagtataatacactgcgaaagtatagactatatggatgtatggtcatggataagtagctgctactgcaattctacaacaccactcgctggccggccatgcttcaacatttattaattatatgtcgttagccgcttttgtatgtattaataatccttgttaattactagttgttagtgtaactatagctgccatgaattactggatagtgaaagtaacatctcatttagctgaacgcacaaagttagctagtgaaagtactacttcaattcagtactgctgttgttcatcagaataatgctattgctagctagctcggtccattgttcatgcatattatttgcaacaacctacctatcaaatcggccaatatgaaacagtagagatctctgtagtaatgtatcggagagcagacaaaaattaagcatgttttgaagtgccgaggcctaatgaagcaatgatcagtcaccagtaatgcatctgcagaaagatatacaatcataatatcatgcatgctagggtagatgctgcagagcagacaaggttgtattcgtgatgggccggaacacaaagaattcttgggccaggccgaccgtccgtttgggtttgggttaggttgtctcaggctctcagccagtaccagcagcgttcagtattggactatgtcttaaatatatagttacatttttttagataatgacatactagtatatagttagataaatcttcaaaacatatcattcgatccttagtccaaggagattggccacaaagtaatctgttctgtttcttcctagtagatgagctagacatgtaccaagaagacagagatacccaagtccattggaaacagagtaacaaacaagtatattccaacaagaaatgcttcagtgcaaacaaatgatgaacttacaaggctacaacttggctaatgtacatccaaaatcctgaaacccaggtcataatttataagcaacaaactaatacctttttcttgttctcttcgaatcatccaatgacaagaaatgaggcaagcatacacgcacgcatttttttttctcctataaattcaacagctgccacaacattgaaaccctgctcctactgagaccacctgatccaactatactagctgctggtaagtggtaagtgatctctcattaattacttggcatttttatcagaggaattagttagcgttttttagcaatgttttctggtacggacgcatcgtcgccggagctgtcgctctgctcgccatatgggccgtggacgcaaggccgtagcccaaccgaggagctgggcctagctctgttggagtgtgcggcccacgtagagactgggcccatggagaaggccacgcgttgcctcgcgcgcgccacgggcctcgccgccgccgccgccgccggcgacgggccgcggaagcgcctcgccgtggcaatggtggactgcctcgcgcggcgcctcctccgccccgtccaggccatcaccgacgcgctcatcgacccctccgtctacctcgaccggcgttccgtcagggcggcgcgccgcgggttctttgaactcagtcccttccccaaggtggcgttcgtcgtcggcaaccgcgccatcgtcgaggcggtggagaacgagagcttagtccatgtcgtcggcatgtccggtccatttacccagccatgccagtggatccagctcctgcacgagcttcgccgtcgcccggaaggcccgccacgtgtcgttcggctcaccgtcgtccacgacgacggggagttgcttgccaagatggaagagttggtctccgacgaagccgaagagctcggcatggagttccagttccatggcgtcgtcggccagctcgaggatctggacttcagtaaccttcgcaatgtccttgagataaaatccggcgaggcgctcgtcgtcagctgcactctgcaactgcatcgtcttcttgctgctgatgacgatgcgatgtatagctctcgctctgcccatctcaaccaaatggcgagcatcgcgcagctccagcacatggcggtgaattcgtgcccgtcgagtagcggcggcggaagcgtgcagtacaaagacgatgacccttaccgaagcccggccacaccgctgacgttcgtctcgccaccggtgtcaacccctcacttccagacgccggcggcgctggcgagcttcctgtcggcggtgcgcgcgctgtccccgaagatcctggtggtggcggagcaggacgcggaccacaacggcgtctccttccggaagcgcttctgcgaggcgctccaccactacgccgccgtgttcgacagcctcgacgccgcggccgccaccacctcggcggcgtcgcgcctgtggtctcccgacgaacgcgcgcaggtggagcgcgtcgtggtgggcgaggagatcaagggcgtcctactccgggatggcgcgcaccggcgggaatggcacgaccggctgcggcaatgggcggcgcgcatggagatggccgggttcaccggcgtgccgctcagctacgccgccatcaagaaggggaacgacatggtgaggcgatgcggattgagacgctgcgagaacaaggaatgcggcggctgcctcctgctgtgctggagctcgaggcctctctactcgatctcggcatggcggccggcggcgagcagaggatctgggtcaggttcagagagaagcgagtacgtacatgtcggtgccgagccagatgatcgatgactccggtataggggtgggcattcggtcttgatcttcggtgtttcagtcatttcggtctttgaaaagtgtagatcgaattttaacgtaaaaatgtcaggaccgacaaattcggtcttggttttttcggtctcggtcttgatcttggccgaaattcaataatatttttataaactcaaagaaataatgaaaattttcaacacaaaaatcacaaaaaatttttgtaaacacgtataagtaaagactattattagattgcgtgcctagaagtaggatgttgaaattagagtttaatcttattgaaattagtggattgtgtgttgcatttagacattttttttaatttggtctattcggttaaccgagaagactaatcgaattgaccgaataaaattcggtctttcactgcctagtaccgtattgttgacggaatttctcattatcggtctcggtctttcggttcggtttttttctgcccacccctactccggtacatagctttgatgaccaaccagacgaaagagcatgcatttgtaatttagttttcaatttgtaacttatttctttttttttcatttttttgcgagattaattaatctgtataagaggcagagagttcttgagttgcaattatgtggagaggagagattcgagagaatggttagctatgaaaaatctaaaattatgatcaaactcattttttttctgagattagagtgtggccattttgatttgtttgaaattctagttagttttgggccgaatctaacaaggaaaaagtgtaccgaaggtccctcaacttgttagcggtataaaaaacatcctcaaaccacaaaccacatatgaagggtcccttaactatacaaaaccggtcaccagaggtcctttggtggtttgaccggtcatccgacgtccttcggtggttttgacaccggttttggtctacgtggcggctgagtcagtgtgggacccatgtggaccccacatgtcagcgtgccacgtcatcaccctgtatttcccctttcttttttctcttctccgcgggggtagaacggaacatgcggcggcaagcggtgctgagcagcggccggcgaagcggagaggagcggaggcgcggagcgccggtggcggcaggcgggtgagcacggtggccagcgtcctcctcctccatcgccgcatcgacggtgtgtgccctgcttctcccggtggtcgtcggcgtcctcctcggctcctcctcctccgccgccgcatccgcggcgtcaccggcaccggcatcctctggccggcggagcccgccgctccgttcaactcgcacgcgatgctcagctcctccacgagctactccgccgtttgcccatgagcgccacgatgctttccgccgccggctgcgcgcggtcgacgagcacggagaggagcagcgaaaggttctgcttcagcgtgcggagcgccgggcggatgcgggcgtcggcatggacagctcgaggagctgctcgtccattgcgccgtcggggaagctctcgtcctccacgccgccgcactcactcggctcaccattgtagtcgtagcaaaacaaatctgtttcagacaaaagcaaactccaaatctttgatcgaacaatgatcttagccacaattcagtgtgatcttgatctgaatcttgattgttcttaccccggtactgcacattgttgatcaccagcgtcggcaagatggtcacatcccctctagcgccatgtccaacctgcatcaagaacagcaatggcgaaggtgttcgccagtcacacaccgaaaatcctgcatttttcagcatcaagctggtcagttggtctaacaacctgaacaatctgctccgtcttgagcgcgtcgttctcgatgtagtcgtagcacccgacgctgctgcactcgggctccgtgtcccagcggcagaagaagtagcggtcctcgtcgccgtagaacccgggcgtgtccagtacagcaggggcgatgcaggggatgaggcagagcacccgcgccgacggcgtctcctcgatcgagtactccggctcgccgtaccgcaggcgctcgctgcggccgccgccgccgacgacgccgaggcccacgccagcgcgccgcaggttgctgaacaggcaaaggctgtgcaccgcgctgcccttcctcgcccagagcaccgccaggcgcagcagtcgccacgctcgcctcccgatcgacgccttctgctgcttctgattcgccgctgctgccgccaccaacgccattgccgcaaataccagattcagcggaagaaaacggtcgcaaaatgctcccctgctcccgcgtcgccggctgccggacctcctctcccgcctcgccccgtcagtctcctccccacccgctggttgccctgcccagagccccagagagaaaattgagagagagagagagagagaggaggaagggagagaagagggggaagagagagaggaggctgacgtggatatactgacatgtggggttcgcgtgagtccgcgtgagtcccacgctgactcagcagccacatatgataaaatcgggatcaaaaccgttgagggacttattgtgaccggtttttattagttaagggacgccggatatcaggtattgcggttcgaggacgattttgtatcccgctgacaagttgagggaccttcggtgtactttttccatctaacaatgccaagacgggccagttcttatgggctccaagccccaaaggcccaatcaaccatacgcaaaggcttcggccaccttctccttcttcccagtccccacactgatccgccatgtcgcgtcggccgttcggcggcggcggcggcgatgtccgccagtctccaccggccagccctcgcttctctactccagatcgaggcgggaggctgcggagtccttggtgtatttgcgcctggaccccggctcccctgtcgcggctatcacccgtgcaggagtagcagcactctgggttccgcgtcattgacaccgcgacgctggcatatttcccctcccggactccggatcagggacgttctggtagcagtttgtgctttcctttattgcacctttaaatttgcaatgcgaaatgttgtggataagttttaatttagaaaaagaaagtgagtatttactacagtatgtcgctactgtgctaagtgcctttgtggttgtggatgatgcgtaccatgtaacaagtaagaaatcacttaagctgttggtactaagcgttaccaattttatcgaattaacaaaatttcattctgatcaaatgctagttatgatgccattgggctaaccggctaaaccctagtgaaaaggaaacacaatgcagctatactaataaagaaaaacagaccaatgaaatgtgcatctgcctgaaatgtagaatatataacccggctgaaatgtagaatatataatgtgattcttcccttgttaaacccataatctttcacaacaaatatttagggtctggccaacagggcagttgggtttgctagaacctgtgtcctaccttagcaaataaggatgctaaccgcataaaaattgctaagatattagtatcacttaacagtatgtactgcatatattttctcattctaagtaggtaccacatggtccacatctcttctttctatattatttttttaaaaaaccataatttaataagcttgccaaaagttccatgcatagtagtattccatagtccaacgagattgaccccaatgtttgtcagttgctacctggtggatatgaagaaaccaaagggacaaattcgaacagaacaaactgaacattcctatattattcctttcattgcggacatgccaacatgtaaaactttgcctataccgtgaatccttccaaattgcctaatgtaattctatataaaaccaaaaatctttattttgttctatcagttaaagacatgagttagagtgctttccttatgtatcacatatgtagctgtgcataaaattggagttactccagcaaactcagccaaacaatacttcctacttgaccgcgccaatcttttcctagagagcagaaaataaaatgatgcatgggctatgggtgcaagatcagggtgtggtggatcacttagcgcagctcgtccctctcttgcatgagtgtgcttcccatgtaactgagggatcttttgagaaggctgacttcagctttaagaagatcagaatgctcaccatagctgacgggccattgcagcgcctatccacgatcattgttgacagcctagctcaccgccttctctcctccatccagggccttcctggtgcccttatcgatccatctgattactttgagaagtcaaccctccgggctgcacgccacaacttcttcaagctgaacccctacctaagcaccggttttgtcactattaactgggccattatggaggcaatggaggatgaaaaggtcacagtatgatttgaatgtgcttttagaaaaaaaaaagttttcaatagatatgcagcttacccaatacattgggatctgtcattgctttgtggttgaagtatgtatttttgtcacctgcttaatttggatgccaagtcttctttttttggctaatttatttaattagcaatttagcatggtgctagaatataattctcctttccaggccatataaactttatagcatgctgacttcccagaacatcaatgtttgtcactattgattcaagaactagagttgatactgttcctttctacttttctaataatgctgggcagtgtagatttgttaagatttcttcccgaaaacatgccgaattttttggagatcaaagtaaagaccaattagagatgcaatagttattaatgccattttaaaactttcccattataactttaaaactttacaaggtgcaatttatgttgaaaggtcattaatgtttaacatggtaggtaaaattgatatacatttgcacacaacattctttaagaacaaagtcaggacctgcagaattgttggttagcattagcgagcattactgagaatttgagattatttgtaccatgcttgtaatcttctaacgcaggtagatttgcaggttgccacattgttgacttgtcctgctcagctgctcatccatggcagtggcttaagctcctcgatgacttccatggacggcctggcggggcacctgaattataccttactgttctccatgatgacaatgatttcttggcgacatgcagtcattgctatctaagaaagctgaatctcttggggtgtccttccattttatttctgtgataggcagacttgagaccttggatttcagcaatctccgtagcacctttcagataaaatttggtgtggcagttgcaatcagctgcgctctacaaatgcatcgcctcctcttggttgatgacaatttgagctccaccagcattgctcagctccagaaaatggccaacttcactcagcctaagcaaatggccagctctgtgtgcagcccagcctccacactgaactatctgcagacaccatcccctcgtacaccaaaattgctggcaagattactgtctgccatccgagcgctcaagccaaacatcatgttgattatggagcaagatgcagaccataacaccctgctgttccgtgatcggttcaatgaggtactcaactactatgctgccctctttgactgcttccatgcagtggctgcagctaacccagggaggactgatgaacgcttacgtgtggataggatgatcctgagggaagagattaaaaacatactggtatgcgagggagtccatcggcacgaacggcacgagaggctggaccagtgggcaatgcacatggaggaatctgggtttcacaatgtgcaacttagcttcagtgccatcagggagggtaaagagaatctgctgagctttggattgaaaaactgccagaacaaagaagacaggggttgccttctactgtgctggggttatacgaatctctactctatctcggcatggaggcaaaatagaggttcatcctctgggagcagagagcatatgttagttcaacgccaaataatatggccattccagtaggcctctctgtccgtggcaattagagagcagcagactacatccaaatttcccactctgggtgctctgttcagcatatgtctggcagctcaaggtacaagctgataatgtgtgtttgcagcaagatttgactcctgcactaaagatatgctaataagttcacttggtgtaaaaaaaaaaggatggtataggtaggacatagaaatatcttttggtgtgaagtatgtaaagaactgaaaggtctgtgttttttttttctctttgaaaattggaaccaacgaaatgggattggcagagatgcttaattcatcatcgatccttgaatgattacccatcatttcgtagttttctctgtttgcaaaatgattatgtttcttagaaaatggtacttatgtttcggcagagtaatctcatatccaaagtttatgcgcctgattaagaggctgagaaactcctatggttatgtatgcaaattaatctcatattcctagcttttcctgcaaaaatagacgagaaaattaggtttggaggtaaaagaacaacaacagcttgggtccaaatgcgaacgtttgctccaagaaaggccccttgcaatcacctacacttcgacgtttgcaacttcagacaaaaccaggttttgtttggactaagaacgcagattttggagctattagtttcattgatcctgtgcttagtcatggactgcaatagactgggagcacaaatagaaaaaaaaaatcgtgactgcaatagactgggagcagaagaaattgatctcaaaattgtcagatagcatctgatccaaatgctggagataaattccaagggaataattccaagctccttagttattccaccaagatacagacgacatctcttagttctatccgaagaagcatccacttcttctttgtcccttcgtcgtcccatgacaacttcgtcgcacaggaacacctgaccttgcaacatttgtctcaaacccaacaatggcgacatgccaatgatgccattgcttgataagcttcacggctctgaaaactggtagcagttgaggctgtgctgcacggacaggggcatgttccaggacgacatgctgtcgtcggcgacgtcatcgccggcgtcgtcggtgtactcgccgtcgccgtcgccgtcgaacgggtcgtgggtgcaggagctgagccatgaccagcagagcgttcggctgatcggcctgctttaccagtgcgccgccgaggtgtccgccggctccttcgaccgcgccaacctctgcctcgagcacatcacgcagctcgcgtccctggacgcgccgcacgcgctccagcgcctcgccgccgtcttcgccgacgcgctcgcgcgcaagctgctcaacctcatcctgggcctctcgcgcgcgctgctgtcgtcggccaactccgccgacgcccacctcgtccccgtcgcgcgccgccacatgttcgacgtgctcccgttcctgaagctcgcgtacctgaccaccaaccatgccatccttgaggcaatggagggggagaggttcgtccacgtcgtcgacttctccggcccggcggcgaacccggtgcagtggatcgcgctgttccacgcgttccgaggccgccgggaaggcccgccgcacctccgcatcaccgccgtccacgacagcaaggagttcctcgcgaacatggccgcggtgctgtccaaggaggcggaggcgttcgacatcgccttccagttcaacgccgtggaggcgaagctcgacgagatggacttcgacgcgctccgccacgacctcggcgtcaggtccggcgaggcgctcgccgtcagcgtcgtgctgcagcttcaccgcctcctcgccgtcgacgacgggaggaggcacgccgccgccggctgcctcaccccggtccagatcatcgcgcgctccagcccgagaagcttcggcgagctgctggagcgggagctgaacacgcggctgcagctgagccccgacgcgtccgtggtgtcgtcgctgtcaccccactcccccgcagcagcaacggcggcgcacccgacgacgtcgacgccaaagctggggagcttcctgtcggcggtgaggtcgctgtccccgaagatcatggtgatgacggagcaggaggcgaaccacaacggcggcgcgttccaggagcggttcgacgaggcgctcaactactacgcgtcgctgttcgactgcctgcagcggagcgcggcggcggcggcggagcgcgcgcgcgtggagcgggtgctgctcggggaggagatccgcggcgtggtggcgtgcgagggggcggagcgggtggagcggcacgagcgggcgcggcagtgggcggcgcggatggaggcggccggcatggagcgggtggggctgagctacagcggcgccatggaggcgaggaagctgctgcagagctgcgggtgggcggggccgtacgaggtgaggcacgacgccggcggccatggcttcttcttctgctggcacaagaggccgctctacgccgtcacggcgtggcgcccggcggcgtcgcgacgcggccacactcggtcgtagctgtgcacgcgcatgtgttctctgtgtgaaattgacagcttgtttggattggatcatttgagtggagagaactgaattgatcagcttaattgtgttgttttcactgggagattgttgctatttgccagcatcatcatcgtcatccaaggtgctgcacggttgaatttgcaacctggttgcgatgttgagtatgagtgtatgacactattaatgtgacagtactactgtgatcgatgcttcacagtatagatcactttggatcataaagatagtttgtgaaaagtgaaactcagtgtttagatcactttgtcctgcagcttgagtgcttgacctcttgtctttgtcactgaaaaagtgcagggctagtttgcttttgaccggaaagttgcactgcatctcgctggaattgcatgcaccgttggtaagttgccccgcaattgcaacgcactgatgtctccggtctcccgcgcgctcaacatgtacaacgcatgcaaactgttttccacgggaagattaattaaggccccgttccaacgtgcctatcgggcaggcaattagctgcttggctttacttggagaaaacactcaattgacgtatgtttaactaagattgaataaacttaaaaatatatttacttaaagtttttaagaaatttctatagaaaactttgttttaaaacatcatacgtttagcggcttaggggttagaacacagctattaatatatgagtggattacaggacttctactccctccatactacaagggattttgggttacatatatatgaagtataaacatccaataataatgctgaggcacctatgatatgatgatggaatcataaccaagtgtgggagtatggtgttgcgtatatagagatatgtgtgcttgtgtttactgtaagtctaaaaattaaaaaaaaagatcaatggctggtgtatatgatggtatgtatgtgcatcttacgtataattaatttatactccccccatccataaaagttagacatatttcacatttgagtttttctaaataagttatttctatttgtattctttatgtatttaagacttaaatgaagagataaatttaaatgtttgattagaatttaaggagtcttctaaatactcattggttgcatacttgcattcactccatgattttgaaacatcaaagatgatttaatttctcattggtcttggtgacaaaagtaatatgtacaacttttgtggatggagggagtataactctaaatgttgacagtagtggtagcagtgaataaggccattcacaacccaatgactaagtggtgtccatagcattaaataagctgttaactaggatgaaaaatgatgcggcaagtgaataaatgaaaaaaagagaaggaaaccatgtcttgcatgagacatggtttctacacaatatccaagacatcatgtgaaataagtagcattaaatttaagtatggaatagtggtgtttgcattggaagagtggtgtctagtactagtttcttgatgatgtggagtttatggaaactatgtctagtgttttgggttgggaatggccttagaagagtagtgtgatgatgtggagtttatataaactatgtttagtgtcttgggttgtgaatgaactaagctaccatcactccgtatcattgacgtgtgtgcctctcaacatcggtgaaacttgtgtactcgctttcaattcccaatcctcaatctgtcctttgattctattgcaatgcacgggcaaatcagctagtaaaggaaaaaaacgttaccgatctaaactgaccgttctgttcatttcttctgtgaaactcgtactacgtacaaagagaacaaaagaaatcagtggagacaatgaacagcagatgaacgacacgtacatacaggagacgatcgattaacatgcattacgtacatcgatcaaaacctagtaaccaatatataatcacgcgcagccatacatcatcatgcgggcgaactcgtcgaagcagacgaacccgtcgccgtcggtgtccacgccgccgatcatgcggcggcagtcgtcgacggagcagagctcgtcgccgagcgacgcgagcacggcgcggagctcctcggcggagatcctcccgtccccgtcggcgtcgaacaccgcgaacgtctccttcagctcgccctcgtccgccgccgcggccgcgatctcctccagcacgagctccccggcgcactccgcctcggcgagcatcgcggccagctcctccttgctcgacacgatcctccgcagggccacctccaggtcctcccgcgtcacggccaccgccgccggctttttggtgccggaggaggacgccgccgccgacgccggcaacacggatctcggcgtggtggcggcggaatcatcggatgatgacgccgccaacgacgacgacgacgaagacgtggtggagccgaaggagcagctcttggcgccgctcctcctcttcttcctcctcttcttggaggaagacgaagacgaagaagaagaagagccgaacaaatgtgcaagcttcatcatggcgatgtctttagaaatcgagagctgaggaaggggcgaggaagatgagggggaagacgaggaattataggggaacaaggcaaggtgagcttccacgaagcttcgtgcgcgggaaaaccgaatcgcgcgggcctaccatttctgctgtttattcggctgggctttgaaggtttcagtatgtcctttgaggaggatacggcatgagcgagattttgtaccaaagttcacatacaaaattacacagacaatgactaccgtaccccttcatggtgcgtagtccactagcttgtgagttgtgagacaattcggaaatgtgggcctgtttagattccaccttaaaattttacaccatgtcacattgaatgtttaacacccgcataaattattaaatatagattaaaaaataactaattacatagattgcgactaatttgcgagacagatattttaagcttaattgctccataatttgacaatgtggtgctacagtaaacatttgctaatgacagattaattagggcgttgtttagttcccaactttttcttcaaacttccaacttttccatcacattaaaactttcctacatacataaacttctaacttttttattcaaacttccaattttggcgtggaactaaacacaacctaggtttaataaattcgtcttgtggtttacggatggattctgtaattagtttttttattagtgcccgaacaccccatgcgacatcctatataatacccaatgtgacacgccagaactttacacccctggatctaaacaccccatgtacttcagatttcccatcgaatgcaacttaggccctgtttagttcacacacgaaaactttttaccatgtcacatcgaatgtttggacacatgaatagagtattaaatatagacgaaaaaactaattatatagatcgtgtgtaaattgcgcgacgaatcttttaagcctaattgcgccatgatttgacaatgtggtgctacagtaaatatttgctaatgacggattaattaggcttaataaattcatctcgcagtttacaggcggaatctgtaatttgttttgttattagactatggttgtttggttgatgcctaagcttgccataactaagcttaggcaagttgtggcatgtggtaaaagtatggccaagaaatagttagccacaagtgtggcaatgttaggtctagttatctgagtatgacatgtgggacctaagggtagaaaagtgtagaatgacacaactgtggcattgaaacaaacatacgcctaaaaactgtggtatgactgaagtgtggcgtggcaaagtgaagcaatcaaccaaacaccccctataggtgtccatatatccgatgtgacacgccaaaacttttcacccctaaaagtaaacagggcctcaataccaaatgcatatgcatgcataggtgcagccagtgtctaacccataaaaaattagtgaggttctagatatacatataatctaattattgagtaatataatggttaatatgactataacaacagaaaatagacaagctacccgatatccggggactacaggaaagcttcaagtaggaacgtcattgggtgtagcatcatatatatgtgtactacttaactacccttcattttaaaatataataagttttagcctttgacacctatgtaagaaaatgagtaaataggcttggttgccttctcggaactggtgagttatagacctggactagttaagactatagtaaacaaaatgaatagaatgggtagttttaatggtaaaaatattgttttacaactagattgttatatttctgataaaatttaaacttttttcagggaaaaaaactttagataagattatcatatattttgggaaggaggaggtacgtatgaaaatgaagtttgtatcattatatcatatcgcatcttataatgttatgaatacaatagaacgatgatcaatctaaaatacaagaggattgcactgggggtgtctttttgtctattggtgggaggaatgttccatcgttttttcatgtaactaattaaaaatgtcaatggaaatattaaaaatatatagtaaaaatagattaatatataatatatacaataatgcagctcatattcgacttatacatgcatgtataatttaatatataatcatatttgttatttttttgaatttgtataagtcaaaatttaaacctgtggagtgatataacacatcttgccaattcatttaattttatttataatttatttagattatatacataaaacaaggaaatattcactcgaggaaaaaaacactttatttggattgcaacagataaatgacaaattgatcagcatgcaacttgagagagttttttttatctcgcagcttagattttcggcgccggtgttcacttcaacagttcaacacgcatgcatggatgtcggcagcaatcaacatcaacattaccacgggggcacacccacacaatacgtgttactcctaattaactaagttacgtgattgggtaagtcgtatgtataatgtgaacattatcaaacttaaacgaccggaatgcatacgtacgtgatggatttggggttgatcgcgatcgggaaggcgccaagaaacttcgcatgcatagctcgacgtacgtacggctgccaaaaaacgctccagtctgatgacttaactgacgtgtggacatgagatgatgagaggtggtttgaaaactgatgctcctccatggcgtagggcgtaccgcggcaacctcatccgctagctcgttcacactcacagcggtggacgtcttctcgctctcgctgcgcgctcaccgtcatcgctgagatgaactcaacgtacgtaggctggaattctgttccggcccaggttaattatatgggcctcacgtaggctataatcacgttccagcccaacatatatgggccgcgcgtagtctgtaaccccgttctggggtctgggccgaggccgcagtcccgcctggaccaacttatacaggccgtacgtaggccggagttcctttccagcacatatgccgctcgcctccggggcaataataagccggaatcactagttagcgtcgccggcagcgtgcgttttaggcccataaggcctagcatcgctgcgccggcgcgcgcgcctctccacgcctttttatcttttttttcgttttctttcctcactttttctgatttttttaatcttttagcatgttttgagttttaaagttttaaaattttgatttgaaagttttcaaatcttaagtttaaagttttcaaatcttaaactgaaagtttttaaaatttttaaatctggacttgaaagtttttaaatctcgattctcgagttgaaagttctcaaatctgagttgaaagttttcaaatctcaagttgaaagttttcaaatttttcaactctggacttgaaagtttttgaatctcgattctcgagttgaaagttttcaaatctgagttgaatgtttttaaaatttgactttaaaatttaaaacttaaatcgaaagttttcaaatctaacttaaaaaattttcaatctgttagaaaaaaatctcccaaaaaatctccagaatatattcttaattagtatcattagtgttaagtatattgactaatatatgtagttaagactaaaggggaggaagtgctcgccaactccctttcttggcgcgcacgcgcgccgtagcaacccccataataagcacgttggattaactccactttacgtctctacaattttcttttcatcgagtttaagtcacatccctgagccgcaatacaagaaatttttattatcacctaacttaaaccgggttaaattaggtccttcagcactggtttcgctgatgtggcaagttgaatacagtcaacctgtcctgtttgattcagcttaggattattataatctggattattaggagtaagctgaaataagcagataacttattatgatagattattacaatctataagccagattactataatatgataatccactctaaaggtgcttttttagattattgggtggctaacaactaacaaccaactaataatccagagaaacaaacagctaacagcttatcttatgtcggcttattataatccagcttaaaataatttggcttaataatctagattacaataatcttaagctaaaacaaacaacacctgagtcagcataggacccacgtggaccccacatataagtcacatgaaaatatataaaaaaagaaaaaaccttctctctccaccccccggagcacacggtagggacgacacacctctcttcatctcgagctttggcccaaagatgacacctctctccatctcgagcttcggcctcaggaagtaaggaggtgaaagccgacgatgacgaggttgaggcggggcatgggggaggcagagggccaaggacagcacggcccgccgtattaaagacgagagtgaggaccggcgtcacccaacctcgcttagcgcctaatcgccatcctggttgtccaactgtcacgccccgaactagtcccgaccggaactagcccgtgacgctccaaattaacctgttaatcgataccagtcccaggaaacagtgctggtatcacaggaagacagaatatcacagcaatagaggtctctttattatagagtaggagtacagttatgttgggctgcggacagaacccagctcacaactgcattacaaaagggaagcggaagccaagacttggaccaaacatcacaggcgcgacttgggaactaggccgaaaccctaaaactcagcgtagccggcttgctcctggaagaactcctcgtcagcgggatccgcttcatcttcttcagcaactggggagggggggattatttatatagagcaagggtgagtacaggagtactcagcaagctatgggaaataagtgtttaatgcaggcttcaaagaaatgccgttgtttttgcgattgattttatttaaactcttttctgaaacaactaagggagtgcttctcaaacgacacggatgagacagtgcgtctcgtccggtcggagtatgtgcaatgtatcagtcttttgaattgatcaagattggcacccggccaacagctttcaaacgaccacccgggcctggctgatcccatcagccgcagattttccaaacatcaaacccattccacaacagcaaatttcacaaggcagtagtcaaacaaaactacgctaggaatcacctcacatccgcccatgatcgtgggcacggctgttcgaacagttttaataacctctgcagagggggtacactttacccacacgacattactaacccggatcatccagcccgtgcagaacggccatgactagagaccttaaggctttcatgacaaggcatttcgaaagccgacacaggttcaccatatgccaacgagaggggtcccagaccaacaccagattaggtcccagaccatactgtgccaggaagcccaggggtcctccctgacaccaccccggcgaatccacatgtctcttagcatcatggctcccccgataagctagttactcagctaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacctaagttttacccaagatgtttctcagattttaagttttaaggcgaccgtcgatacccgtgcagagtgcacgattaccgaggcgcaactaggtgggtacaagggaacatggtataacaattacaaaggaaggatcagatgcaacaagttaggtaggtccgctaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttggaagttgaacggagtcaaacggacttacggttgggaagatattgaatttataagattattggatttttggtctaaaggaaaaggatttatttaaatcctttttgaaaaaaaaagaaaagaaaagaaggagggagggaaattagacttccctcgggcggctagggcgcggcctgagagaatggggcggctcggccgagcttaatgggccggccggcccaagaaggcggcccaaggcgcgcgcgcgggcggggaggggagagagccggtgggccgggtccccatcccgcgtggtcccgggtgggacccgcttgtcggcgactcggctcaccgtgagcgaggtgcacgcggggcatgctagggtttgggaagggaggcgcgacgcatgcgcgcggttcgcggaggacgcggtgcggcgggcccatgcgcagcctcacggctcgcggtggagtgcgcgcgcgagggggcggagggaagcggcggaccggggtctgcttgacccggtcgcggccgaggtggcgccgacgtggcgcctacgtggctgccacgcgggccggcgggaggtagacgacgacgccggccggaacggacggcggacgacagcgcgcgagcggcggagcgaaccatggcgatacaggcgaaggcgaacacaccgggatgttgcacaggacgaggggagacgagccaatggctcggattcgccgggggatgctcgacggcggcggattgcggcggcggcaaccgacggcgggagaagggggaacggcgatgagttcacgaggggccgattcctggcggcgagagcatctacgcggctacgggaacccaccccttgcaccggattaggaggaatcgcatcgagggaggccggcgacgagaggcgcttccgagctcgggcggcgacggcaacgagcacacggcgagcgacggcagcagtcgaggcggcgccggctagctacgggggggggggggggctactcgtgctactacccgagtctaaggggaggagatggaacgaggagagagaacggagggaggcactaccgtgtgggggtgatggggcgcagtgacaatgggccgacggcacgggagcgatctctccggcctctggccgggggagaggaagaagacgagcgcccggagtccccttccgcgtcctaacgcgcaccggctcctccggcacacgcgacggcggcggccggcgagagagacagcaatggcgcgggcgagaaacggggaagattgggaggggaaagaggaagggaggcgcttgggtttatagggcggcgatgtcggtttggaaaccgaccttgggcggtcaagggagcgagctggcgctcggcgctcgcggccaaaacggcgacaggagggggggggggaggatgacgccggcgggagggaaaagggaaaaagggggagagaaagagggcttgcctccttgccgctttggggaaaaggaggagggagagagggcgacgcggcagaggagggagctctgcctccgtcccttggaggcacgcgcggggagaggcggggccgagtcgatgacgacggcgatgacggcggggcggtttggagtggagcggcgacacgggcggcagacgcggggcaggcgcggcaggcgctgacggcggcggtgactggccggtcggccaccacggcgcgcgcgcgcgcgcgggcggcgcggcgatttgggcggcatcggcgggaacggccgcgagagtggagagggagagctcgacgcggctcacgggcagagcggggagagagagagagggagagagagagagagggggagatgggccgagagggattcggcccatcgaacccgagggaagcaaaatagacttttgcggagggatttgatttgggaaggatttggattcgggattgaactcgacgatagatcagagatttgagatctgagatgacacggacactagacaacaagcaaagaaacggatttcgcaaataaggtttttaagagatagttttcccgctagacgccacgacggaacgggcgctacaccaaccgcggtatacacacaaagtttatacatatatatacagagtttatacgtatgtatataaagtatatacatatgcacatacatatagagaggagagtctaggggggaaatccaccgcgcaggcgtgcgaccacccgcacagtagcttacagacacacatcttgtagcagcgttctggtgccatcgccgcactcttttcctacaacaaacaccttcctctcctcctgtcgcccggacgatgcccttgatccgctcgacgcatgcaatacacgacgaagaaacctagcccattgtttctccatcacaacgcgtgtagactcgcgcttgctggaggatgcactgaactactgaaagtgttcgatggtatgccttaagagatatctgatgtcctgaaaatgctgtgctggacttcaggagttcgtctggggatcggaagcaggatcatatgccttcaggagttccttcggatgatatataggtaatgaaaaaagctcgatgttttcgcctctgcatctgtccttcgcgatttggctgagtggatggcatgtttagaagcacggagatacacttcgatcagttattctcaagtttggttatggagtataccagagatctttttctgtgcaaaatcagttattataagctattcttgcgcttagcaaccatgcatctcttgaatgcaacactatgcaatctgcagttattttctcactctcaaatccatgaatcggtctatgtaatcaaactagaaactgatattactgctgaactaacaatcacccagtttggtgttttatgttgacaatatataacaggctgtctttatcatttttgatccatatttcttaggacaagattctaaaggtatcttctaatcagtatagtacgttctcacatgtgtcatcctcgctaagaaaaggggcggtaataccccctattaagagctaaactcactgattgacgacatgatacaatttgatcttcagaagaattaataaattcttgtaagctcaagttgatcatcacgtgcattgacaaaagaaaagggagattcatatgaaaacactttagagatgctaacaaggtagttaatgtcaaaatgtcacttccagtttgaacactactcatgtcctcttgacttccgaatctgtctctcctcgcctatatatttgcactttacgctcccacatattcacagaatcacagcatcacaacaccagctaacaaccattagtccttggtgttctgcattcacttttcatggcgccctccttcccgctctcctttgcaccccaatcagccgatgaagcaaccgcacacaaggaaatctatgaccaactccggcaagccgtggagaccttcccgacggcgcccaacagcagcaccagcttcacgtacagtcgccaccccgacggatggtacacgttcccggagggggttgtgagtgccatggtcatcaagagtcaccttacggcgcgcaccaccgacatctttatggtcaccttccctaagtccggcaccacctggcttaaggcgctcttgcactcggctctccaccgcagggccgacgatctcgcggcacacagcccccaccagctcgttcctttccttgagacccaggtgttcatcaaagatcggatccctgacctgagctccctcccggcgccgcggctgttgatgacgcacatcccgtcccagtcgttgccggactctgttgctgactccagctgcaaggtggtgtatctatgccgggatcccaaggactgcttcatctcgctctggcatttcttgaacaggttcaggccgtgggacatcaacgaggcacaccgaaacttctgcgatggtgtctcactgtttggcccgtactgggagcatgtcctcggctattggaggtggcacgtcaagagaccaagccaggtactcttcttgacctatgaggagctcactaccgatacactcggccaactgagacgcctagccgagttcgtcggacgcccgttcatggtgaaggagcaggagatcgaagtggacagaaagatcgtggaggcctgcgccatggagagcttgtcgaggttggaagtgaaccagtcggggacaactgacatggtcgataaaacctatgcgaacaacatattcttccggcgtggcgtggttggtgattggaggaatcacctgacaccggaaatggcgcggaggattgatgagattacagagatcaagtttaaaggatccggcttgctgttgcatccacaatttttacaagcaaaaagagaataaaatgaactattgacaagtgaagtggaggaacatctcatgattgtacttatttctttgcttaatgaaaaaaaaatgcaaacctcgtgtctatttatgaaaataaaaagtgaaaacatagtatgtacgtatgtctataaatgaaattattgcaagctgcctcaaataatactcctactgtaagagattgccaattactagtaataagtcgggcttgtttttttttttgttatttggcttcattgattggttttgtgtcacatgattatcttctttgtacagcctgcagatatggtcgagcaaaatttacggaattataagaccgttggataagagcgtcaaacgttaaaaattagagggaatagtaaatattatttcagttgggtgatttatgtttttatctgaagttaagttgtgatttgcgttaacaacaacattcttcaaaatgcttttttctcataaacaacttatccgatctacgatccgattatactattgtatttgttataagagtaaattttacaaaactacatgttttgtggtctaagttgcagaaaaccacacacactttgacacttggcacttgagtacatatattttggttgtgtagtttcacaaaactacactatcgatgtatagattcacccgcgagatgatgcgactgtttcacctaggacggggacatagcatcctattaccagccatcgcatgaaattaatatgatgccacgtcctcatcctagatggaacaaccacgtcatctcacgggtgaatccattcatcgatagtgtggttttgtgaaactaaactaccaaaatatatgtacttaactgccaagtgtcaaaatgtatgtggttttctgcaacttaaaccataaaacatgtaattttgtgaaatttactcttgttataatataatctttataacaatatatcacatgattatattatgacaaaagaaaaatatatgtttcaatccgttaacactctttgtttcatacgtgatagtgatatgtttcaatatgtgtctttagtgtgttccacaaaattcctgaaactacctaccacttctccctctcctctctctccacctcattcatgcatgcatgctttttagcgagctttaaaacgattttcctcaactatttatccaatctacgatctgatcacacattgtattcgttgtaattaaatctttacaataagatatcacatgattatattatgatgaaaaaaatatatgtttcaatccgttaacactcactgtttcatacgggatagtgaaatgtttcaataggtgtcgttagtatgtttcacaaaattcccgaaactacctgccactactctcgctcctctctctccacctcatgcatgcatgcatttagcgagtttcaaaacgatttttctcctaaactacttatccaatctacgatccgatcacaccattgtatttgttgcaattaaatctttaaaacaagatatcgcatgattatattttgatgaaagaaaaacatatgtttcaatccattaacattagttgttttatatgcaatagcgatatgtttcaacgtgtatcttcaccatgtttcgtaaaatttttaaatgctttgcttatttttttcaccatatataacttgatgttttactcgttagttaacagaaacatttgaccgactgattttttccgggcatcgggcgcccgatgggaagattcctccccatgagagcgaacgtggacattttctatttctttgataaattaatagatgtttactagtactccttttgtcccataaaaaactcaatcttgagtatgtccagatttaaactcaagattgagttttttatgggacaaagggaagggagtaggttgcacgatggcacgatgcatttttggaatgcaatttgcaataattatatcagtgccaaatcccatgtgtcggtatgtgtactatatcaaactagaagccgatattactaagaaacaagttgacagtaacgtacactattatcatgcttgatctatatttttcggagtaagagtagtataatgttatcttctgatcagtatactatgtgtgccatcagtataacgtcatggtaagattaatttgaccctcataagcatgatacttttatgcaagctaacacgctgagcacgatgtgcactaaaaaaaggtcatatatatagagagaggtgtgagaacaactcaattaatgccaggaagttagaatgtcattatcagtttttgaacactgatcatgacttcccgatttgtgtctcttcttttttttcgcgaacaaaatttgtgtctcttcccctatatattaatttgcactactctacacactgcacagagtcacaagaacacgtgttttgttcattgctgtttagtgtggactcttcatggcttcctccttcccgctctcctctgcaaccgaagcggcggacgaagcgaaagcccacaagaaaatctacaaccaactccggcaagtcgcggagacctttccgacggcgcccagcggcatcgacgtcccatacagccaccaccccgacggctggtacatgaccacggcgggggtcgtgagtgccatggtcatcaagagccacctgacggcacgcgccaccgacatcttcctcgtcaccttccccaagtccggcaccacttggatcaaagcgcttctgtactcggctctccaccgcagggccgacgagcttgtggcgcatagcccccatcaactcgtccctttcctcgagtctcaggtgttcgtcaaagatcggatacctgacttgagctccctgccagagccacggctgttgatgacgcatatcccgtctcaatcgttgccagactccgtcgcagcctccggctgcaaggtggtgtactgtgccgggatccctggattgcttcgtctcgctttggcacttctggaacaagttcaggccatggaatattgatgaggcacaccggcaattctataatggtgtctcgttgtttgggccttactgagagcacgtcctcagctactggaattggcatgtcgagaggccaagcgaggtactcttcttgacctacgaggagctcgccgctgacactctcggccatctgagatgcctcgccgagttcgtcggacgcccattcacaatggaggagcaggatgccggagtggatagaaagatcgtggagatttgtgccatggaaagtttatcggggttagagatgaatcagtcggggatgactaatttcaccgagaaagacgtgccaaacaacacggtcttccggcgtggcgtggttggagattggaggaatcacctgacgccggagatggcgaggaggattgatgagattacagagatcaagtttaaaggatccggcttgcggttgcatccacagtttttacaagcaaaaagagaattaaacaaactataggagtatgatcacgtgtgaagtttcattattgtacttatttctctgcttaataaaaaaaatgcaaacctcttgcctatttatgaaaataaaaagtgaaaatatcgtgtgtactgtatgtctataaatgaaattattgaaagctgcttcgaataatactctcctactgtataagaaattgccaattattattagtatgttgggtttgtttttggttgtctggttttgtgtcacacgattatcttctatgtacaacctgcagatatgcatggtccagcaaaatttgtaagactgttggataagagcgtcaaacgttaaaaatcagagggagtagtaaatattatttcagttgggtgatttgtgtttttatctgaagttaagttgtgatttgtgttaacaacaacattcttatcaacaaatttggtgcaaaagcctgatgatatcatctcgtcagcaaaatgggatcctaggatagtgagcctgctagaagctaaatccacctattggtgctctgataaaatttgaccctcataattcataaacaacatttttttccaaggtaaagtttaattccatgtgcatgaaatttctcaacctaacaccatataattttagaggagagaataaggaatgaaaaatactttctccgtcccaaaaaaatcctaatatgtatctatctttgtcttcagattgagtttttcttgaacggagggagggagtaggtcacatacatacggaatgtaaagacgctaacaacctaacaatcaattaatgatggattatcactgtcagctagcttgaaaactctgccggaatttgtctcctcgatctcttagatgtttgcaacttgcactctcatatattcatatattatcaggctcatcgctcacgggactaaattccattgtgttctgtgtcgcctcctcaacagccaaagtggccgacggatcaacgactcacgaggcaagtcagcgacatcggccaccatactgatactgccgccgtcctgatggctggtacatgtccaggcagggagttgtgagagctccatggccatcaagaggcatctgactgcgcgtgccaccaacgtcttcattgccaaccttctctaagtccggcaccacatggctcattggctcagggcgcttctgcactcggcacacatggctcattggttcaaggagtcaaggtgcttctgcactcggctcttctccgtggaactcaagagctagctggtggcgcaaaagccccaccagctcgtcccagctgttcgtcaacgaccgcatcctcagcctgaataactagaaaaacatagattaactagaaaatacaaaatacgagatgccgattatgtcttgcgatttggattcacctacgtgtatagtcattctggcgtaacgatggttccagcccagcctgcatataagtggtaaacccgttccggcacaacttcttggaggcagctccttctccttttgttatccagattgaaaatgatagacaaaaatgtagtcatgagctcgattagtttgttgtaattttcttttcagacccctttttctttattaataaagttttccctaacagcaggtgcctcccttgctgtgttcctttttttttaaaaaaggagccggatggaagccgatcaacctatcatgggtctcatataggcttcagtcacattgaggaacaaaaagggccctcacggaggtcccagtaccgtttcggcccaacttataatggtccaagcacacgtttgctgccatcccattttggttccaaagtgtaagatccgcacatttgcagcaaagttcttgagccgctgcctttctttttttttttataacacgcccttcggccctagatctgctcgacgcaatccacgacgaggaaccttgggtcgtctacaccgaggatatggtgacccgttgcggcggttgtctctctcaaatgatgcgttgctcattgtgccggcaaggtccacatactctattgtttctccgtgtttgtgacctacgatgggctctgtccgtaggtcgctaggctatgacatgagggctagattccttgcattgggattggttttgtcgaaactcgtgcaaagtcgtgtttggtggtgttcggcagtacttctaagaacgaatcgggatatgtatttatttagattcatccatagaaatgattcttttttttggaacggagggtgtatgccttaaagatactaggtgattccccgcactttgctgcggaaattcctaagtaacttttaatattttttaataatcgagctaaaaataaaaattatattagttattaagaacaaataaaactggtttgtcaaactatgttcagagagatacatttagtagactttatctgagattgtaaatgaaatatgatattccgcactttgattatatggatgaatatgtattaagtatctattatatattaaaagtccattaaacttcctacaaacgctactaagctgccacatggcactcctataaactctcctaagtcgccatgtggagttttaatatattagaaacatctagcccttaattttcatttaaattagtgggtccattattttacatcattggattagatttaaaacagggcctccctccatgtggatacatatgcctccctcactgcctgcaagtacgtacgtacacgtactaacagatataccccccaccctttttcccttcttttattttttttacctaggaaacatccataatatatatgacgtttgaacatgtttatttactataaaaacatgtggcgttttaatatattagaaacatctagcctttaatttttatttaaattggtggatctattattttacaccattcgattagatttaaaacagaccctccctccgcgtggatacgtatgcctccctcactgcctgcaagtacgtacgtacacgtactaatggacataccccctcccccaccccccaataccctttttttcccttcttttattatttttttttacctaagaaacatacataatatatgacgtttgaacatgtttatttactataaaaagaaatatgtaattatcatttattttgttataattcgttaaattttctacaaacgctctcacgtccaaacgctcctacgtcaccacgtggtgctataataaattagagaaaattatagaaattctaacagaaaataaaacatctaaccgttgattttcacttaaactgatgtatctattgttttagaccattagattattagatatataaaaataataatctctcgctcctaatatcccgttcacatacaagagaaaatccttgcgtattattcatccggagaaaaggcaaaagctatacgtatgtacgatcgaaataaaaaccaaagaaattaatacgtataattgaaaaaacgaccagccaagattaattccaactaaccatgcataatcagctcacggctcaagcacgtatgtgcattatctgcactccttttttaggttgttgagtgatttgtccattaaactttctataaacgcttttagatcaccacatgtcactctacaatcgctactacattgtcacgtggtgctataataaattacataaaatcataaaaattctaagagaataaaacatctaaccattgattttcacttaaactaatgactaatggacctgttattttagaccactatattagattattagatctataaaattaatctctcactcctaatatcttcatcccgataaaaggcaaaagctatgcgtatgtacgatcgaaataaaaaccatagaaattaatacgtatcattgaaaaaacgaccaaccaatattgattccaactaccatgtaccatcagcttacagccggctaagcacgtatatacattatatgctctcctttttttaggttgttgagatatctaaagcataataaaatctaaacagcattgatttatatctccaattgaatatagactttcatggttatcccggtcagtgtcctcttcatgaagggctccacgcatgtattaacttttgaaaactaataaactatatgttggttctatgatcagtttagttctttatattcctgacaactataaatcaataatttaaatccatgtattgatgttttattatcaattaaaaaaatagtgtgagccatacctatctattattgacctatagtagttagtgctaactgataaatacataatgacacataataattaatgtcataatatttttttaaataattatggtgtaaaatatcacctgtcaaataatttgaatctacatatgtaaaaatgaaaaattgaaacaagggaatttagttatatttttttcaagtagatcttatctaattttaatgtgtgagattaagattctcaaatatgtttttgatttttttcaggactattttattggtatttgaaaagtgagaagcacacatgatacacagacaagaaaaaacttattaaaaatacttccagcgagtgatatggctatactacaaccccatagtccatcatgagaactatggtcatatatgtaggttttttgtttgtcatatagttttggcaacaaataaataatctaataacatgtgcattaaactacccatgatatattttcttttacttgaggaatttcaatgtgtcgggcatagttgatggatgtatgtcatacactacactaacatgataacctcactctctttcaaataataatattgtatatgtattattgaaatttgagtaatattgatatttacactataaacaaattgtgtctattatataccacaaaaacaactcaaaactttcaaaatgaatattttaatcacctccatcttctctttttccattctcaaaagtgtgccaagcatagataataaaccttgctatgctgccatgatatagcaaaggcatacatctggctgagttgagccaccatgggtggtcacccttagcaatagagctcaacttcctacttaacaatgcaatcctttataaaggtgctaattgtgaattaggcgttaaaactgctctccacgatagtcttgacggatacggctacacctatatgtgacccatgtttcaaggtatcgaggaataaagccttggtagctatgtttggctatgggcattcatatctaattttaacagtattatactattaacacgtataagcgatactgttataacatatttttttgataaaatattattggaatatttattcataggtttggaaataagttagatcgacatgaacaattaggtaagtagtggagataaactttttagtcgattagtgatgtattgtgcttattttgatggtacaaatacagtttcatctattaaataagcactcaggtttcaaaagaacgatattaagtatccataaaaaattcaataataataagtagtggtgacattaggcaaatttatatataaccgggaaatagtatttttgtttgaatctaggaaacatttttgtcatttattatatataagtctatggtcttttccgtggtctatatatttctttttgtattttcttataaacaataaacaaaatgcccacgcatctgcgtgggcttcttttctagttataaaaatgatggatacatatatattaaaaacattgtgaaaaataatgtgaaggaagataattggatgttgatttgtagaatttaatgaattatatacgatgttgcatgcttgcataggtacattttgtatgtaattattgctagtggatgatgaggtggcatgtttgcatgttgagctttaggattagtgggttataactttttggtaagataggatatgatgtcctaaaatgttgcgctggcactggtggagagatggtttgtagttccggttggtaacccctctgtagtcccggttggaccgggactacgaatgcgggactaaagatcactatctttagtcccgattgaaataaccgggactaaaaatacatatttaatcctggttgataacaccaaccgggactaaagatggcagcgccagtcccagttggtcaccatttttttctctttttttattttcattgtttctttccaaattgagttgctccttcccaaatctccctaaatatccccgaatcaaagtatcatcccaaatcaatgaatcattcacatcacaaattctaaataaatacaactcaaattcttaaagaaatacatcacagatccaaacatcaaatacatcacagatccaataaaccacaagttcttagatccaaatgtatcacaaatttggaaaaaaaaataaagttgtgcttccgctgccgcctcccctccggtagaagggagggcgccgccggccgccatgtagcgcccattccgtcgtggcgcctagcggaaaaattatctctttaaaactctatttgcgaaatctgtttctttgcttgttgtctagtgtccgtgccatctcagatctcaaatccccgatctatcgccgagttcaatcccgaatccaaatccttcccaaatcaattcctccgcaaaagtctaatttgcctccccgggttcgatgggccgaatctctctcggcccatctcccctccctccccggatctctctctctctctctctctctgtctttccctcttcttcgctctgcccgcgc

SEQ ID NO: 60452 - DNA, 20759 bp, Oryza sativa
ccccttagactcgggtagtagcacgagtagcctccctgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcatcgccgtttcccccttctcccgccgccggttgccgccgccgcaattcgccgccgtcgggcatcctccggcgaatccgagccgttggctcgtctcccctcgtcctgtgcaaccacccggtgtgctcgcttttgcctgtatcgccgtggttcactccaccgctcgccgctgtagtccgccgtccgttccggccggcgtcctcgtctacctcccgccggcccgcgtggcagccacgtaggcgccacgtcggcgccagctcggccaaaaccgggtcgagtcgaccccggttagccgctccctccccgtgcgcgcggtccaccgcgagccgtgaggctgcgcgtgggcccgccgcatccgcgtcctccgcgaaccgcgcgcgtgcaccgcgtctctcccccatcctagcgccgcgccgcgtgctccctccgcacggtgagccgagccgctgacaagcgggtcccactcgggaccacgcgaggtgagcccggtccaccggctctctctctcctcccctcccgcgcgcgcgtgccttgggccggtcggcccatttagctcagccgagccgccgcttttctctcgggccacgccctagccgcccgagggaagtctaatttccctccctcttttcttttcttttcttttctttttcgaaaaggatttaataaatccttttcttttagaccaaaaaaccaataatcttagaaattcaatatcttcccaaccgtaagtccgtttgactccgttcaacttccaaaattcctcaaatctcgagatctatctaatggcatgcttagaggtcattaatagggctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaatttaattatgttgcttgaaaaatattatgcattgataggattgcacttaatctgtttgtcctgtctgcaaggcagattggcggacctacctaatttgttgcatttgatcattcctttgttaattgttatatcatgtccccttgtaaccatctagttgcgcctcgatattcgtgcaccctgtgcgagtatcgacggtcgccttcaaacttaaaatctgaaaaacttcttgggtaaaacttgggttttacaaaaggcttggaaaacccgacacctgggtcagtgcttgcgaactaaatgaatttccaaaaccgcggaccggggaacgtaccgggtgtatggtttcccgctcttgcacttaaggaccgtttccttggaatttcatccgaacataagacaagacgaccacataggtggaatgagacacccctggctgagtaactagcttatcaggggagccttgatgccgagagacatgtggattcactggggtggtgtcggggaggacccctgggcttcctggcacagtatggtctgggacctaacctgttgttggtctgggacccctctcgtcggcatatggtaaacctgtgtcggcatacgaaatgccttgtcatgaaagcttggaggtctcccgacgtggctgatccccacgggctgggtgatccgggttagtaatgtcgtgtgggtaaagtgtgccccctctacagaggttaacaaactgttcgaacagccgtgcccacggtcatgggcggatgtgaggtgattcctagcgtagtgttgtttgactactgccttgtgaaattgctgttgtgaaaaggggatcgttatttggaaaatctgcagctgatgggatcagctaggcccgggtggccatttgaaagttgttggcccgggtggccgtttgaaagttgttggccgggtgccaatcttgatcaattctaaagactgatacatttgcacatactccgaccggacgagacgcactgtctcatccatgtcgtttgagaagcactcacttagttgctttcagaaaagagttcaaataaaatcaattgcaaaaacaacagcctttccttgaagcctgcattaaacacttatttcccatggcttgctgagtactcctgtactcacccttgctctacataaataatcccccccagttgctgaagaagatgaagcgaatcccgctgacgaggagttcttccaggagcaagccggctacgatgagttttaggttttcggcctagttcccaagtcgcgcctgtgttgtttggtccaagtcctggcttccgcttcccttttgtaatgcagttgtgagctcgggatctgtccgcagcccgacttgattgtactcctactctataataaagagacctctgttgctgtgatattctgtcttcctgtgataccagcattgtttcctaggactggtatcgattaacaggttaatttggagcgtcacaggctagttccggtcggtactagttcggggcgtgacacgtcagctcccgccaccgccgcgctccctgtcgccctccacgcagccacgccgccgcccgccgccagccgccaccgcggcaccctctatgccagccgccgccgccgcccgggctcagccgcctgggctcgctctggtatgggaggaggaggaggtggggtaggggaggagaggggaaggggaggaaggggagaggagaagactagccagatcggatctgaggaggaccggaggaggctgagaacttgttgtttaatgagagctagggagtagagagagagagagagaggggaatggggagggataagattatttttgtttataccaaccgggactaaagataattggggcctgaattcgacccgacaactttttaaaccaggactaaatctttactcccgaaactaaagatcaaaaaaattttaaccaggactaaaaaataatctttatgtaacaccccaggtaaccacgtacctagagtgccacatcaaaatacactcaaaccactaactcccaaaattattagaaatttcggcagaatcttccctgtaaatacggacatccacgacaggcaaatgtaagttaaactaataacaacatccttcccacaattcgatccatccttataattccatggaaagaaactaatagatatctaaaagattattacaagaccgaaccataatatagtttaagtatcattatggacctaagcaatatagtttaatactgtgcaaataaatgtgtatataagggtgctacttcccgcccatgcatatcggtcgcaatatgtacctaaaaccaaataaaacacacgagtgagtataaaattactcagcaagtataatatggaactagaaaacacatatacacaacattggcaataaagcatgaacataaggctttctttctttgataggaaacacattttcaaacaccaagtcaaagaagatagtagttcccatcccgggcaggcatgaattgaaatagtagtttccatcccggacaatagtgaatacatcctagcatttgccagcaaagccgagtaagcgtgatcagcgcttacccacaggaatatgaataaagatccaaattgcactcacatgactacacatggtccttgaataattgaaaaccagaatcaaagaaccaaattgaaaccatattgcacatccatggcaagcatggaacttgaattatttacctagaaccaaaatccggaatattaaaacaagaatagcatcgtaaacataggataaacatgaaaacctaaatggcgtgaataacaatatgaatataatcggtcacatgtcacatagaaatatatcaaaaataaatagatagagcaaacaatccatgaatcacacaattagttcgtcatgcacttgcctccaatgaaggattggtatcatgcacgatctgataggccaccacctaatcataaacaaaacctcagcaaacacattcaaacatgcgtataaaacaatgaaaaaagtgaacctactgccccatcccatcaaaacgcaataacaaggaacgccgcttggactatacacaagactactgcttcaaacatttatatcttgaaatatgaaaagtctatgactgaaaatatatacattttgaaaatctacagaacaataaatacaactttgatgtagaaagcatatttttattctgcaatttaaatggtctaatttgcgcttgaaagtagacatcagaatctgtccagaatttcagactgtccacactaagacaaccataactggagttctactcgcccaatcatggtgtactttgccaatatggaaagctaagaaaaacctctacaattttgtctataggcagcctggctgattccactgtttaacccctccaaaaacagttcaatctactactatccaaattatgacacaaaaacaacagtcatactaaaaaaaatatatctcctaaaccacttgagataaaatcgcgccctttggtcagaagatagatccaaacattatctacaacttttatatggacactttgatcagaataaatcattttgaccatgaaattaatgtaaaacagaggcgctataaatcggcccacgcccagaactaccaatccgaatcacaacgtccaaaacgcttctctaacccacctcaaccacgaattaaaccactagaaacaccctagaacaactgatacaacaaggggataagcctcacctagggttcttttagagaacttatgaggagacaataggggagactccggtctaacccctacttctactcctctcctcctactcgttccgtttttccactttgcttcttcatccaagctatgaagatggagatctagggagagcaatttgctgttgagggggagagatgcgaacacaggaggagaggaggaaggaggcgccggctaaggagaggggtggcggtaccacaaggggaggtggggtttggttcccctctctctaggttttaggggagaactaatgggctgagtttatgggccttctcatgttggcccacttctaaagatatttttcttttatgtatttctattaacatctttattttaacaagtcaacccaaactaaaaaaacctaaatattttttttaatatacggggtattacactttagtccccgttcctatttgaaccgggattattgtagtttttgggcgaccgaccaaagatgatttctccaggactactatgataggtaattaatgaatgtagcctgatgatctcacctttaatttgcagccgtcctttgcaatttggctaagtggatgtcatgtttagaagcatgcagatacactcggctattcttcaagtttggtttataaagtatactccctccatactcataaagaaagtcgtttaggacaatgtttaagtcaaaccttgggaatataaatcatgaataactctcaagttgttgagtttaaaaatgtaaaaattatatatatagatttgtcttgaaaaatactttcataaaagtatacatatatcacttttcaataaatatttttatagaaataagaagtgaaagttgtgttttggagaccgtgtcactgtcctaaacgacttcctttacgagtatggagggagtactagatatctctttctgtgtaattaataatcgatcgatctgacctactgttacgcttcgcaactattttcgtatatcttatggagtattgcatgatgtatatctgaaatacaacactatgcaattcctagttattatatcgctgtcatatcggtgggtgtaactaaccaaactagaagtctacaagcctactgctaaactataaatgatcagtacactttggtgctttaggttgataattgataacgcttgtcttatcatgttcgatcaataattttcatcgtaagatcctaatggtatcttctgatcagtgtagtgcatatatactataaaatgggcaagataatgcatcttgctaagagctaatccactcatcaatgtcatagtaaaatacgacgcgttaggttgccagtcatattttgtcatagtttactatgtccaagattatataggtttcactaacttagcaactactccattcgcttcatcttatcaatcgttttgacattttatcaaatctacctataataataattagcaattacactaaattagtttcattaaatataacattgaatgtgttttgatatacatcgttctcacatttgtcatcaatcataatacaatgagcaagataataccaccatctgcatggacaagatctccttctcagctacaacatctccttctcgctttgagtgatttcgtactagttgattaactggacgaaaggggagccctcaatgctccacacgccaccatcttgaagtccaagcaaatctacgagtacttgcatgaagaccgccaagacgaccaaaattggaaaataatttggaaaagtaaatctcctccgaagattcagttcttcatttggttattatccaaagaacgcctccccacaaagcagaacctgtaaaaaaagaaaattgtttcgtccgcgaactgcgatcttttggtgttttagaagaaactgcttttcatttctgtgttgattgttcttttgctcaggcgttctggtcgaccattcagattgtcccaggactgacaagctcagccaatctcgcaagtttaggccgcctagatggcattcccatcaagcacttcagagtcttcttctttctctgcttttgggttctgtggaaccacaggcatgatgttgttttcagggggctgcaaacatccttgcgtagactagtaactaaatgtatagatgatgcaactctttgagcagagcgtttcaattcggatgataggggcattgtttcctcgtggaaggaaacactagcgtctgcttttcaaaactctgtaatttaacatgtaactgcaagtcttccttcattttataaaattcaggtggggaaactcccccgctcccccctgaactttctaaaaaaaaattatacaatggacaagataataccctccgctaagagctaaatccatatgtcacggtaaatttaaccctccgaagcattaacaacttttttcaatctcaagttgagcatcacgtgcattaaagaaacaaaaagagataaaattaatctacataactagagatgctattgttcaacgaaatcttcaatgatctaaaaaagatgctaacacctagacataataacaagttaatactaattaatgtcaacttgaatactttattattacttccggactactctcctctccgagatagtactatatatttgcacttcagctcccagtggatcaaaaaaaatacattggtcattggtgttctgctggattcattcttcatggcgccctccttccggctctcttctgcacccgagtcggccgacgaagcaacagctcataataaggagatatacgaccaactccgacgagtcgcagagacctttccgtcggctcccagcctcatcggcctcccgtgcagtcgccacccggacgggtggtacacgttcacgaatggggttgtgagctccatggtgatcaaggagcacctgacggcgcgcgccaccgacatcttcctcaccaccttccccaagtccagcaccacttggctcaaggcgcttctgtactcgactctccaccgcggaactgacgagctggtggcgcacagcccgcaccagctcgtccctttcctcgagtcccaggtgttcgccaatgaccggatccctgacctgagctccttaccttcgccgcggttgtttatgacgcacatcccatcccagtcactgccagactccgtcgctgcatccggctgtaatgtggtgtacctttgtcgggaccccaaggactgcttcgtctcgctctggcacttttggaacaggttcatgccgtgggacatcgacgaggcgcaccggcaattctgcgatggcgctcgcagtttgggccgttctgggagcatatcctcggctactggaggtggcacgtcgagaagccgaaccaggtgctcttcttgacctacgaggagctcgtcgccaacacgctcggccagttgagacgccttgccgagtttgtcggatgtccattcacgacggaggagcagaagcacgggtggataggaatatcgtggaggcctgcgcattggagaacatgtccggattagaggtgaatcggtcgggaacgatcaccatagtcgatagcactgtcccaaacaacacggtcttccggcgtggcgtggtcggagattggagaaaccacctgacgccagagatggcaaggaggattgatgagattacaaagagcaagtttaaaggatctggcttgttgttacatccgcagtttttacaagtaaaaagagaataaattaaaacaaactaggagtatatgttttttctttcaaaaaatagtttgtgtgccgttttcggtgtttaatagagatacaatctcttgcgtattcacgagtgaagaaatacatatatgtactggaaatttgtaaatcaaatcattgcaagtaatataataaaatgttgccggttagccgtgagttgggttgttaggttgtttggctttgtggattagtttggtgtacgtaactatcgtcatacagttttcagatcattcatcaaaattcactaataacgttcaaatgatccacactgtttcttgatatgctaaagattattaaacatcctccgaaacatttctataccaccatgtgacactctaataaattagaaataaaaataaaaatactgagggaaaaaagcaaaaaacattaaaccattgattattacttgaaccgaaggaccattcaatgtccaaaacaatttgtttaagagcagtaaaacgagctacctcaattggcatagggaggcaagcaaagagaaactgcgattctagtccaactgtccaaggctataaggatgatatgctacggacctgctaatctgctcttccatttgttttcctccaaattattttttcgagtcacatctatagttagctgaactgatcttacacttagcaactaggagtatgtcgtatatatactttattgagatgattgtccatttccttctagtctagaaagtagtttgcatgatttcatctctgaaaagaaagactgtaattcacaattacatcactaccaaacccttgtttcggtgcgcatagttaattaaagctgatcttactactagacaccatgataaatttgaccctcagaaaaaacaactttttttgcaaggtaaagtttaacccccatgttcatgaaatttctcaacctaacaccataatttgagaggagggaattaaggaatgaaaaataggtcacataagtacggatgtacagactctaacaatcaattaatggtggattatcagtaccagctagcttgagaactctgctgggatttgtctcttctcttagatgtatgtttgcaagttacatctcaatcatatattgtcaggttcacgggactaagactcattattgttttcgtaggactacacacacttcatggcttcctcctcaactgccgaagcggccgacggaacgtctcacatggaaatctatgaccaactccggcaagtcgtggagaccttcccggcggcagtcagcggcatcggccaaccatactgtcgccaccctgacggatggtacatgtccaggcggggggttgtgagcgccatggccatcaagaggcatctgatggcgcgcaccacggacgtcttcatcgccaccttccccaagtccggcaccacatggctcaaggcgcttatgtactctgctctccaccacgacgcccacgagctagcgtcccttttctggagtcccagttgttcgtcaacgaccgcatccccgatctgagctcgctcccggaaccaaggctcttgacgacgcacatcccggccaatcgctgccggactccattgccgcctccggcagcaaggtggtgtacctgtgccgggatcccaaggattgttttgtctctctctggcacttctgtaatagattcgtatcatggaacattgatgtggctgtccggcaattctgcaatggcatctcgcatttcgggccgttttgggagcacgtcctcggctactggcggtggcacgtcgagacgccaagccaggtgttcttcttgacctacgaggagcttgcagctgacacgcttggcctattgagacgtttggccgagtttgttgggcacccgttcacggttgaggagcaagaggctggagtggataggaagattgtggagatttgtgccatggagagctcgtcgaggttagatgtgaatctgtcgggggcactgactttatcgagaaagacgtaccgaacaacatattcttccggtgtggagtagtcggagattggaggaactatctgacaccggagatggcaataaaaattgatgagatcaccgagatcaagtttaaaggaactggcttgttgtttcatccacagcttttacaagtagaaagagaatagaaggaactatcatgtactaatgtttgacgcgaacagccggacatgtgttgtattcatgaaaatgagtgaaggatatgtgtactgtaattctatgaatcaaattattgcaacctgcttcgagtaataacaggtcgattagcagtataagttgggtttgtcatttgtttggcttttgtatcacataattgtcttcttcgtgccccctgcaaacccaccaaagtgtaagactacttgaagttccgtaagcatttcgcaacgtcttaatcacccatgaatattaccaaatatgggacaaggagacaccttaatcttgagaaaaatatggagataagccaacgtgctcaattgggtgatctaccctttgggctcgtggctgacgagtgtgacatccttgtaccgagcaagtatgtttgcttctcaaatcagcttttctggcattacttggttgcccatatattggcagaaggaaaccatgcacaattataatatacatatggaacacattattactcagcaatcaacaaatgccgcagtaaggaaagttagtaaaaaccacatatttttacacgagcttcagtttcagatgtaagttcaatagaattgccatagcatataatttagccacagggagtgagcttcttgttgcctgcaccacgagggttatcgtccttccagtcatcccatcctctcgctttctcctcttcggcgtcctcgtcctcttgggctgaccgactgccatccttgtgccatgcggagtttgattcttgaatcatcttggcagttctttcttgccatttctccatcattttcatctcacgtaagccagcttcttctatgctcatcgttggcaacctaagaattattggatcaaaggatagtctcatatgcatattttcactaacttttaggactgaacaatgcaagatcactttaatagagatgatctatagctcaacacttaattgctgcaggggaaatctaatgttttttatgagcaaatgtagaaattgcagcagaatagtatcatttcttggaatttttcatagattatgactaaacataaggtcacacctacgaatcactatctcagcatctatacgattgcaccaagtgttcgtagtcacaacagagtacaagacaacagtttattgtcagtgaatctagtattgcactgaatagcaaacttaacatggtgccttttcagcttgaaaaaatgattaatttaacagtgtaaaccacgaatttgtcacggacttatggcagaacatgcaccaacaggacaaggaaacacctacgattgaataaacatggtcacatactaatgtggtgaagcaaatacaatgtaaaggaccactttacaaatttaccaagaaataatttgctcatcgagtaatgctcaacgaaaaaggaggtcaaagttcctacaaatatatcaaagtatgactagtatgatgcattaaaggttgccacaaataatgcccctccacattctgccataaccgaagttcaccatcacaataaaaagaagcagtgcagtttcagccaggtatgtagtagtattttaaagcatacctataacttggctgaaaaacttgtgctgccattctctctctttcactggttagtcctccaccaacaagacttgcagggccaaatatcagcggctggtgtttgtgctcatgtgcttgtgaaacacttgctctaccttcaatgacatcttgagcaaatgttgcacaagtgattggatcagctggtttggagtatggtgcacggttggcagcattatggtgccatgcttcagccctttttgtacgttcatcaagcatttcacgagcaaatgcattaccatcctaaaacatcatgagcaggaaattatttcattactaaaggaaacctccatgtaagtgcagaatttattgaaacagacatgcaacacaaaggaagcaaagataaaaaaaaatctaattgtttttttcttacggtagaacatctaccatcgagtgctataaaaggatcatgaaaacaaaatcaaacatctaatattacttgcatgtagtaacaacaaaacactcagcactctgcagacactgagagagagagagagagagagagaagtgtgatgaaatacttgcaatggcaagttattatcatattatgacaattaatttaattgtatctcctaactcagaatccggtgtataatttttttcaaacagaattactgtatacaactatccagctacctacttggtcatggtctacttggtgaaggtaagctctactacaacataagctcaaggcaaagcgaagttcaataattgtatcagtaaaaacacaaccagaaatgtacagaacggttatagaagaaaagttaaaaggccaatatgatactggaaaggatcaaccaaagatactattgacgagaaattggcaaactttattcatttgttttaccttcgctttcctttcttttactgccggaagcatttcttcttccttctttaacatgtcaagaaggtcaaaagcctataaaatgaagtagaaatgagtgcgtctgatgatcaggataaccaaagcgagcacagtagcttaaaagaatgcaaataaacatcccaagcagtataagagaatcattcttgcccataaaacacaaaccttgcatagagccaatgagatagtagctaaccatgcctgcaacatagaacaaaaaaaaaaagaatcaaaaccacggcataaccatttatcatttgtacatcaaagtgagttatgacaggcatggcatggaacccaaactttggaagcacacatcgacagatcccaaaaggttgattgcccacaaaagtaagagatcgtatataaaaagcacaggaaaggcaatgagcatcatattgttacaggaaaaagattggtggtgacaatctgccagtacagaataaatacgctgtgtgtttcatttgaacaaaaatgggtcaattcaggaaatgtgatcagttccctatgggattttttaaaacttatcttgaatcatcaaatttgtcaaattccatcttttattgaacagaacaaagcctttcctttccttctcttttctggaaaaagtaaatattcttcttccacttctagtacattgtagctaattttagtttggggtattttcaaatatgctatgtggtaatttaagaatatatcacgatgtttccatttggtaaacaagatcagatttgctacgtaaatgggttctaaatgcctggtgctaactgctaacctctctttcttcctctccatcatcctcaaaagcatcttcctccccagcttcaataggagctgataaagcagctgctctcaatgaccgcctacgcctttctttcctctccttgatttctaggagctttgtttctgcagccttttggcgcttgaaccgtgcaacctaggttcggcaaacaagaaaattagagtggaaattaaccgactttggaaaaggtcaagcagattatgagtcccagattttgcagtctcaataatagatttggatcccagtttattgtgttcgtaaattgcagaatgattgatgacccctttaacatatttgagaaaaatatttcgtcaaggctcaccttctgtgctcttcgatttgccatggtatcaggttgcttctgcctagatatttcaagctcatcctctgatataagctccagtgcttcacagatagaaatgaattcctgtgtaaccgtagtgattaaaacatgagaaacatgagtgttgtgatgacagagtgctcccaattgaaaagggcataagaaagacatgacaaatatgcaccaaatcaactaaatgtgacaggacaaactgatataaccttcaaatgatcctgcgacgccttaaggactgggatccgatcttcctgcgctaccctttcagtcatttccccaaggtagtacggtacctgaagaaaatcaatcggaatcacagatataaccacatgtcgcagatgcacaaacatgatacggtaagagaaacgaatataaacgcagatgtagtgcaggaaacaaacatacgagtaggtatttgaggttggcggtggagatgtcatccttggtctcgttggaggagaagaggccgaccttactgaccatctcgtcgcaccgccgcagcaggtcgacccccttgcggatcccttcctgcaaatatcccaaaccaagcaatcacagtgagcgctcgcacaaaaccgccacgagagggttgatggggatgaggagaaaggggggtgaatcgaaggaaaacctggtcgagggaggagctggaggcgagggagtggaggtgggacgccttgtcgaagagggcggggagcgggaggtcggcgtcctcctcctccgccgccgcggcggggtggaggcgcatctgcacctgcatcttgttgctgacttcctccacctcgaccattctcagtcgccgagcgcgcgagaggggagagatcgccggctaaaaccctaccggagcagcgccgcgcgaaaggaagggaagcgacgcggaggaaggaaggaagggaaactggaaacgtcgggaagggcggaggcggccggatttgttgacggggaggcggggctcggccggaggtgctcgatgggccgttgatgatcgatccaacggcagaaatcgctgtgttccgcgcactgacgggcggcaataatgtttacagaaaaacccctgtttcgggctatttttttcacaaaggttatcctaattttggagacgactacggatcggacgtccgatgctattgttttcgtcggacgcctgttctactattgaatccacgtccatcccttcatgtccatccgattaaaagaactattacatgcgcatgcagagaagagcagcaacaagaaaagtttaactgtgcatgctcagtaccaaatgagagaggtacatggatagtgacatgcttcaaacttttttctcaaaaactatttatccaatttacaatccgattgctctgttgtattcgttgtaattaaatctatataacaagatatcacatcattatattctaagaaaaaaaataaatgtttcaaccgtttggacttggatctttcacgtgtgagaaataaatgtttcaattggaatttaactatgttgcacattttaagttttatgttgcagtagatctttataaatattgcacgtgatattatttagatgtttcaataagtattttctaatgtttcactaatttaacgtaaatgttgcaccggcgtttttttagtgtctcaataaatagttacggtgttgcaacacttataactcgatgtttcatatatagaataaaaatgtttcaattaggatttaacagtgttttgttcttcttatttattttttatcaaaatgtaatcaactaagatcttattgtaaagatttaattgcaacggatataatagtgtaatcagattgtagatttaataaatattttaggagaaaaatagtttgaagttactaatgcagtaatgcatgcatagcccttttttttacatacatgcacacttatatgttagagtgaagagtgaagtactaaggagaaaagtaagagaaagagagagaaatgtgcaaccataaactaggctaagagaaaagataagagagcagacatatagtatgtaggtcgtgagcagatcacgtccaattttgtttggtgcgtcagacgtttgactgcaagcattttcccctagtttttgcaaaacaccccttgtggtttgttttcaccctaaggtaagtaacacaacagttccactaactccatttcatgttatagatctttttaactttttttcaaactaaatttatataaaaacttagcaacatctataatgctaaattagtttatgacattaaatatattttaaaaatatatttgttttcttacaatatttctatatatttttataaattaatcaaactttaaaaggtttaactaaaaaatcaaagtgacttacaatataaaatagatgaagtattatttttgttaaaaacccccgttttagcatcgatcatttcaaagatcatcgttttttgcgagagaatatatgtgtgtggaagtttttgtgtatgtgtgtgcgtgtgtgtggaagagtgagtgtgcgtgcatgtgaacaacacttttttaaggaaagtgtgaagaacactatgtgatgaatctggtattaacccttgaaagttgtgaattcacttatggttaacatattaatcagatgaaagaaaacttatagttatgagtacacttgcacacaaatttgtgtttaatagttgtaataaaatttatgttagtaacatagtatgctagtaacacgtactgtactaaactctttcatctagttatgagtatcttttattagcagtagacacgaattatcaatttatcagtggagtatatgttagtactaacatgctactagtacatgaattctatgtttcacttgaacaaaccacatattcatggaacttgaaagaaagaaagaaagaaagaaagaaagaaaggaaaaaagcaactaacttatggtgatcacctttacaacgaaatggcagcattctgcttccattacccaaaaacaaaatgtttcaaacaacatgaagaaactttctttccatagactaacaggaaaaataactcaaacatctctttacatgtataattgttcaaactgctaagtattgccaactgctccagacaaaaagatcacaaggattcatttctcatccaatctttcaaactactaactaagaagccacattctattgtgtggccatttacactattatgtaaagagatgttcttttctttagggtctcaccatctacttccttggtagccctcaatctggtttctctgtctactgtttctttgctgaatgtacccaccactattccttttccttccagatatgctgcttgggtcctggtatctattcctgttgatcccattgaagctagccctgttatttgatgaatgatgattgttactattattccaattgccccaactagaatccgccaaggcactaccccaaccagagcaatttttactccactcattccaagattcatgctttgttccccagtccatgttggatcttgaatcttgctcccacttgttaacttcggtgggcttttctacatagatgtcccagtttctagattggttctgcctctgctggcacttgttatctgtatcagtgctgcccaatccatcagctgggagtaactcatcatccatctcgaatggtaaccgtaccatattcaggtcagctatcaactcagggtcgatcttgctattgtggtcaaccttgtcaatatacatatcagggtctggcaaagatatgtctgaaggttgaccatggtaattagcccagaatctagcctttgcattcttaaaattatcaaaggcttctgagtcatcccattgctctatgttcttatacatgcagacatatctcttgttgtcacagaacctgtgccaagaaatgccgccaacataaatgcaaaattccctttcccataatgggattgggtggcaattgtgtcctgtaaatacgaaagcaatatcagattcattgtagcagcataaaaatgcagggagatgatgaattctaaaatgtttatacaaacaaataacatatacaaaaattttctggctagattgcttaagactactgtacagattagaaatcacctgcagattttggacgggtcaaatcccaaaataccagcatcccttctaaaagtatgggaaacaaagacaccaaagtacccaacggttactttcctaacaggctaaacagaagaaccattcaaggtactggataaatgggttcagtactaaaacactactccttctaagggatgctcctttgtcgccacacaactgcgcctttcatgactactccctccgtcccaaaaaaagacaaaccctggtttccgtgtccaatgtttgaccatccgtcttatttgaaaaaattatgaaaaaaattaaaaagataagtcacgcataaagtattcatcatgttttatcatctaacaacaatgaaaatactaattataaaaaattttcatataagacggacaatcaaacgttggcacgcaaacccgcggtttgcctttttttgggacggagggagtatgtcagttatctaatagtttatttttaatagaaattaataatgtctccttacgcatatcatggatttaggatccggctgcttgaggaaaaaatgtaatggccacataagaagttatcaatagccaacttaacattttgtgtcccctcattttttctgaagatatgcgcacacaagtgctccctctttttttttatttgacgttgaactaaccaaagtcaaataaaaaaacagagggattagtttgcttattgcaataccattacagttcaaactatgaactgatacttggtagtcaaataaaactagcattttctgacatttgggtaccttttcaaatagtaagacaaattagaccaacaataataagcctaatggtaaaggaagtcgcagtagcaactctggttctaagcttaaattgactgcatcacacagtacaggacagtccaccatctacgacagttgtgtcattcttagggtggcaggaaacaaaatgatattcatgcccattccgagaactccaatccacaggaaaatcgtcagccaacaagaaagtactagacctagatatctagatcgaaaattttccaacccgagtcttccctaacaaatcaccatctgaacaccactgtacagatttagaaatcacctacagattttaaaaatcgcctgaaatagcagcatctcttctaaaagtatgtaaaaaaaaagacacccaacagttactttcataacagactaaacagaagaatcattcaaagtactagataaaagggttcaatcctaaaatactagcattccttctaatggatgctcctttgtcgccacacaattgcacctttcatggctatgtcagttacctaatagtttattttaataccaagtaccaacaatgtttcctcaagtatatcatagatttaggatcctgccgcttgaggaaaaaaatgttaagcccacataagaagttattgatagtcaacttaatattttgtggctcctcatttttctaaagaaatgtgcagtaagtacagcgctttgttttctttctccattaagtacaacctcaaccagatggctgtgatatggctaatgcaaagcaacgccattacagaggacaattcccttaatctcctatccttgacatcctcaaaagacaagccttctttagtaccaacatttattgtacttttttgcattgtgtgttaatgtggttttactattttgaagcttctagaattatcctaattttagagaaataacttgtatgatcataataacataactccgccttccatttcctagggtaagcttactcagatcagcttaacttttgatgagtcaaaagcagatagagtaattcactgttaaatatttttacaaagatatgaaaataagcattcatttttcacataggaaatctggaaattcaagatccccttgaaaaatcgaagtgttcctgtggcttattttgagaaacagtatactaacgaaagataatttaattagaagaggttggtagaagggggataaattttgtcaattatatgatacagcagaatcaatgcaacacctttttatcgaatgccgaattgcaaaactgatctggaatgttgtttgtagcctttaacttgaaaccttttagagacataaatcatctttttggtagttggatgtagagctttcagaaaaacatgaaacatctcatttgggttggtgtggctgctattttatgggtcatttcgaaaacaagaaattctgcttgttttaagaaacaacttcctggagatcccacagatttgatttattatgcgtcattggattacatgttgggctgatttgcagatgcaggaggaagagcgaagaaggctgctgtgggggggggggggggg

SEQ ID NO: 60453 - DNA, 11825 bp, Oryza sativa
  unsure (1)..(11825): unsure at all n locations
aagcggctggaaggcttcactctggagtttgatttctaagcatgatgtgctctgctttcaattcacctgaagcattgaccccattcttctcactgttgacaaaaaactggaagtctcttagtagggtgggcttttgatctgggttgagcttttttgctgggttctgtttggctgagtccctagagtggctccctgtgtctttactttgtgctggctgctggcaattagggggttgtgtgttgacacccaacccaaattgaccaatgtaaactctatcaggatagttggtggtttccttttatgttttcccgaattctgtagctgcatttctgttaatggaaatgtgggaatggcccttgctctaaaaaaaattttctaggctaggctcctagtcatgccacattaaggtccaggtgagttggaaccccccatgtaataacgaaatgagctagggcaatttagtagtgttcaaaaaggtgctaagtgggtgacggggtaacatggtggtgtctagttcctagttagcaatagttggcctgaatggcaaccgtgctaggtggcaggttggcgtctagcaagattcaagtacagaagtggtgcaccctggctatgtttcagcatttatatttcctctagtggataaggagaggcggtgttttaaattttagtgggaagcaaagaccatcctaaattattactatttccattaggccgttgtatattattttggcgggaagcggagaatatcctaatctagaaatacatcaccactatttccgttacatattcttgtcggaacagatgacacactgtgcttactgtgtggttggatcaaatgaccaacttgtatgtacaaagtttgcacattagtagttggcaaactgccataccattacagctcaaacgacaaattgatacttggtagttgaacaaaactagaactttctgacatttaagcaccacattttgaaataccaagacaaattagacaaacaataagactattggtaaagaaatttgccatagcaactctggttctaagcagacagtccactatctacgacggttgtgcattcttaggatgggtagaatgatattcatgtcgattcctagaattccaatccacagaaaaagattagccgacattaccagacctactgacctagatatctagatttaaaaatttctaaccctattatcgcctaacaaatcaccacctgaacttaatcgaatcatacaaaaacgcaatccaatccatagaaacaaagggaacagaacaagcaaatcagtcatccataccgagatcaggaggaggggaaggcggtcgtggagcgcggtcgtggcgggtcctcctgtaccatggccgccgatggtgattccaattccccatcgccgggaggaagaggaggaacaccagactcaaaatgattcgccgatgctctctctcgctcttgacggcaatctcctccggcaaaccggaatgctatctcgccatggaactaggcgccgcccctgcaccgcgagattgggcgccgccgccgcaatttccaaacagtgagatgagctgaggcgacggcttgccggagaaagctatagctttaaatgaagccaaaagatgaagctgcttgcgtcgcactgactcgtgggcccccggcccatcgaaggctatacgtctcctcgcgggcgtgtggcttcttctccctttgacccaagcagcagcgtctcttctccctcttctccctccactcctccatgctctgcgtcgccatggccgcgcgccccgtcagtagcaccacctccacctgccgcccatgctcccggcgcaggtttctgcttccaagccctccacctcctcgtcccctggtacgggtgtgctcgtgggtgtccccgcgagcgcgggagctcggtttccaaggcagcgattcgtggagcgagattggaggccgcggcgaggtgctctctcgtccgccagcgccccatgctgctggcgaccgtggcgggtagagtgttagctgttgactgctcccttcatgtgttctatcgctggcaatctgtttgatgaaatgtctctgacgttagtgagtggtgtttcttggtctcagnnnnnnnnnnnnnnnnnnnnnnnnnnnnnnnnnnnacagaaattggggattctctggtgagggagcactatgtgccttcgaattttctgtccccttcttgctgatcacaaaagatttcgtgatgcctgtgtcaagttgtgattttaacatgtcaaattgtactactgcgtagaaacaattgtgaattgtagtcagcagtgtagttatctgtcataggaaagagcaatatcgtatattcctttttattacattgtgagggcatatagctaatacatgcataaaattttattgtgatcagctagggtcatctggacttgctttggctgaccttagcgttggagattggtttggaaatttgctatattcagcgggtcagcaagccaacgaagctgttcaggatcagctgtctgctcttagtttcactaggttagcttttcggcccctgcagtcaattgcctatagacagaatctgtttacttactttctttcattatattttatgtttctgtccatctcttttctgacatgtttctctattagcttggctgtaattttcggtgctggacttgtaactagtttgtctccttgtacactcagtgttctgccattgactctaggatatataggtaagtatagcgactaccttttgagatgctgtttttttgttgcccgggatcagttataattgatggcactgatctgatgacacattctttaaaatctttcaggtggcttttggctcgggcaaagatcgatctgaggtatattctgttatttataaaataacttatagaaattaaatagaacatgtatacccaaaacctcatagtatgtcataacatccattcaccatgtagaaaaaacaaacttcatccatgttattcttgatgtaaattgatatgtttccattctatatattaggttgttggaaattcagttgctttttcattaggactggcaacaaccttagccatccttggtgttgctgcttcttttgctggaaaggcctatgggcaggtaggacaaggacttccagtggctgcttcagggttagcagttatcatgggattgaaccttcttgaggtaaattcatgatccaatgtgaaaactcataaagcggagcatgccaattaatttttcaagctaacttgttgccacaattcaaatcaagtatcggttgatttgatggttttccttttataaatagttgtaaatcctttgctgcgatggtaatttatttcaatgaaatgtgtatcactcctgttatagtagatattagctcactgccttaaactgttctctatgctggttatcttgtatttacaggtaattgagctacaacttccctcatttttcagcgattatgaccctcgagctgctgcagctaacctcccttccagtaatgctttgacataattttctattttgtatcaaagtaccatatgcctcattatgtttatttcagttacggtaaatgatatcttgctgtttccctataggtgtacaagcataccttgccggacttacgtttgcattagcagcatcaccttgcagtacacctgttcttgctacccttctgggatatgttgccacttcaagagtatgcataacaggaacattcataagttacattaatattttattactttttcttaaatttcaaaacagtaaaactgtcataaattttaccatagtgtctttaattactaaagttagtgaatcacataccttatgatatgcagtaatgttgatttctttgtttctaatatatgttacacttgacttagcaatctgtcataattgttggcaagaagtttatgttcgcctaatttattaattttctgacatgctgattacgatacattttctgtcaggatccgattgttgggggaagtttgttattgacttatacaactggctatgttgcacctcttctcattgcagcttcttttgctggagcactgcaggtataaatgtcttctgatatacacatctgttaagtatagataagatagtgccatcaaatatggaactttaaatctcacttagacttgactaacagtttaacagcgcatatcctagaacaacaacacctgttcattttaagtttagtgcctgataaattatttgctttctgtagagtttgctttccttcaggagatattctgcatggataaacccaatcaggtatgtgccttagttctttctggatcttgagaggttcctggtttgtaatttgattgcaaaagacctgcacgttgcaattaattatctgtacgaatagtaataattttttgactaccttttacaaaggaaacactgaaaatccatatttgttaattgatagcattcgctacaatttcactgtcttggttcaaagagcttgaaatcacatttgtttggcatgcttttttgggagaatatagcacatcaaatttaccttatcatccatttaatattcttttgttaagatattgttctaaacttcttgccacaattctgtcatgtgctttgcacagttccaattcctcagaagcattcgtgttctttcttttttttaaaaaaaaaaagagaaagatctctaaaaaaatataagccattccttctttaaaaaatctgccttttatactttattttttttggattaacgccttgcgctaacatttgccatttgcttggtagtggtgcatttctactgggtggaggggtttataccctactggacaggctgtttcctgcaacatcaatggtgatgtagaatgcatatcatagtcggacaagagctgcagtacgaggatcgccattgttgaacatgcgaattatgtcagagttgaaatgtaaagtaggtaatgataaaatgctaacgaactatcatcagctcttcgtagcttacataggtatatatgatatcttagtctcagcaatctgtatagaacgagataagttgatgtttaccccctacacccacccacaaatgttatttagcttccgttgcttttaaagaatacgtggaattttgtagacagaggcaagagcagaacagagaaatatatatatgcccttctacttcaattcacaggctgcacaagtcgatgctaaacacgatgaccaaaattgctacggataattcatttcggtggatgcattaatgctcttggaatgtaacgaattctttagagacctcacaaagtcacaaactcaatacatttctgctaagacaataacaggcactaaggatacttcatcaaaactgtaaccctcgtttggttgtattgcgctccaatcatttcattcatccactccatactcttttttttagataatgatccactccatactcttagagcattacaaattcgttctattatttacagccacattcagaacagtgcgattaacaaagagacagaggtgcctggttgaaaatggataagattttacttgctcattgccctgtcctatttgtcgctcttgctcttgctcatacccaagaactttgtagtaagtgctaagatttcaccgtcaaaattataattaggaactgtaaacttctatatagtgagtgaaacatattatttccctacacatatattcccaggccaacttcctttggatcagtctctatcatccaggaaggcctgtcaatcaaaatttacggtattgtgtcagctagcatactcagtattgattattagcttactaatgggtgttgaaattgagcagagaggacatcacttgttcatcacgaagatcgttgttccttgagacgcccgctcaagaagcaccttccttgattcaattgctactccctctggctgcattatgaataaaagtggtgattttagaaaattaaaacaatatattgtgtcgactagtgtgttattttgtcctcccattagtgcaccactaacctcctctggaaaccagacgccaggctgtgtgctgccctcaagaactgctaaaacaaacgctgctgttgcatagcccaccgatctgaaaatccaataaaaattaatgctaagatgcaatgcagatagttgtaccaaatgattttgtttgttcttaaaatttaaaactgcaaagtaaatcggaacttctcaaaacaaccatgtagtaagatcgctccaagttttgagtatgaattcctaggatttagggtgttagcattacaaaaatgctgcatcattcaaatgttaaggaataatcactctgggaagtagataccctgttagcttttaaatgaggacaggtttacatggttttctcaggaatccctttttgaataaaaggaaactcttatacatagcatgtaagtttttgaaactggggtctcatttagagagcacctatgtgaagcttcctgcgatctagggcaaaaaatgtgatagttattttttaaaataagtcttgatatttgatgactaatatggtaaatatcaattaggtaatggaccttgagaatgctcaactgcttgtgcagaagtgtctacttacacagatagttttctatgagaaaataatccaatagtattctttccatttgaacaatctaagtctacctgcatataaatgaaataaatttgatcaaaaggtagtgatcagtagctacatatacaactttggacaaagtttgagtataattaatttactcttactccaggtatggcttgaggaaaatactagaagtagtatgcttttaggctgctaacctggaccaaggaaacaaatcttggccagtaactagtaaaaacaatagtctcagtggaccaatattttgtggaaatcgatggctatattgagagttacatggtccatacttcgctccctttttgaagaagtgataaaatcaaatcttataattgatcaaatcaaagtttagaaagtaaattattttaaaaaactgaagaaaaattggctgaacaaatattttaaaactggcattcaaatacctgttctggccacagcttgaaagagtatgcagttaactctggaaatagcttgaagccttggaaggaactagtacttctaaaacacacaggcaaaaattttctatacaaaagttgctttaaaaaatcatattaatccattttttcaaaaaaagtaaataattaattttgcgtgtgcatgaggtgagttcccaacctcacctcgagaacacagctttaggtacttactctcatggaaacacgctctccagcaataccatcgatagctcggacaaaaggatcaacaaatccaaccaattttagaaccttatttttatccctcaagaattcctgaacacgaacaagttgcagtcaggtgtaatccgcattagcaccaaatcaccagtttaatattatcccatttttaagatttcagcagaaaacaagcaaaccatgttgctttaacagtaataatagtattagttgatttcaccaactacataattaaataataaaataaaatgtaagcaattggttgcttaaaaattaaaacttctatttttttagtagagtttactagtactagaatactaatagcaccggttgtgtctgaaagaagtaacttgatagtgcataatttgagaagtaagacatacaacaggtaaaaagtttgcgaaggcctgcattacccaattccagaaaaaaggagcagtaccgaagcgagcactgacagtaggcacacctaaaaccttataagcactcttcacctcaggcaaattcctggaattagtggcataatataaaatttattagcttccattttgaattctaaccaaagtggtttttccttattgtggtaagatctcaaaaagtaattaatgttcagtgcctacagtaagtaaacatctttcttcctaacccctttgccaaaatcaatgctgagagctccactgtagggcttcaattttatttcttctcctgaatttgtaatgagaacaaaacttagattttcctcatagagaaatcctataagtgcactaataaattattgaaaagtacctttgttatatgcgattacatcctccgcaagaagcagaaaactagttgttaatattgttggcccagcaccaccagtgcctgcagtataataaaagaatctagaaaaaggatttagcaacatactagcatagattctgatgaatacgacaacgctttccatacttcatgactagtttgacctttaatttttccaggaaataaataactcctaaccttaatctttcaggttcaccagcattttcacttctagcagcatgaacaagctcagcagccatcactgttccaaaagaagaaaacagtgtatttctaagcactcaaaaaattaagatatgaagcttacctagctagatcaaaacattgtcttcatagtttactgctagatcatgtctctaactctctattatgtatttgatatcttcaatcttcatattaatacatgacactaatcaagttggtgattttacacatatgtaaactgcctcaaagagcaatggatactatccatgagtactgatggaaattgtgaaagagcacatgatgatatctggacagtgtaacttgaaaaatatcaaagtaaactgatatgtttgatagaaatgcgaagtaagaccattgctcactccaggatagatgccggcagttgtaatagctgggataccgcaatcttttgcttgttcatggaaaccctttgctctccacgaatagtctgtatcatcacaaacatcaatatatgccgtctgtaaaaaaaaaaaagttaaggatgtcactaatttcaacgtgttattaaacttatgcatttgatgatcaggcgttgcacatttctaaccttggtcgctattgctgcctgtaggacagtgcactcattctccctttggaaaggtccagcagcatgaacaactaaatccacatctggggcaaaaaaagaaaaactagaatggtcaaacatcagaagaagtttgtggatgacttttcaaaatatttgcaacaatcttttgaaatcatacggccggtgttccaacttaaaagcacaacataagcaggtagttccattactaaccctgtagcacttcctccagcatgttcctgtcgcgaatatctacttggacaaactctgattcatccccgagtttagatgccaaagattcacctttctccctgaccaaaaaaaaaggatactcgacaaatggtcatgctactataatcgtctcattgtacagatggaactgcacaatattgcaggcatccagccaggatgctattgacagaagaaagaaattgttcccactattgaagtgaactacaaaatggctacttggctaggtgtggtttgcattcgttcaaaagtaagaaattgcaacacaagtgaagtaaattcattctgcagattaaaacagacgaggaaattgagtaacagactagtgcggaggaggcatagcatatagggggcaccaacaggttcctgccggcgatgaggatgttgaggtcggggcggagcttggagagcgcggtggcggtggacccgccgacgcggccggtgccgccgagcacgagcacgcgcgcgctggaggaggaggacctcctctgcgcctgcgcgtccgtggagggagcggcggatgaggaggcgacggcggcaggtggcagcggcatgcatgccctcaccacggtggccattggctctttgctcgctccgctccgctccggcgacatagccgagtggtgtcagtgctctgtgctgtcagggatggcgcaaggcaaggaggtgcttgtttggttgggtacgtggaagccggtgggccgttggttcggtcgcctatcggattatccatccatctaaccgctgtttcctccctcccttcatatcgcttacgatgggctgaattagctctatcttgggcctcagtatgaactatgggaaggtgagatggcaccagggtttcccaaaccgccgaggtcggggttaccgcgccccggcggtaaccgtgaaaaaccgtataaaaccgcgcaaaatttattaaaaattcaaactatttttaaaatttatttgaatttaaggaggttaccgcggtatttatattaccgtgcccccgcggtaagcccggtaacttttaataatcagtggtagtttgaaactagtccttattgctaaatcctctcgaggtaaactaccaataatctcacaaataagcatcttttattttattttgaaaagatgggaaatcacaaactgagtacgcagtctggctacaatctttggattaaggataggaaataaagtaaaggtcaagtatttaggtattgccgtattgcaagacctaccaaggccatatgtgtttcgggaccgtggcctaagaaatttgaggatatgccatctgatttgtgtgcctttgaattcttgccacccaatctgtgtgtctttgcaaaagtgtcactggaggtgcgaaacttttggtttcgtgccacttttgcctagggatgaaaacggtcggaaacgatcggaaaacagcctcaaccatttccgtaaccatatttttctcggaaacgaaatcggaaacggtaaagtcggaaacgaaaacgatatcggaaatatcggaaaaccggaaacggaacaatacgaacggaaacatgtcggtacagatcggaaaccggtaacaaatacggaaacattaaactataaaaacatatatttaactttacataagtatgttatatatatatacataaattcaagcttatactatataaattataaattaacttcattttagccatgtacaaaagttagagattttattgaagagtcattcaatctataagctgtgggtcaagtatagacatgtcctataatatcgacatatttagaatacggtaattaccatattataagaaacggtaatttccgcgagaatacagtaaatacggaaacgatcggtataacagcaaaaccatttccgttttcatttccatattttttaccatttccatttttgtttcggtcgattaccatttccatatggctcggccggtagaaagtcgaaaacgaacgccggtcggccggtaattaccgttaccgttttcacccctacttttgccgaagaagggtaggaggcagtgcgcgggcggtgtctcttggcggtgatgccgcgacggcaacgataatacgacagtcagctactgtaacgccccgatttttgatcggaattaaaaatcattaaataatacattttctatgaattaaataaaagttaaatcaatttaatcaagtgaactaatgggagaattaaaatttccttttaaaaatcattggccggaaatattttgtaatattctttgtgccctaattcactctccggatttttccgtaaattttcggagctcaagaaataattttaatgccacaaagttcgctaaatcaatttaaagaaaaagaaaaacaaattaaatccctttcctccctttttgggctcggcccaactccctccctcctccttcccggctaggccggcctccctttcccctccctcggcccgctcggcctccctcctatcctccctcgcaaaaagtctgttttgcgtcccttcctctctcccttcgccgacaggtgggaccggcggccccacctgtcatccccttcctccggctccaaccgctgccatggccgcccgagcctccccacgacgccgccgtttccgcactccttctccaccccgcgcgcgagtccgccggccgtgggaccccgccg

SEQ ID NO: 60454 - DNA, 9814 bp, Oryza sativa
cccaccactcaccggcgtgctgcagccagccgccgtctcccgccgactagccaccaccgagccgcgccgacaccaccatcggcatcgccgtgtcgatctccaccccggcccctactccattttcccatgccacctccgggacgccgccgtcacgcgcaccacctgtatccgtcgccattgccacctccagccgcgtcgcaacaccgctttggtccacgccgtcacctctctctgctccacaaggacaaggagaacctcggccaccttttcccatcgccggaaactctctggacgtccgttttcccgtgcgccggtgagcccttccccccttcctttctgctccggccggccacgtcgccgccccgtcctccctaacacctcccctcccatcctagcgtgcagctgccgctcgccgcctcttcctgagcgccgcccgtcgccagagcgtcatcgtctccgtccgccccgagctccgccgtagccgcctcccgttgccatctcgccgccggccaccttcttccgcgtgtgctactcagtgagctccccctcccctttcccaccgctctccgccgctctcccgcgcgtgccgccgtgccggtggtcaccgccggcgaccatcgggccgcacgccgccgcttcccggccggccggtcggcgagccggctcccgcccgcctgtggccgcctgattcaccccgggtgaatctgggccgtccacatggccgttcggcaccgccccatgtcagtgccctcgtggcgccatgtcggcgccacctttgccgcctgtctgccgtggccgccacgtggccgtccatgtggtgcacccgcgcctgtgccgcggtggactctcggtccaccgcgggccgctcctcttgcgccgctgactcgtggggccctcctatcggcgccggcctctttgatgacgtcagcgcgtcccttttcctttgagaaattaatcattaatgcgcaataaattcgttaataattctagaaattcatttaaacggctcaaaacttctaaaatccatatctaattcattcgaactccaaattgagccattcaacttgcaaaattcatctaaaattgagctctacatgtttgtttacttttcatgtactgtttccttggtttttattagagtttttccttggtttgcttgccagcgtgtagaatctgtcgtttcggaagatcgcgatcgcaaggataagagttcagaagattgtttgaagaagcaaggcaagtcacacattccccttaagcattttgatcctaatttacaaatgttttatcatttgcaaataaaattgcatgtcttgctaattacatgggaatagggtttacctatctgctcgcttgtgccatgtttacttgatatctgtcctttgtcaatattgggtaataaatcgactagctcatattacttatgtgacctagctagaactatatgcttagccatgcttaattaccactagctcagttgatgggataattacagtattagaccttttagtatcagaatgagctgcgtgctcgagacatctggacatgcttcatggtcgtaattatccaactaaaatacgactgaatggtgggctgtgggtgcatggttttgctagtcgcacacatggcaattaaggaccagttcgcgggaaaccctggaagaattcctcgtacttaccacaagccagcgtgggcaacgactgggcttgtagtgtagctttcctctagctgacgcatctaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaaaggttctgtcacggcctctttccggtatgtcgtggtggcatgtcggcgcacgggaacgtgtcgtggagctgtgtcttgtgggtaccgttgtacacctctgatcagagtaaaactattcgaatagccgtgcccgtggttatgggcggtcgaccagattcaccatgattagtcccaccttaataaaccgactcaatgcactgtagttcaggtgggttggttgggcctgttcaacgtggcgtagcattgatcagtggagatttaatgttactttaattactctactgttttactatttgctcaataaaatgtttcacaaccgcctttatgcaaatagccataaaccgtccttgtatccccttgcacgaatgcatcgttggtgtggcttgctgagtacggtggttgtactcagccttgctattattcccctttttcagaagtgtagtgcttctgagctgaagacgaggttagaagaccaagactcagacccagttgagttttgcctgtggagtggagctgaagccccactaggattgcctttttccgctgctgttgctttcgtttcggtgtgaggactaagtgcctcttctgtaagtatttacgcttttatttacgtttggaactgtatattacttgtcgttttgtgtaccctggctagtcctggacagggatttaatacacaaaatagtctggaaatttgggctaaatttctgggcgtgacagctaccgagtgaagcggaggcgcaacagctcaatatgtgaagcttggtgaagtggaggaagacgaggtggaggacccctaggcggcggctgtggaatctggtgacgggggagaagccgatggaggactggagagcaatgatgatagcaatggtcctaggtccgtgcgtgggtgctggagacccacgcgaagctaggggcaagggcaagctcggctcccaggctcacctccccccccaccgcagggcggtcctgactttttatggccccggtgcgaaactaaatttagaggcccttatcatactatataataacaatcaatagatacatatactaaattaatgttgtaaacatttaaattgcattcagaaataatatttaaatataaaacattgtacatgttacctcaaaagtttcttatgggattctatctaatcatctacccttttcttttttttcttttcttgctactcgatgcatactttctcgacaacatggcctggtaattgaaaaaaaacattattatagtagtttaactcataaattacaatacaaaattacaaatcaaaatttaaaatcgtaccaattagtttatcacaagcgtctagatgcacacggcaagtgagtcggaaatacacactagtgccttcgtcggttcgtccacctatcggaacaactgaataaacctaacatacgactatacattaatacacgggtacatggctatttacatattaacagataaaaatcacaatggtacgaaatttcaatttttcatatgacgattggttaacggccaaagcttgttatagcaaactctctaatctgatgactatacataactgaagcgggcgaagctaatccagctgctaccatgtaaatgcacaaacacataggatcctagctaatagtaatacctgaatcaagattcaagaggtggcaggcggcagtggctgcgtccaccgggcggtcacggagtcacagctgcattgcgcctcgtgccttactgccgtcgactgtcgtgcggagcagcagaaggaaaacgagaagccggcggccggcgtgcttatgcgtcatgcgtggccttgcgctgttgcgccgcgcgatttcggtgccgtgaggaggagaagattagaagacatgggcggcatcacaggatcgcgttctgttcgcctttcgcttccggcttccgtgcacggcgtgtctgttcaccttcttgttgggcctgggttggggggggggggtttcaagcggttgcactgctctgggcccccaaatcgcagcccccatcccacacacacccgagggccggccctatgcccccctctcactctcaagctccgcacattgccgttgttgtcgctgccgagggacaccgcccgccacctcctcctgtactcctccaatgaaagtactcccttcgtttcaggttataacactgtgtctagattcattagtatctatatgaatatagataataatactagaaagttttataacctgaaacggagaaagttatactcacatctcaaaaagcatgtggattgggtgatgaaaatttagaggcagacgaatcaagtgacatgtgctcaaatttctttggcttaatggccttaactgaggaatggaccacttccaagcaggaagcatgcgttcattggatcatccccgtattcccgtgtgccagtcgaccaaacgcgtccccgatgcttcgtgccgtgctcactgctcaacctttggttcaagaacgaataacgaaacatgcagcgccaaggtaagccgcacactcaattcggcggcggccgcgcggccgtgccgtcgctgcccacgcgcatcacgccctttcttctactaccttcgacccaactatacgtgacacatgttccggtgttctcacaaatacgacggagtacacggtgtcgtcgtttcacaactcacgcgtacaccgtgtgtcctcaccatcttcaagcctgcaacaaccgcatctacttcccacgtcatcatcttcatcattaatataacccgtactaccctccacagctttcttccattttgaatttcgaaacacacaaaatatcagaggacgcagacagacttgataaccctcgttccccaaattcgcaatccctctctctcccatggccggctacccgccaaaccccggctccggctacccctacggcggcgccggcggctacggtgccccgccaccgccctacggctcctcccccgccccctccgccccgccctacggcgagaagcctcccaaggaaggtaagacctcctcctcttccgccccttactacggcggcggaggcggctacggcgccccgccctccacccagccctacggcagcggaggcggctacggcgccccaccctccacccagcggccccagtcctacggcggcggctacggggctccgccctccagccagccgtacggcgcgccatacggggccccgccgccctcgtcggcgccgtacggggcgcccggcgggtacggcagcccgttcgcgtcgctggtgccatcggcgttcccgcccgggacggatcccaacgtggtggcgtgcttccaggcggcggaccgcgacggcagcgggatgatcgacgacaaggagctgcagtccgcgctgtccgggtacagccagagcttcagcctccgcaccgtccacctcctcatgtacctcttcaccaacaccaacgtccgcaagattggtaagttcatcgtttcatcgtctcactctcacccgcgaattgagtagttctggccttggggatggtgtgcgttagtctgatcgcgccatggttgctatcgtgcgcgttgttctggtcagcggcatacgtaatggtggttgtgcttcgggcgatgtgtagtcaaacgagtggcacgcgattggcacgtggctctccgcgggattatcaagcttcccacggtatttgcgatgccagtatgcgacttttggcttgcgatgtggagatggagtcttccagccagggctgtagtcagtgtttgcatcatacggctaggacttgtcgtttgggaggaagacgggggaacgtggtggggcaacgatgtagtggcaacttgttaaaagctggagtttacttttaggtgttgggatgcgggttcttttaattaagtttcttaaattgcatcaatttctttgtgggataggattcaatagaattgtggaaaatcctagctcatcttgtgtggttatcatggtgtggtctactttggtacagcatagacacatatactactagtttatttgcacaatgaacttgtaagttctcccggcttgtgatctagaaagaattttgggtttactccagtaaaagggcatgctactttggcacatagtttatacatgttaccttgtatacttacttttgttagtcagttctatttaaaatttcaaattactgctaaactgaaaactagatatttgcaactttaatcaatgccatttctcctattcttttgtcatctgttttctgtgtagagaactagagattgaatcatgagctttgaattgcttgagcagtgtatactctgaaaccagtgctatgtttcaggctatcagctagtgagcttgtatatggaattttggacttttagttctaacctgtgaaatgcacctgatttaacaaatactggattgctagatactgtactttgaacttaagcatttcttatattattcgtttttatgtaaaccacattgaatatgtgtctttgatcctttcaggtcccaaggaatttacctctgtgttttacagtcttcagaattggagggtgagatgctacagcttcagctttccttttcttctgcgcggtggaactaatgaagttactgttgaaactgaatacgtgcattttctgcttgtactgtgcagtccattttcgagaggtttgatcgtgaccaaagtggtaaaattgatgcaacagaattgcgtgatgctcttctcagtctgggatattcagtttctccaactgtgctagacttgcttgtgtcaaagtttgacaagactgggggcaagaacaaagccattgaatatgataacttcattgagtaagatgactccttcaattatgttttgcagattgctttcttagtaattgttcaagctattagcttatccaatcatctacttcctctgttttacaatgtaagtcattctagcatttcccacattcatattgatgctaatgaatctagacatatatatctatctaaattcattagcatcaatatgaatgtggaaaatgctagaatggcttacattgtgaaatggagggagtaatcattttctaaaaaaaaaatccaatcatctcaaacttggttagcatatgtttatatggtcagctaattataggattggttcaaattcgtttcagccttatttttaacattttatttttgaacatttgttgacacaaaagtagtctttgggatcaaatggctggttaaagatgatatttcctatcaaatataattgttaagatgtttcttgcacattttgaggcaataactaaaaggataatgtatgcatcaactagtctttctacttctgttttctgatgcaaaactttgaatccatctagttgttttctcatcgttctatttttcagccttggattttaaaccacttaattgtataaatataaaagacttttgttgctttgatcacgtgtcatggcttattataagccccagccaagcaagtcctaacctcaaagttaatattggatatagtttaaaatcttgatatcttctatcattccaattcggcctatattacagtcctaacactattttgtttgcctttgcagatgctgcctcacagttaaggtaatgcactaattccatcacagacgctgttaagtcctagcacaatgttctgttttcactctgttaacatacatttgtaacaattttacagggtctgactgagaagttcaaggagaaagacactgccttctcgggctctgcgacttttacttacgaggctttcatgctgactgtactcccttttctcattgcataaaatggcagtgtgctgcacagtcgacctttcaggagaccatgcccattgtgttgaaacggttctgtaacgtgtgttcatcgacttgtttttaactgagtttattgtttggatttgaaatgatacaagtgcttccctgatcgggcatgttacaatttacaacgctcatgtatgtgaggatagctccgaaaatgatgtaatgactcttccgctagaaatcgcatatcgatcagcccacaaattcaatgcatttgtgaaatgactcatagaaaggactaagccgagtgaaatgaaagtttcgaagtgctttgatatcgcttgaattatcagttgtagctgatgtgtagtccttcagtccgggtgattttggcgttaacttgaattgcagtgcagaattccatcgcagcagggcaacggaaacaaaaatgagtagcgtattccaggtcttggttgcatatctcacatattggagagttggcaaatgttctttttgaatagattttgcgttgttggtagcctttcttttgtggatttggatccgatggaccgtttgatgtaaattcaagggtctaaattatatgtagtactattcacacgcggagaaaactagaggtactgtaacaataatacaactgtagactgtagtatcagatctcaactatttgctgaaaaaaatggatggttgaaattacttgcagcaaagttagtactgcactgaatttcaattcatcttttccgatagccacgcaaagaattgctactctattaggaaggagttccgacaaataaagtgctagataggacatgtctgtattgagcttattttacccggcatatgttggtttgggggtgggggcgcactgatgtgccaggctgaagatgtcatgagataaactgcagaaactgtattttttgcccaatagatgtctgaagatgtggccaaataaactgccaatatctgaatatatcaatgttaagctcatttttggccgatagatatatgaagatgtggtcaaataactgcattttctgaatttgtacaaaaaaaaaagatatggtcaaatatttttttaacataaactgaatataaaaaaaggtggtggtgtgctggagcagtcgctcggtctaggagtgaaggcgacctccggggcaactccgtatagatttgtaatgtaagtctggtttttcacacaaggcctaccgaaggctcccacgaggggaaaaaacttatcatcaggcgcctgtgcctactccaccaaccgcggcgcatgccgctgcaaggccgtcactctcgagaattcacgatgtgtcctaactccaacccacacacccaccttgtcccccgaaaacttgggttacgacgccagcgctatctggctctgtgagaatccatggatgtagcggtgtatttgtgcccgccattctcaatgtcactaaacagtgcggtactaaacgaaatggaacggagaacacagcttggctagccagtagctgccgactccgagagtccgagtcggagactttcgaaatggcaaccctgtcgttcttgccttctcggactcgagatcttcaccgattcaaactcgaacgaacgagattatgccaaataaattcaacaccaacctgtgctcttgcctttcacagcgacacgaatcgatcgagcgcgcgaaaacagccgcatgcgtgatctttgcatgcggctagggcgaccgcatgcgaaaattcgattttcgcttgcgggcgcttaagccaacagcatgcaaaaataaaaaatcacgaaaaaaaataaaattccaaaagaaaaaaaaaaacctacccgccggcgcccgagctcaccaccgcgccggatccgccaagtggaagggcggcaggggcggcgccggcaccgccggccggatcaaccgctgcgtcgagggcggcggcacatggcacaactcgcagcgccgccgccgcccgctgccgtcgtcttcgccgcgcccgagctcgccgccgctgtccgccgtcgtcgtcgtcgccgcggtggagggcgccgcgccggatccgcgtgggaggagggcggctgaccccggatccactcgggggagggccgccgtgctctggccgccgccgccgccgccccccttctcggactcgagattcttcaccgattcga

SEQ ID NO: 60455 - DNA, 4983 bp, Oryza sativa
  unsure (1)..(4983): unsure at all n locations
ccaagcctcccggcgacgggccttcactccactacggcgggagttggcctttattaagtacaaatgaatttggatcacaactcaacagcgcggcggcttcgagggcggcggcacgtggcacaactcgcagcgccgccgcgtcatcgagggctacggcgaccgtcaggcgttcgagtaccgcgcccccgggaacaagaagacggactggctcatggaggagatcgccagcaacctgccggcggcgatcaccgacgagggcatcatggtcatctgtaaggtctacctctcgccgagggccaaggaggcgacggccaacgaggaggaacgccaagaaaccaacgtggttcccgggcccaagaggctccgagaggcggaagccaccggctacgacgcgccggcgccgccacagcccgacgtcggatactcgtactccggcggcggcgagacgtctcaagcgaccgcctcgatggactactgctgctcgacgacgacacacacggcggacgacacggccaatgccgcctactaccacggcgacgctgatgccatcaagccagatgcttacgacggcggcgactacggcatcggcttcaacgcagacggggagctggttctctgcggcaacggccacggtggcatcgggacgcagggacagacgccattggcaatgcagaacaccaacggggagatgaccttgttctcaccaatgaacggctatggtgttggcttcaatgaggaggtgagacaagaaccacaagtagaaggtgaggtggagatggataatttcttcaacgatttgttcgtcgacttcgacggcgccggtgatctcaatcccaatcctaacgggggtggagacagccacggccacatactatgtgaatgaattgaatcgctggggtagagtagtcgatgattctttatttatttatttttctttgagacgatggaagaacatgtatctgatgattctttgtcaacgtagttactgatttgtagacagatcttaggagattgttctgttcagttcatgaatgatacttctagttctttatttactctgttttatgaatttaactcctgttcaggaccttaagggtgctaatatatatcagtttcaaatggcatatatggcatcaaaagattatttcagtgtgaatccaaaccacaataacttgttgcactaacaaccgtctatcatatgaattcactgatacaataaagtctgaagttgaaagcagagtggtaaaggtgcacatcagtaacgtgtgatgtagtaacaattacatgacaggatatagtgcagtttggcaaaatttgaacaaaatcagtggatggttagtgtattccaaaacaactgaactgagctgggcagctggatgccgtattgcaccctggattctactttcccttattagtgattattcttcagctatatgtcatcagggccattggcaagtggcctgtatccatttggagttgcagaggtttcacctgaaccaactggtatacacttcaagatgacaccaacaatcaggctgatggagccaaggccgacgctgagcagccaatgttgccagttgagcggaacagtactggcgaaagtgccaagaaactctatgatcaccacttgaaatgctacggttgcagctatgactgcaatgaagatccaattgctgatgataccacggaaaacattgatcttctgcatttctctgctgtttatttcattgaatacctggtacaacgtttgccagaacatcatcattagaacaagaaattcccttgccaaatcatgattatttttttttaaaaaaaagatatatctatcagttcaggattcttaagcatgatattggaaatataagctgtgaccaaccaaacacatattgtggcagacttcggaaagacctcagtttcaccataggtcttaaggccaaaaaagaaacaccattttatgtgagtggtttgtggaaatactagcatggttacagtgttccataatgcactaacctgacaaaacacgaaggagttgaagatcagtgtatttatgatggatttggaatctgcacccttgatgttcagaaggctttctccaccaaacatgagagctccaagtacaaatagctgatacaaactttggcccatgatatttctccacatgaccttggtaatgaaactttccccttttcggacaggtggcctcttcatcatttcatcatttggaggctctgttgctagtgctaaagctcccagtgtatccatgatcatattgacccacaatagctgcacagcagtgagaggagcgctccctgtgacggaagagagaaacattagtactgtgttggagatcatggggaaccacttaatggaaatacatggtatcagatgaatactataatgttgccctcacctgtgatgcatgctgagacaaaattgataactaaagcaacaatattgacagtcaattgaaactgcacaaacttttggatgttaatataaactgcacgaccccatcttgcaacatttattatagtagtgaaattgtcgtcaagtactatgacatctgcactctccttggcaacctgcacaaataaaagacaaaattactccatttcagaagatgaaaaagaaaatacaaagtatccaaaatgggttatcagggtcaacttatttcagtaagaatgaatactgacatatttgtcctaaatatctgacttttttaatgtctattgatgctacatccataagttttgaactgcataggaaacagtacctctgttcctgcaatgcccatagcaagcccgatatctgcttcgtgtaatgcaggagcatcatttgtaccatcacctgtcacagaaaccacctcatcaaacatacctcgcaagtttgtcacgagtgtatgtttatccaatggtaaagaacgggccataacctgcaaaatatttccagatattaagtttggtcaatatttgagtaaacatatagactgaggaaaacattatgaacctgaatattcggtatcaggtccctcatctcttctgggctcttgctatggaattctggtccttctattgctacaccatcttcagtcaatattccacactctttagctatagctttagctgtatttatattatcaccagttaccattcttactgtgataccagcagacatacaggtcttaacagcatccttaactccagggcgcacaggatccttgataccgaaaatggctattagagtaaaaccacttgttggactatctgcattgtcatcaatatcatcatccacttccttatatgccaggcacaacgtccttaaagcatctgaagcaaatgagttgatagtatctaagatgttctttctctgagcttccgataagggaatagcatttccatcgccatcaaccatcatgtcgcacatctgcaaaataatttctgatgcacctttgcaaaaccatctggacgtgccactgggtaatgaaatcagcactgccatcttcttcttgactgaattgaaaggctcaaccttaaccttggtgcaggcactatactcagcatcatgaactccttccaagcccaagccaaattctaatattgctctttctgttggagttcctaagacagtttgcttgccatccttttccttgaccacctcagcgctagtattctcaaaaattccctgcaaaagcagactcaatgttctagaagaaaccacagaattaagttctcctgaaatggtgttactggtaactgactttgaaacctcagatatccatattttgtcaacaaccatatagttagtagtcaaagttcctgttttgtccgtgcagatggtaccagcagatcccattgtttcgcacgctgaaagatgtctaacaagtgctttatcattcattaactttttcattgcaaatgcaagactcaaagtaacagccaagggtaatccttcaggtacagcaacaactataatggttaccgctgttgcaaagtagtttactatagtcaatgcatcggtagaataccatttgagcagaccaaccgtcatgcctttgtcaatgaggaatctaaccagcagaactaaaaatgttaatatggcaaataccagtccaatctttcctataacggtcgcaactccatttagcttaacctgcagtggtgtctcatcctctcctccctcactcaatgtgctcatcaattttccccattcagtgcgcataccgacagcagttactatcatcttagcagatccatcttgcactttagttcctgccaagatgaatggtttgtcttgagaaacatacactgggtcactctcaccagataagctggactcatcaatcaaaagggagtacccatgtatatatagtccatcagcaggtacttgatctccaattgacagatgaactatatcaccaactaccaagtcatatatagagatcttttgtcgacgcccatctctggttacatggataaatatctttttcttttcattgtctagctccttaaattggagtgactgcttataatcactaacagcagtaaccataacaactaagaaaatgctgagtattatacccaagccatcatacatgccctttggccatccttctgttgccaaaccaactgcaacagatagcaatgcacataccataagaattataagggtcatgtcctggaatgcatcccaaacaaacatccagaaacttcttgaaggcttttctgcataacggttgacgccatatatgttctgtcttgtatctaagtcactagcacatatgccatgatcaaacgatgaacggacttttttagatatcccatctaccccaccatgcatctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60456 - DNA, 724 bp, Oryza sativa
aaggagtaaaagccaaagggcggttaagtcttttggtgatgatttcactgtgtccttcgtggatgacactcctaagtcaatttcagaagcatatgcatctcttgatgcagactactgaaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggcttgcagtcaatgaggcagataaatgtgtgtactatcgccatggtgggggtgaggagttattttgtgcttgtatgttgacgacatactgatatttgggacaaaccttgaggtgataaatgaggttaagggggatccact

SEQ ID NO: 60457 - DNA, 2162 bp, Oryza sativa
tgtggggcctctgttcatctgacctcagccaacggcgtgcatctaccgtaagagcacccgtaatggtaaagtaaggtactctctataaaatatgtatatctcagcaataaactagattaatagtaaaccaccttaatagtatgtctatatgggtatctatagctctctaatccattgccttatttttctctatagactatctccaggttagtagatagctttgctcttctcttccaagtaagaaaatatgctgacatggatctcttgtagagagcctatagataatcattaagggtgccctaagggtgtgtttagttgaggaaaaggaaatttttggtgtcacatcgaacgtttgaccggatgtcggaagaggttttcggacacgaataaaaaaactaatttcagaactcgcctggaaaccgcgagacgaatcttttgagactaattaagccgtcattagcatatgtgggttactgtagcacttaaggctaatcacggactaattaggcttaaaagattcgtctcgcgatttcctccataactgtgcgattagttttttttatctatatttaatgtttcatgcatgtgtctaaatattcgatgtgatgtttttggaaaaaaaaattagggaactaaacgggccctaaattgaagggccaatacaggagtacgtgcttttttttatagagtaaattgcatcggcggaacatgaacttgtcaggtgtgtacaatctagtgtatgaacttgtaaaatgctcttttttacataaacttgtcttccgcgtgcgagctaaggtcaaaaggatattacatgactaattttgttgatttaggtgctgattaggatactacgtaaacacatatatatatgagaagattgctacttagacatacacctgttcaataaaaatatagaatgagacatggtgattgtagagaaagatataaaaaactgagcaattataaagggttagaaacatatgaaattcaagataaactagagaacaaaattataaatatagcttgttttatgtatactaactatatgtatgtacgccatatcctaatcaatatcagttaggtaaaattaaccttgccatgctattttggacctacttcgcacggattagataagttcgtgtaaaaaacaagcattttgcaagttcatatactaaattacacccacctaataagtttatgtaccatcaatacaatttactcttttttatactatcaaaacctcttcgaaaatcaattgagaacatgcatgattaggaaaagatatacagtttatatgattttaattgaaatggaaacatgaaataaagaattacaacaggacgtaggaaaattaaaaaataatgattatttaaatagacaaaatggaaaattacacggattagagaagagataaatacttgaataaaggattgcatgagattaaaactcaggctacttattactttaaaattctgtagtggtgaagatgactccaacctgataaacacgcgacttattaaccgtgggattggcagatcggatggtgctgaggatcccatcgcacgcgctcctcccctccgtgaatcacttctctcccccacaggccagatcgcgctcactatccaaccgtcgacgccgctcccctcatccttcgccgcgcccccaccacgccttcgccaaccgccactcctgctcgcctgaatccacgccgccgccgtcgcggatcgacatcgccgctcctcctatcgcgctcctcccccgccggcaccgcctccatccatccgccgcgtctcgccgccagtcgcaccaccgatccattcctcctctgccgcctgctctcccggtccctcccgccccatcgccccaacacttcccccgtcagcaccgcctccatccatccgccgcgtctcgctgccggccgcacccccgcctccatccatccaccgcagatcgccatcgcacgcctccgcctctcaaggtcgcacgctcatcgccgcccgacaccccgccgattggggaccgaacgctgaccctgcatcgacgccacaacagtcgacagaggggagatgttgaagacctcactccaacgacggctgcgcgcggcgacactaccaggcactgagggagagaatgcggtgcgaggtgcggcggggttgttcgtc

SEQ ID NO: 60458 - DNA, 7405 bp, Oryza sativa
ttcctgcagcccagatcaaaatagctcaacatgggaatttttctagcagaggatgggcaattcttggaaaatactatatatttcttgtcgttgaatgtgatcatgtcccattattttggcacttgctgccttgattctgttgcctgtgccagcccttcagctagctctctatcacacatgaatgcgtgatccttgatggttgtatgcagttgggatattttggtgagttcatcccccttccccaccccacctctctctctctctctcaaaaccatcatttatcttcactattgacttacaatttcacttctagctgatgatgatcaatcaaagctagctcatatgtattagtgagtttatgaaaaaaaggatcagatattcaataacagagtcagctccttccgaacgatggcaaaatggtacctttataattttacttctcaacacgcacacattttttttatgacgagtttgaacttttgttctccttgtcagattttatctgaagcaagtatcatatacttctgtattagaatatggacgcaatcatatatctcctaaggtttagtgcatactctcatatttggaagtgaataccaaacgtgtatgaaatagtgcattcgatttaatctattctctcttgggcatttattcgcaaatgcaaagatttctgtaatttgatcgtagcttagattatggcaaccttggctttgtggtttgccatgtcatgtactgatatatgaatgtgatgctttaattaacgttgaaaagccatgaattatgtattcgaacgaattgattggatgtgtcctgaaatcggttcagactttcgttctttgggtactggcgtgagacggggaaaaagacgctgaagacatcaagcataacatggagttgataaaacatcgtcgactgaatcatgatttgtagtttttttggattgccagatttttttcagtgttcaacaaattttcactcaataattatttaatatattttcacttaatataatttgaaattgatatatagcatttcccgttgcaacgcacgggcaccttactagttccatatgaatttcgtagggtcctcgtacgtatagtcctgatcctttgtttcaaagttttctgtaaaattcaaattcttcgtatttcctatgctactaaaaattaaaatgggcctcagaggatacgttagtcagcacgaggaaattgcaccaagaatcgtcgcagtttagttaatggaagattaacctccgggcccctatatcatcgtcgattagttgtgttaaaacagctgaaaaattaagaggattctatgaacaagttatattcatgattatgtaattacagacttaaaaagacagcaccactacatcaggggatgataaatccagaagcagaaattggccatcggcatgcccattttcttttcttttttaaggttcggcatgcctttataagtttgtataattgtatataggccatacaagcatcaattgtttgcaagattgcgaaagagattaagaaatgagaaaatgagcaaatccctgaagacatcagcatcagtaaacatttctgtagccatctcataaattattacttttatcaaggccacaaagtctgacagggtgttgcattacaaagctattatttttctgtactccctactagctcctgcaatgcccacaatgaacaacggcttgccagcttaatctgactcagaacaacatcatcaaggggataactgtgatgcagatgatggccaaggttgcaattattgatccctgatcaaatgctttccctaaacccccaaccctggtgaagtgctgaaaagcgaggtacccagccaatgccaaagacagtgctgcaccaccttgagttcccctgtgcacaggaaatgggaattggagcatgagcacaagaacttttgaaaaaagtaagatcttacggagtagttccctgtcaacagtgataaaaatgatacatatgttcatactgatattcatatactgtaatatgattgctataaattattacttttgtccgcgctacaggcaaagactaaaatttcttatgttaaatgtcattttgaaccttttgaaattgtttgtataggctgcagatattatttccagaacagggagagtgttccacacctcagattcatcaactggtaaggagcaacactcacgagcagcatagttgacaatggaagctccagctcacctatgacaaagcataaacatctgaattcaggctgaatgagggcacttcaactgaagttgttttcagcaggaaaatgttaatgatgaatagccttacaatattgaactttttattgttactctacctggaatggagaagaacaaacgcaccaaaagagcaagaaaagcagtccactgaccatagtcactcctacatttgttgatcaaagaattaagtaggactcaagagagtaccttgttttaaaccgaacaagcatttactagatgttgttaatgaaggaacataataggtattaaacaattatttgcacggaatagcgatgccttacttgatccatgagattacactgcaaggtgctagcagagcaaacagtggcacaaggaaagatttgtgtatggctgtgcctttagcaagcaatagcactctggaaaagacaaaaagggggtaaatgatcaaataataatcagagcgtactgggaatttacagtgcagttatcacgcaatcccaagtattaaatgataaaattaaacagtagacaattataatgagattgtatttgtgctaacttgattttaaaatggttatcaatcctcaagttgcatacatatatacataatttgggaggctatattcttttagcttattttttacatgggagattatacgtgttaatttgatagtccatttcaagattatgtctctgtttgtgccctgtccttcctcaaggttcaacaatcaacatcgtcacggtcagacaacaaaatcaagataggtttgcgcatgtccctatcgagtgacagctagaagcacatgaactaacacttgcacaatcattcacagttctcacgggcaaaagatcgaacagatgccaaaccccaaaatcgccatgctgtacagcggatgaatcgcatcgcattatccactattccactaccattagacgaaagtatgagaaacagaggcactcacgcggtggccccggcggagacccattgcatcgtccgcgcgctcaggtgcgccgacgagtggcacacggcggcgccaccccggcgaccgctcgccgcctgtcccgcccccagcagcggctgcggcttcagcggcagcgaggcgcatcccctgcacatcatccatcaccacaacaccgtcagtacgaacaaatccaccgcattaacccggacagatagccgcctcacctgagcgcgcccgtccgcagagcggcggcggcgggggagcccgccgcccgcaccgcagactgccgcagcggcggcagcacgggcggcgccgccgtcgggaccgcgaggcgcagcgagatggacatcctcttctcgaatccgaaagaagaagaagaagcagaagcagctgagctttcgcgaattgtgaaggtgtttttgtctccgcgtgtgagtgacgaactggacggcgaggtgagctgctgctgttattgaagccgtgggcacggcccaccgtgaccgtccacgtgtccgggcgggtgggcggcgacggcccacgagaggcctcactttcccgtcgcgggggccgaggcggatgggcaagcgtgcgcgccgggttcgagggtggtgggggtctcgtttttggatctgggcttgcttttctcgcggctgatgactcggcgagatgagatgatcgcgtaacggcgacggcgacgtggcggacaggccagcaggaggaggaggaggcgaggcgagcgccagcggcaacttctcgtgatttctctcggattttccctctttttctcgaagaaatctgcggggtttttgggctgaaccgtaacgcaacgacgctgcattcggcccatgatgcggtgggcgcgatgggctggaatagggttgccacgaacgggttgtattgggccggaccgtatgcttcccgctgggccgagatccggcgcgcgggcctccgctgctgccttcgaagcaagagggagggagatgtggggcggaggcctgtcgccggtaggcttgggccggaggtaccgatcgtcatcccttttagtgttccaccatatatatatctcttgtaagccgccgtgcggcgttgtaacctcacccttgatatagtgaatatattttgctggctggcgcccgtggttttttctctcatgttttgggagggttttcacgttaaatctagtgtcttatacgattaatctattgttttttatcgtttgtttgtctatcactttctaacatttttatcatacctcgttaatatgtgggctccatctacagaaactgctttcaaaaccaccaagaagataatttgtacccgtttttcaaagatgggaactgtgttatatccgattttacggttggatcaagataatgaatgagggatgcaaagtagacttaatccaaaccgtaccaagggccgtgcgattcgtgtcttttccggctgggcctagatgagagggagagactgctggctcgtgtagatcatcgagacgggtcatcacgtgtacccgtgttttttttatgcacgcattaattacaacgtgattgatgattgtaatctgctcattaatatacagacagggattttcccggtcttgaaacggcatgccaatttgtagggttctctaaattttgcagcgagtaattaatgagattgcacatacaattaattctttatgttttgtataaagttggggtcaaacaattcaaacttcacgagtaaatttcaccaaactatggatattttgacaaacctatcgtagaacaacatatttagcactaaattatcacgaagctacatatttaaggtcaatttatcataaaaacccccataaaaaaatatcatacaactatatatatttaaggccaaaagttataaaaaaaatacatgtggttttggttgaagtatatgtagttttatgaaatttacttaaactttgaatactataaactttaaaatagtcgtcttggaaacaccggcagaatgatgtacatattagactttaaaatacgttaataaaatccaataattactttttaaatgttaataataaaatatatagttgatatatattttgaaaaccttgtagttatcgaaaacaacaacaattatagaattgagggagtatgtaaggattcaacaatctttaacttgttactggtatattatacactacatgagaaaacattttctcgctaacacgatatcatggagtagcaccttgtttaagttttaaagacatgtagtcaacatggagaattttgaaagcttttagcaagcccaactaaaatcattgcattataaggggtttttttttcatgggtggccttagtcgaaccatatccatgaaccataggatgcaacactagctagccctagatatgcccattcgaaacaaacactactatctcattgcacgatatggaagtatagtaccatatattcctcttacacactataatcgcaagatgcctctttctcataaaccaataatggagatgaaaacgacgtcctcttctctttctcatgaatagtgacatcaataatatctcagtgttcacgtatatgctagaactaaaagccacagaatgagtcaaagaccatatagaaaacatgcctccttggtggcggcagcaagaggatgttgcttctttgcacataaggataacacatatcatcgatctcatcagtccagtttagtatcatcaataagtcggtgctaatgtatctcaacaacaagtttacttcattgtcttcgcgaactcatgttatatctcctcctttttataaagccaatgcatctctaggtttgaaaaagaactaaaatttcacctcacatttaattaaaaaaaatcaagtaataaagttaaaacatcatattcgatatgaagttgagatctagcaaatcattttatataaatcgttatgcaggatttctttttaatcatacgagaaataggatcttgcatagcctgatcaatttaggggtagcactgattaatatttttccggattttaatacttcctggtttgatttagtttttttatccacaaggctacaaatgttggtatgttcggcaatcggtcatgtggctacggctgttgcagcctctagctgtcttgtgcacatggcactattctgggtggctgcaggctacaacgtaaccgtaacccaggcgtttgaacaggtacgctacctagttactcaccgcacttggtttctataataaacaatatggtggacatagatgccatttatactcatgaaaatcaacaaatttatttcttaatacattatagtttgctttttttagttaaactatgaaaaaacacttgtgcattgcaacggatgaagactattttgatattagtaaaagtatatgtttttttttaattttgatagtacttatgtctaatttggaactcttattaagatgatggccatatgctgtatgcttgctttcttatgccctgtcaagaattataaagcaattaggagtctgtctctcatcccgagttagcatgcgagtattttttaaatgatttcttatacaactccttatgtatttcaaaaaatggatgaacttagaaaccgactcaaatacgtacagacgacgtaccaaaatatcggtgaaaacatcttcaatttttacaacaactaatttttttaaaatcttattattgttatacggtttagttaggataaaattcactgtaggaattcgcttggatttttttttttagaaaatcatgagctgcaattaggagttcgactttcatctcaagttagcatgcgagttcttttaaagagatttcttatacgacttttttttatttctagaagcaaacaaacttaaaattcgactcaaatatgaatatgtatttccaaaagcgaacgaacttaaaaaccaactcaaatacgaatgacgtatcaaaatagaatcttgcatagctcgatcaatttaggggtagcactgattaagtttttttttctcttcagattttaacacttattgtcttgatttagttttttttattcacgaggctacaaatgttgggtctgtccggcaatcggtcatgcggctacagctgttgcagcctctagctatcttgtacacatggcactattctgggtggctgcgggctacaacgcagccgtaacccaggtgtctgaacaggaccgcaacctacttccttaccacacttg

SEQ ID NO: 60459 - DNA, 12325 bp, Oryza sativa
ccaaccccagctatataaagctcggcgcagcggagggaggggaggaagggttttggaattagaagccgccgttgcgtgggagagcaaagtggaagcagccgaaaccgaaactagccgccgccgccgccttcgcctccgccgcgccgcgccgcaccactcgcccccaaggtccctaggggtttcccgcgcgcggagtgtggggaggaggaggaggaggaggaggaggaggaggcgggggggatctctccggcggcgaggatgaccggcggcggcgcggggggaggaggaggaggagggaaggggggcgcggcggcgggccccgtcccggcggcgtcgaggaagctggtgcagagcctgaaggagatcgtgaaccgcccggaggcggagatctacgcggcgctgcgcgattgcggcatggaccccgacgaggcggtcagccgcctcctctcccaaggtctccgccccctctctctctcgcgcgccctctcccaccccgcgatttcgcgcttgtttcgatgccccctcgcggattcttccctgatgcgcccgcgcctcgagttctcgtcgccgttagggttctagaagattcttacaaccgcgtgcccctctttccgattggggctattcgttacttgccgcgctctgagcgtgcgcaccacggatgggatgagtgggaaggatgcgcctattattttttcttcatgagagtcctgccgatttgtcatgatttatccgtttatgattgtagcatttgatagatttggccctttggggttcgttgaatccgttgtacatttgtagggtttctgtttagggttcctgctaaatgttaacagtggctagcgttttcctattctggagcaggggttaggtcgatcctgcttgttatttataggaatcgatctccttttgtttcttgtctttcggttgtaggaaggagttgagatttttgggaggaaagtcaaacagatgaatactgaacttttttctgaactttgaaagaaacagctatatctttggtaggattatgtaggatagaaggagtggaacgagttcattacttgagatttgctgtttggatcaatttactgacctgtctaggtaaatacaccatgctaaagttagttgttggattggaaaagagatggttgtggtaattttagttaccaggcttgaaaagagtggaatctttagattgggaaaggagatggaccctctggcttctcatattggctatgtttgaaaagtgggaacacattactgttgcttccaaaatggctatttgcattacaatacttgtgaaattaggacttgctgtttctgcagggtggtggttgagttttgtgttcattctcggggacagttcgataggtgttttagtgccttcgtttttgctcttgtcgctctttcctgtgtcatatcttttcataatttataaagaagaatgtgtgcatctctgattgttctatagaaacattccatcatcagtttttaggatgtgttgacaataataacatatggacatggggggaagtgtaactatcatatgtatatgatgaaaggggctattagatgatatttactgaatttcattggtcatatagtggtagtaagcaagaaactcaggtccacctttagcttatttatatcgtagtgtgccatttgaactcgtggctttatttctgtaggataagtttctgagcttgcagtgatttgtggcattagtcttgggctcttctctttgcaaggaggctttttattaattgaaactccatgcattttctttgatctgggaagttgaagaaagattaactgtcagacatagttggtagcctatctattccatctatgatttttccatggcatttttcttggtttgacttttacaacatgttacaagaggcattgtgtatttgtgttataactttcctgaacattgttagtctcctactccccttgactccttggtaatctattgctgctaagtttatgagggatgatggatgagccaggagtgggaattgccaccttaatatacctcatctgtgtagcatgtgaaagtcataatacagcttcctgaaatggcatagaggtgtcatttgggttttatgactactttcttgttcagagtttatatgctgtactgttaccacatattgaatatcttattttctgcacacatacttaatgaatgttcgaggaggcaagtgttaggttgttttgtcaaccttttctaaatttcttctcatattgtcatgccaattttatttttgttcaacattattttttgtatgcctttgttgatcatatcatccagttatttttagtcagtttaaactgtgatctgacaatgcaccccaagataaatcagttatatttatttcagttgctcttgcagttatgttaaaattgatatcttatgtaccgcttttttcagatacttttcaagaggtaaagagcaagcgcgataagaaaaaagaggtgtgccccacatcttgcattgctcgccttattttttgaccagcactcagctttgattcggttgccctatatttattttcatcatcaatagcataaagaaaacattttattcatgtaacaattagtttttgtctgattcccctgcgtctaaattaagcatatggaactaatcttttggagttttggttattttgaaaattctctagccttgatgaacttaccattatagtcatgggcactttcataggttaaagagattcctgagccaagatctcgagcggcaagtaatgctgccagtcgaggtgtaagaggcggtgcagatcgaggcgggcgaaacagttcttttcactctagctccattggtaataggaaaaaccaccatcagtatcttcaaggttatcattggttgtaatttcttttcacattttttttttgttcatttcaatattcagacaatgtggcttcaaggtcaatctcagggcctggtatgacatcaaccaattccactcagaagcaaacaattccaaggtaagagagcttcccttttgttgcatatattttaagaagggcttgtacagcaggtctgcctttttagaaggcataccatttttctagttgtcttttctctggagcctttatctgtttgcatttgatatgatccttttgcattattgttaattctgctgttatgtgtaaaatttcatgcaaacagcataggtttttttacaaacaattctcttgttagatgactatgactcaatagttcatatagttacatataattgttatctgagactatcgtttgtaatgttgtgttagattcaaatgaaccatatggaatatggatgaacttggatgatgcatcccacatgaaagttaatgcatactacaaattttatctgatgcgttgatgatttcataacgccttcttatttcactctggggaattcatgctcttttttatctgctgtagttccttggtaaacaaaagtgtggttgctgatggaccgtcggtacctgcacaatcatcatctgggtttcagcacggttggtctgggacaccaggtcagttgtcaatggccgatattgtgaaaatgggcaggcctcaggtaaagcagtcctctagcaagcctgcggttactgcagacaaaggatatactggacaatacccatctttgcccagtactgtaaaccagaatttgaaacaatctgctagcacagtttcaccaacaaatcctgaccaggggttacattctgctcaagattctattcatcccaaggatcacaaccactcagcagctgtcaacaagcaggcatatgataatgattggcttccacaggacgagccaccaccaggaaatcaatcagccttgcctgagacatccggtgaccaatcattatatgagtcatcgctacagtcatctacactggttgctggtgtgattaacccccatgaaaattctcatttggatgagaacagatcagctgcattttcttccgagagacacttggaacatcatggaggcgattctgaatatgatgatggactgttgcaagaatcgagtacctatctgcctcagaagaattctcatgcagaagatgaaggtgagtgtagatatgagtttatgaatttgcttaactttagcatctccatattctgtcctgctggaataacctggatctttggtgttatgagcttattgcattcgttagcattggaaaaggcagcagacaatttattagtaaatacttttggtattccttccagaatgccattgatacttgcgtaggtgtgagatgcaacttacaccctgtaattgacgttatcaattcctatgttaatctgggtatgttgaatgcatctctgttatgatagggtttagggaggcagttgttgcaactggcaagtaatcaactttactgaacaaaattgatatatgatggttcctgcatctttttagtagtagaataccagtcttcagatttctgatgtcatgctgttactttcttgatgaataatgaactttagactgtcgtgttatccagtattaaaagttctgtaaggcaacaacaggtcatgcagtttattgtgaataggttttacagcatatgttcctttctggttgcttgttcttttcctggacgctgttgcattctggctttggctgtgcatgacctgcatgtgaatactgatttctttttactattcttgcagttgagggctccaattctgatgtagcgttagccactgaaaacttccagggtctaagcctacataatgaagagttagttccaacaaaattagctgaagataaccctgcagttataattcctgatcacctgcaagttaccggctcagactgtgtcactttgagctttggcagttttgaatctggagcattttctgggcttctccctgttccatcaaggagcgctgatgataacaatgtggagttgcctgttatagaggaatctgtacctctagatcaaattgattcaaggttaattaagtttgttcctgccgtctttatttcactccacatattgcttgtgacatgactggaatgccatttttttaatcttgcagagatcaagactattatgatagtgccgcagttaattcgtcaggaaatgagaaccttgatactatcataggaactaacatggagaacattgatgtaccttctgtttcacagcctgatgtcctgagacaggaagtgcttgatcattccggtcttcaatataacctaccatctgattcaagtgctgcatatgcaaacactacacagccaagtacaatggagtcctcacaaggaaacaaccaggcgcacactctttcccatctttcaaacttactggtaaattgttttctttttcctataatcttcacttttcatcattcatgctgaattgctaacagtactaagtaactttagccaaactatgttcttgctacatcaagtaagataactagttttacccttgattggaaaagagccaaataaaaaggtgccatatagacccattcttttgctcataactcttgtctcaagatattgaccacagatgtaaatcattgcttcattctggaatgtccagaataacattgggagctggtctttctggataccagtttttctgtcttctgcatatgcatgttattcaagtcagctaattgtgctcctgcataattcttattgaactcgtttattccccagcaagcaaattcattacacaacagcctattggggtcaaacattgcacctcttcgggacttggacttcagtttatcacctttgctagcagcacaatcaatgacaaaatataactcagctgcaccaactactactggaccagcaatctccatgcaagaggtaatttaactacgctggttcactttctcatggtgttttctctggattcatatttcatagaagtataactttaggaagaaaaaggctccacatcctttctttatttgaaagatgaatttacaagggtgtgatggtgttggaattttttattttgtgtgcatatacagttaatcattcagcaacaagtaatctctagttctctaattttcttcacacacatgtacatatttgtttcagactctgaagccaggagttttctccaacgctcaatctacccaaaatcttccaagtactagtatagcaacggggcctcctctccctcagcaattagtccacccttactctcagcctactgtaccactggcgccttttgcgaatatgattggttatccgtatttggcacagaactaccctgctgcttacctaccatcagctgccttccagcaagcatactcgagtaatggaccattccatcagtctgctgctgctgctgtaccaggagctatgaagtacaatatgaatgtgccgcaattcaagaacaacctatcggctacaagcttacaacagcaaccttcttcagtgatctctggttatggaggatttggaagctctagtaatcttcctggaaatttcactcttaatcagaatgctgcctctgcatcaacaaatcttgggtttgacgaagcattgagcacgccatacaaagatcccagccaatatatggccctccagcaggtaacaattgcaagcagcccttgtgtttctttggtaatttatatgctatataataattctgataggcacggctcggttcgaaggttttggatgagtgcttggcttaccggaaaaaacacttaattatcatataattaattaagtactccatttattattacaaatttgaaaaatggatttatttgtattttctaagaaaattctgtatagaatatgctttttcaaaaatcatactccctccatttcatattacaagttactttgggtttgttctacgtcaaaccttttcaagtttgaccaagtttatagaataatatagaaacatttcttacacatatactattaaaaaacaatcaatgatggatttaatgaaagtagtagctatataatctgaaaagaatgggacattagtcacaagttactttgggtattcctttcagggtgacaattctgcaatgtggcttcatggtgctggttcaagagcaacgtcggcgcttccaccgagtcacttctatggcttccagggacagagtcagcagggtggctttcgtcaggcgcagcaaccgcagcagcactcgcaattcggtggccatgggtatccagctttctaccattctcaaagccaagagcaccaccagaacccggccgagggaggcctgaacggtttccagaatgcccaatcacagccgtctcaccaggggtggcagcagcacaccggctactgaggcctttaccctttgttatagttggggttaagttgcttgccgaccatggcgtgcgtgtatcctgaccagctgcagggtttaagcagctcggactagctgagcctgtgcctcgagcgctgaggatggagggtccacgccattcaaccaacagtttcgagagtgtttttaacatgttcgcgtgtgttcgtcagacaagaatgatttgtgctttgttttgatagccgagttattatatgtgcccaagtgcagtcttccttgtaactcttcttgagacctaacaggtcaccgttctgatttctaagattagtatctatcatcttgacctttgctgatgctactttctgattatcacttctggagctgcgtcgatgctttggcttttgctattgcggcaacgcgttcggtgctgctgccggcggtggctgctgctgctgggcggcggtgttggcgatcacgaagtgcagagcactgttggggtctggccggaacgcccacacggcgacgtcgtccttcacctggacgccgcggtcgacgagccttgtggtttctttttgccggattatggtgtggcaattggagagcctcctggtcaactccatggccatcacgtcgagcggggatgcacggtagacgaccacgcgcacggcgagcccggggctcttctcccccttctccctcggctttggttctggcgatttctttttcttgtgcaagaactcctccaccagcttggcggcctcgcgctccgccgctgagaggagcggacagaggcggaggctggcggcggcttgcgggatgaggaagcggctctgctgcgccgacaggtcggaagcctccactcgcttcctgcagatgaagtgcagcggcaggtcgccgcgtaggcctagtagcggcagcagctcgccgcgtatccacgccggcggcgggggagcggcatcgtcatcatctactctttgcggcacggcggcgcgagggacgtgcgccgccaccgcctgcaacgggacggcgtcgatgggctccgctgcaatcggtgcagccgcgtcgatgagcatgggctcccccgcggcggacacttccgccgtggtaccggatgcgctcgtggaatttccaacggcggcggcgctgttcgaggtcgttatcgtcgtcgtctggggggctaattgggcggcagcgtcgccggggctgacggacgacggcgagagcgacaagaagccaggagccacctcttccctgaacctcgcgagcgacgtcgtgacagtcgcccacgactgcaccttctttgcgtccttacgcgctactatcgaactctttcgcttcatagcgttgagctactaataatttaacttgggtttaatctcctctaatcccaaactatttttttaataatggccaatcaaagagtaattacagttccgattcgacttaggctcgcgtcttttccgacttgtagtcggatgctgcgtccgtgctatgttctgtttgagcccggctagtcgtggaactggcccatgggcaaggcggacacagcggcgggagggacgtgcgccgccaccgcctgcaccgagacggggtcgacgggctccgccgcgtcgacgagcatgggcgccaccgcggcgggcggcgggcggcaggcactccttccgccacgctgccggacgcgctcgaggaaattccgacggcggcggcgttgttcgaggtcatcgtcgccgtcttgggggctaattgggcggcatcgcgggggctaacgctaacggacggcggcgagagcgacaggagccacctctttggggtccgtgctagtcgacacaggcacacagcccacgacaggaaatcagaatagctcgtcaatggggtcgccgccgccaccacgctgctgcgcagtcctaacgtcgcgcccaccatggttggcagttgctcgaccggcggctattcggtaatcgccggtcgctatcgtgcccgtgtcgtgccttttctaggcgatgtcgtgctgagtcgtcgctagtcgttacatgcgcttgtcgttgtcgtgttggcacgttggcccggatagcagcccaaacacgacatggctagacgacccatatctaaatgggctgtgttattcctagcccgttaactgtacatgcgtcgtgctccagcaggcacggagagaccgagcatagttgacaacctattagtgcaaaggaacttcgctgtcagttatgtgaacaaagatctttttttttttatgaaatgcttgttaaacccaagcatttagcactatcagaaagctcctcttacctttgctaaaagtaattagtccgcagtcactttcatcgcccaggattccgcttaacaaaaggaagcaagctgcaatggcgtgtgaagagtttctcaaagatgataagtttgtgggcgacaaagagagagataagtcaagggctaaggaacagctagttaggttgagtgcttggcaattgacagtttgacattattcgtagcctctgcttgtctgcaataagccaataacaacagcatcatgagagaaaaaaattaccattccaacgaacacagcgaaaaacagcatgcaagagagcgtttcctttaagcaaactgtgaagttgacattgtgcaatagagactgaatctgatccagcccttcaaaacttcgatatgtctaacttgatgttagtccttgagaattgagataatcagttgttcatagtttttatatgcatacgaaagatgcccagagcagctacaagttgacttccacgagcctttctttttcataattcattatgtaattactcgtaacattgttcagctggtgacatgcgatgcacaattaagaaaaccatgagaccacttctcctcctaggctttttctagttagctatataagaatattcagagacagcgaaactgctatgatctgtacatcttatctcctcctctttctgagacgaataattaatcgatcaattagtggatggatgctctcgcttaatctgctctctctcgctgagttcacaccgcgacggacggctggcccaccagatacacgtgagtacgaccccgcgttttttggcgtgcacgcgacggggtgcgtggagcgagcgagatcccccagcttactagcttcggtagcccgcggcgagcggcaacgcatcgcttcgcgcacacgcaatccctaccactccttttcgtcggcggatgcaagcggcagagaaggtgaggtacactgccgctgaaaaccgggcccagatatgatttgggcccacatgtcagcctgtggtgacagtgagtgctttggactggggcctactgcgtcgagagctacacgtgtcaagtgaggagattccacgaggtggccatgcaagcgatctactctagctacgtggaggtgttacgcatctgaattcgtaggaaaggcttcacttgcaaatcattgctactcctgctttcaatacagtactactgctgctggtaaatgcagatttgatattggaaatggcctattggcttgtatttaaatcttaagcattttcttaacaggatgtactgacttaatcatcaatgcagcatgttgtttatgaaaaaaatattgctatatttttgtagctagttgtttctgtgaaggtgaaaatctgagcagggaatatctcggtgaaggaagcaaaaacctcatgctctgaatgacccattttctttgacagagcccttgtttagtttctaactttttcttcaaactttcaactttttcatcacatcaaaactttcctatacacataaacttttaacttttccgttgtatcgttccaatttcaaccaaactttcaattttaacgtgaattgaacacaccctctgaatgaccattttaatagttaatgtatcatgtaatgagatattccgaccctctaaacgcaaagcacgtggaaaaactgcaactaaccattctgaaaaaaagaaaaaaattttcataggagtactagtttaataaggctcatgaactttgtggattaacatcccaatccaccatgcaatgggtccactctcgacaaataaacaattgagacgaagcaaacaaaaactttatgaacaagtggataatactataatccttcctccagggctccaactcgatatacttgccaaatactccgtatatacaatttccttgtatttaatgtacttgcaaaaaattaatgaaacctcgttacttcaaagcaaagaaaccatcggattcctaatcaggtacagaagaaatacgaacaaaaatcaattagtaaatcgcgaaaaagcgacgtcctaactgagtcaggtacgtactcctcttgcccccacgcaggccacttctccgggtaaatatagcagtttcccaccccactcaccccgatccaacggctgagccgcagccccaggaggatcggacggttggcagcgcgcgcacgcctcctcgcctcgctttatatgcacgcgcggtcgcctccaccgcccgtagtgctcggcacgtcggttgttgctgttgctgctgctgctcctcccgttttccggtgagctctcgtggactccgcttgacttgatgtgggggtgaatctgtttgataggtgggggggattttgcggtgttcgtgtgagttttggtgtggatctgcttgttcctgacttcctgtgtgtttgagggtaatctgggttatttttacgggttgtttttggtgttttttgaggagttttttggtcggatgggtggtaggtctggatggattgttttggggcagctttgatcggattttaccctgggttggataactgatcggtgtttttctgttcgtggtttggtgttgatttttcggttagtgcatcggtgttttctgtaactgctgctctccgattttgagttttattttttttctgttttccccttcagttctagcctcggttccatggctgaaccttcgatttgattttgtttttttttcttatttcgtgagttactaatcttcgatattatcgactaatttcactgtg

SEQ ID NO: 60460 - DNA, 4071 bp, Oryza sativa
atcgcagccatgggaacccgcagcgtggccttggtgctcctcgcggccgtgctgctccaagccctcctccccgcttcggcggcggagggtttggtgcggatcgcgctgaagaagcgcccgatcgacgagaacagccgcgtcgccgcgcgactctccggcgaggaaggggcgcgccggctgggcctccgcggcgccaactcccttggcggcggcgggggtgagggcgacatcgtggcgctgaagaactacatgaacgcgcagtacttcggggagattggcgtcggcactccgccgcagaaattcaccgtcatcttcgacactggcagctccaacctctgggtgccgtcggccaagtgctacttctcggtgagtccctgttcgatgcactggtcaaggggaattctcccaagagtcttgttgcgattgcgacctgtgctaatggtggatttttttttccttgtggcgattgatgcagattgcgtgcttcttccactctcgctacaagtccggacagtcgagcacttatcagaagaatggtccgtgccttaaaactttccccaaccgtgctagtttatgttgtgactgtctgcctctctcagtttacttggatgcattgacaacatccttttttgctattactcgtatttgctctatagctggtggcatatctcatgttgaaatttgcccttttaatccaaaattggatgtaattgaaagaatcctacgtggtagttatttggattttggtgtgaaaaaaaatagccttgttagaagaagcaaaattggatttagttaaaaggatactagatggtgttatttggattttggtgcaaatcaaattaggaggttggttttattcaagttaaagtttgttttaaaaaaattctcctaaaaagatagatactagatttgcatatatgcattgaaaattacatcttcgcttggcggttatacttttagtccctctaaattgttcaatcatttatgatgaaaaggaaaatcattttatatcacaaagtatttatgatgaaaggggaaaaatattctgcatgggtttgaacaaaatacgtggattggtgtagccttaacatacttgaaaagggtatgatgttgatgtagtgcccacatggtgtcgcttgacattaaaacgatatgcagtcaggattgaggaacattgctgacaatttactatcgctgtctgtgttgaccacaataattcagatgtaccatcctatcttctaactagaaagatgcatggaagtttcttacattatttccagcacttgaaattttagtgaaatatcattaaaacataaccacttactttgctgtgatatgaaataaatgttttatttcttggaaagtggtatattcatatattcttacagtaaatttattgattttcttttcatttatttctaaattttaaccacccttttggtagcttaaggaaaattgtatgtttgacagtcctgttttctgttgtttcatccctccaggaaaaccagctgccattcagtatggcactggttcaattgctgggtttttcagcgaggatagtgttacagtaggtgatctggttgtgaaagatcaggtctgcactatatatctcggttaacttactgattattatctctgatcatattgccccaaatatttttaacattgttgcttcaccgctttaggaattcattgaagctaccaaggagccaggtcttactttcatggttgcaaaatttgatggcattcttgggcttggatttcaggaaatatccgttggagatgcagtacctgtgtggtaagacaacctgacttacgtgatctaagtttttgatttctcactgtggttcacagtagaagagaaggtgctcttttgcatatagtgattatatttgtatgaatcttccactatctctaaccacagttcatctatgcacgatacatttataatggtgaagaatcctagatattgacctgctgattaacacaataggctaccttcattctgttaaaaccacgtatctcaaaatatttggctggttgttttcttgcatatttctgttttatttttctcattatatatattttggcgcatttgtcatgataattagatttttcacgtatcatgcacataatatagcagatccatagtccctaatgatatgtataaatcacaggtataagatggtagagcaaggtcttgtcagtgagcctgttttctccttctggttcaaccgtcattctgatgaaggagaaggtggtgaaattgtgtttggaggaatggatcctagccactacaagggcaaccatacatatgttccagtctctcagaagggatattggcaggttggtcctgtttctgctaagttctgtagtgttttcgacatttgatgtaatgtttgcattgactttgtgcagtttgagatgggcgatgtcctgattggaggaaagaccacaggtactgactcttgtttttcatatccgatctgtctaaatgagaaataatcttacacatcgttacacctttgctgctatcaggattttgtgctagcggttgttcagctatagcagactctggaacatcattgcttgctggccccacagtacgtaataagcttttgtttatacttgttttttttttatcatgatggcctacatttttcacaacagtaataagctttggagatctctactaaatttcacatctcagttttatttacttcgaaggaattatcgtcttaataatgagcctttttgaacccaacacatacttgtaggttttttttttaggtccaaaatttgcatacggaacctgtacagggtgcttaacaaatataataatgcagtaccccaatctatgttcagaaatatatttcctttgtttttttgctctgattcttggatcacctttcggaagcttctagccatgtctcgtcctttgtcctatcatgtattgtttgcatatatgaagtgttgtaaatgtagctgtactgtagcacagtatttattatatctaattattatctagagatgagttgtgctgctcaatcaattgacccccaattcatcatattacgcaaatgcatacacacaaaaggaacacctgttgggtctaatgtgcaaaggctttccacactcatccctactctttattgtcttcatactgtcttgtttgttcttaccaagttccaatgagtggttcacgagttaacacaatcatcgcaggccataatcactgaaatcaatgagaagatcggtgctactggggtagtcagccaagaatgcaagacagttgtttctcaatatggacaacagatcctagatctgttgcttgctgaggtttgtaatttgcttcaattttctggaaacagcttttgtcaattatatctttgatgaattaaaacaactttctgggattatgttgcagacacagccatcaaaaatctgctctcaggttggtctgtgtacttttgatgggaagcatggtgttaggtaagaactgcaaatgtttttcaagtgtctgaatctgtaaagtaggatattttcgttttgactcgattagcgattttggtgtcaagtgctatatcaattatgacttatttgagatcggattcgtaggcaatctgtactcactctcatttcttctccatgtggtatgtaaacacagtgctggaattaagagcgtagtagatgatgaagctggggaatcgaatggtctccaaagtggtcccatgtgcaatgcctgtgagatggctgttgtatggatgcagaaccaacttgcacagaacaagactcaggatctcatcttgaactacattaatcaggtgagcttagttaactcctgctctagggccattgtactggtagggatagattttccgttgcttaactgttatcaattttacagctctgtgacaagctcccaagtccaatgggagaatcatctgtggactgtggcagccttgcatccatgcctgagatttcattcaccattggaggcaaaaagtttgcactgaagccagaagaggtgcgatgatttctttatggtttctcttcttttttttcttccct

SEQ ID NO: 60461 - DNA, 3852 bp, Oryza sativa
cagtggattcacagccatggacatccctcctccccgtggtcctctctggtaaactatgcatttccaaacccttgaattagcagtgaaataatttcacttcttgtcatttttgatctttgactgatgcaccctacaatttgcaggatcctgggtgacgttttcatgggtgcctaccataccgtgttcgactacggcaagatgagggttggcttcgcgaagtcggcctaaacgtgttgttgtcacgttcctaatgacgaggtggacgcatacgccgagagaagaagaccgtagcttttaactagcgtatttatccggcgatgtgtgtatatatgcatgctacataacatgtttatgttttccaaggcctgagatggcgcccgtctattttagcttggcaagaatatctcggaccagtctctgttcgaattctcgtactgatatgtgaacttctgataacatgtgcactgtgttttgtgactgaattgctagtcagtccgaaggttaattatcccatggttgatgtgaagagagccaccggattattgcagctgtgatcacgtggttaagccttaaaagtgtggtggtttcttcagctaaatctaatgtggtggtttcttcagctgaagtcttttcacctaagtaactcttactctctccgtcccacaataaaagagattttttttcttacaacattcgaccactcgtcttatttaattttttataattgtgtttaaagtactgtagataataaagtaattcacaaataaaataaataacaatttcaaatttttttttaataagacgagtggttaaacgttacaagaaaaactcaaaatcccttttattatgggacggagggagtactaaagcttgttaagttcctcaaaccagaattactctgaaattcagaccaactccctcatgagccgccggtacacctgcaaaatttgacttcaaaacccctcaattcccttatgtgccgccgaaacaccagcaaaatttgacttcaaaaccaccaatataagtgatccaactgatatcaaccttcaacattcaaatttgacttcaaaaccactgatataagtgatccaactgagatcaaccttcttccaacattctcaggcgactgacaaagctggtcaagtaaccaccgaaaatagacacaccctctttttttagaaagaatccgttgctggacgctagcaatggcagcaggactctccatccaatccaattcataaacaaaataaaaaaaaatctagtaaaagaagttgtcaacggcagtctctcctccatccccctctccgatctctctgcccagatcacgactcgctcgcgatgcaagtccgcaaacggttgccggatcaagcatggactctctctctctctccacgaaaccgtcagacccgatcgcctcctctgaccttagacttgcttagacgccgcgcgcatgcagccaagctgcgagctgcgatgctgcgagcttcatccattcccatccatggcgctcgcgtcgcttgtggtgtccacgcatcctcagcttaaccccccctctctctctggtcaatggtcaccaacactgcctagaatgatggactcagctccaatctcatcccgccacgtgtcccccgtctcgtcgttatatatatacacactacgccctcgccttggcctggtcgtctactctccctcccaccgctcgtctgtcaccgccgcgcgcgacgcgacggcgaggtgtgtgtgtgagaatggagtcctacgtgggtgtcaaggggaagaatgtcgtcgggggcggcgacgtcggcagggagatgccggtggcgccaccgtcgtcgtcgtcggcggcggtagggatggtggagttcccggcggcggcggcggggctggggtacgccgggatgacggcgaaggaggccgggggtggttaccaggagaggagggtggtggtcggcgagatggacttcttcaagacggcggagaagcgtggggagaggaaggagccgccgccggcgacggcgacggcggcggcgagtggacacgccggtgcctcgccggatgacctcagcctcaacaaggacgacctcaccatcaatgtaacggatcagttgatgcgtgatggtttgagagatttttttttcttggttgatgcgtggtttaatttcgtgatcttgttgcgtcgcagatgggattgctcgtcggccggaggaggaacagcggcagcgaggaatccatcgtcgacgatggcggcgtctcctccaacgacgaggagcaccgcgaggccaaagctgcggtgagcaaacagcagcaaaatcaataggatctctctgtgtttataaattcgcttttgaatttctgaatgcgaggaggagagatcggtctagtgaccgtttgccgttttcttcatcatcagaaattctagttagtgtaaaccggagaacaacaaaaattgttgttgccatgatctgatcataattttctctcggaatttatgatcagctggcagtaaccaaagctgagattgggcggctgagtgaggagaacaagaggctcaagaacatgctgagcaacgtgaccacgaaatacaactctctccagatgcagttcgtcacactgatgcagcagaggagatcagtcctagccgctccgatccaccagcaagaggtaattaagaaaaaagaacaaatcataattattaccatgcaagattcaagatcgctcatggcagcaatgctcaagatcgctcatgtggtgtaattcatcgacgatttgtatgatcggcagctgcttgatccggagaagaaggagcaagaggggagccagcagcagcagcagcagctgatcccgaggcagttcatcagcctcggctccgcgtcgctgcagcccgacgtcgaggcgccgcactccgtcgtcgtcgtcggcggcgatgtctgcgcgccgtcgtcgagcaaccccgacgcggcggtgccggcgatgatgccgttgccgcatttcgaccaccacaaccaccaccaccccatccatggtggaagggagagggggagcagcccggcggaggccgaccaccaccgccaccatcagcaagagcagccgccgccgccgccgcagcagcagcagcagttgccgccgagctggcttcccgccgacaaggtgcccaggttcctccccggcaaggggcccgagcccgtcccggaggccgccaccatgcgcaaggcccgcgtctccgttcgagctcgctccgatgcacccatggtgtgtgtgtgtgtgtgctcgatcatgttccatatgcagctagtgttcttcttcttcgcatggatgtttgatatggtgatgtgcagatcagcgatgggtgccaatggaggaagtacgggcagaagatggcgaagggaaacccttgcccgcgcgcgtactaccggtgcaccatggccgccggctgcccggtgcggaagcaggtgtgtgtgcaagatcgccggagcgtacgagcgtgtttgatttgctgtgtcgtcgtcgtcgtcaatggcgcgttcgctgatgtgcggccatggttttgcaggtccagaggtgcgcggaggacaggacggtgctgataacgacgtacgaggggaaccacaaccacccgctgccgccggcggcgatggcgatggcgtcgaccacggcggcggcggcgtccatgctgctgtcgggctccatgccgagcgcggacggcagcctcatggccgggtccaacttcctggcgcgcgccgtgctgccgtgctcgtccaccgtcgccaccatctcggcgtcggcgccgttcccgacggtcacgctcgacctcacgcagacggcgccgccgccgccgccggcgtcgtcgacgca

SEQ ID NO: 60462 - DNA, 5376 bp, Oryza sativa
cgatagctgtagtagagacgacaagataggagagcaaaacagctaaaaacttgattcgctagctgcaatttttttgcttgcttcaagtttcgtttgatttttgctcgtacgtaatttttctttttctttcaacaaaattagtttgaattacacaatttggagtagttttgatgttttttttttctccgtcagtctcctcgtggatggagacagaaattttggtccgtgtcacatacggagtacaaatttttgctgaattttatgtcagcaacttggagtaacaaattttgtgggagcctaattaaagggtgaccattttgtgtgaatttggactttgaattggttagttggtcgcacgcagcgcaaggcgtggagtcaatttcgtggctacgttgcctcacatagagctgagtcacgctctgacatttttatggtcgtctctgaatcgcgagaagaataatggctgatctcgtcacactgctgacttgttgggcttacaaattcgtgccatcacgaactgaccatcctgtggtaggagtattcaacaaaaacagggactaaaatttagccccactttaatccctccaaccaaacaccacctaagaatcagtactttaatgtgaacagtattagtcaaatgataaattttggatagtccatacagagctaagcagggcaaagcacaccagttttgatcgaaatattagttcaaaagaaatggaaaaaaatcatatccacaagcattgccatatgaggtaccgtatgtctgaattggccttttagaaggaaaaaggcaggagctctgcaatttatagattcaggtagtataaagccatcacattacaggtttagggtgatggccacttaagcaaaatgctttcaaaggagatgctagtctatgaaattgaaagccagatcacgctgatttatgtcttgtatcaccaaagccgccgtctacatgttgatgaacatattcaaaaactttacatttttctcaagccaaatgtcccatcaggctataagtgccccagtattttcttttctcttctccttgggttttatctcgcaaaaggattgcctccaatcagctactagtactgacttggctttcaaccatccaatgatacagaccagaactatgtttctttctattagaaacatcagtttcatgatacaacagatgtacatctatgcaataatagagtgggcacacaaaattttgtggagatacctcactaattaccgagctaattcgaccttcactcatcacctcaatcataaacaaagctaacagaaaaaaaaaggtaaattactcctagctgtgacagcctgcataacaatctgatggtcatagtgcttgaatctcccctccatagccataacgcttcaaaagaagttcatcctgccgccagttttccttcaccttgaccattatctgtccaatatatagtatatttgatattaggaaactgctcagaacaaatcctcaaggtagatcaaaatttcacagcctccaaacaaaggaagcagttactacctcaagatagaccttcttttgtaggaaatcctcgatatcaagtcttgatgctgttgctagcatcttgattgcttttccatcctgcagttgccaaacatgttacaaaaatatatcccactaaagcaatgcaaataagatgatttcatgaaactgcttcattctacccaaatatgcaccccaagttatggtattttccttagctatactcaatgttaacttgaaaaagattaaacttaactgatttcgtaaccataaaatcctgaaatattcaggcgcacaaaggtactgttttactattttttttaccttcccaagtataatgcttctttgtgattccttctcaacgagtatctcaacttgaataaaatccttggctgtaggtctgctcttgtaacttatgacattaacctgtcataaacaaagtcgcacatctgacacatgctggcagaaaaatgccgcacaaaattgataggtgcaagcaccagaagatatacctgacaagcatatggaatttcttgacgatactgaagaaaaatcttttctctcactatttcccccacaaaaaatctctcagggtgctcactagctatgtcctggaacgagaatcacatgaacaaatatatttgatatcttgtagtatcagtatttattggctgcagttaaacatcaaagcaagcactggatatcgtgagtagcactatctaaagaacaaacatgatgctatggaaaagacatattatagtcacactatggctatctggttttacatgagtacagaaaaatttgtgccaaagatgaagaaacacttgcagaaatagaataagaaaaaaaaattcatctaatacaccaatacctttggatagtaagcaggccccagagggagctttgataatatccactccttgatatcatccactccatgcccaaatttagcacttataggtatgacgtcatcagcattagtgaatttttgataccactgtgaaaatcgtagccagtaaatcaattacatcgaagtagagggaaaaacaaaaccatctccaaatttttgtaacgatattttacctcaagtttctttgcaatttctcctggctttatgagatctttcttgtttaataccaacagtactggaagctcagtatctttgttccccacaccttcttccagtatttcatcaatctaaaaggtacaaatgtcagaattttagattgtatattggcataataatttttttttcataattcagtcatctctttcctatgttgcaataccttttcaggcattttgcaagcatcaacaacaacaagcacacaatctgcactgccaacggcactcctaacattcttcatcatcattgtgtctagcttatgcatttcctttttgatgacacctggcgtgtcataaagtattatctgcaaactaaatgataactcagattagcagtgagaaattaacatttccccctttcatagtctataatcctaaagctttagaaactaaaaggtgatacctggtattctggttcagaacatataccaagaatgcgatgccgtgtggtttgcggtttgtctgtcacaattgaaagtttctgaccaacaatttggttaattagggtgctctttccaacatttggctttcctaatacagcaacataacctgtgcaaacacatggtatatcaatattacaacaacatgaaaaaatattcatctgcagaatagtttcatttggagatcataaactaaaaaggctgttatttcagaatcgaaatgaagaggtgaatttcacagaagctagaagcctcaccgctgcggtggttggcacaatgagaggtgcctagctcctccgactcgtactcgtcgagcagacacaggctccggtccggcttctcgatgagctccagacgcggcctcgtcgtcaccactgcagcctcctcctcttgccatccttccgcttcttcctccgcttcttcccactcttcctcttcctcctcctccattgccaaggaagccatactcccaccggatacaacaaccccaaccctgcgctccaacctcgaggagcggatgcggcttcttcgggccgcacacggagagaaacaaggcatcggcggcggctggagagctctacaggggagacgaggcggcggcgcgacgagccgcagcgcgaggcctagctccatggctgtcgcaagcgagagctcctcggcttgggagtgtggctcgccgcagcagaaggggataagagggattatgacatgtgggtcccgggcccacatgtcatagacacacgagtggcaaatagtgaaatgcgagatgataccgcctatttgccactcgtttttcttctcttgggccggcccaataaacgacgaaacgtttttcttctcttgggctggcccaaaacgagaaaggaccggcccaacaaagcccatggagacctcaccgccattactagcaaagcccgcgacaaaacgaccaaccgctcgagcaaagcctccaaaaccctagcgctctctctctctccccccccaccctcccttcgcctatagctgaggcggcggctcgtcggcggcggcggcggcggaggaggaggaggaggaggaggaggcagcaatggggaagacgaaggggaagcagcggcaggacaagttctaccacctcgccaaggagcaggggtaccggagccgcgcggccttcaagctgctccagctcgacgcgcggttccgcttcctgccgacggcgcgcgcggtgctcgacctctgcgcggcgcccgggggatgggtccaggtggccgtcaaccacgcgcccgtgggggccttcgtcgtcggcgtcgacctcgtccccatccgccccatccgcggcgcgcactccctcacggaggacatcaccaccaccaagtgccgcgccgccgtgcggaggctcatggactccaacggcgtcgccgcgttcgacgtcgtgctccacgacgggtcccccaacgtcggtggcgcgtgggcgcaggaggccaccgcgcaatcgtcgctcgtcatcgacgccgtgcgcctcgccaccatgttcctcgcccccaagggtgccttcatcactaaggtaattatttatccacaaatccgctccttttaggcgtagttgttgcattgttgaatggtcttagctactgcttacattagcagttgggagtgatgcatttttcttaccgaggttaaaaactcaaaaactttatatgctctgtatatgcgattaaaaaattgttctacagattgtgatgaataatttttagtttcgtaggaaagtgttatgtagtccctctcgtattgtaacaggctagtgcaattattagttcatagaggttgagaacgatgctattagttccctcagacaaaatttctctaatgggtgttcctgtattttctgtagccctccttaaccagctgttccttgtcttctacaggttttcaggtctcaggattacaacgctattatgtactgtcttaaacaggtgcatattactctaaggtttgattacatttttctttttctaaatgtagtttcttgatgtatcaaatatatctgcatgcagttatttgagaaggttgaagtcactaaacctactgcaagtcgttctacgtctgcagaaatttatattatctgtctgagatataaagctcctgcaaagattcagccagaacttttggatataaagcatttgttcagtgtggatccagatcctaaaaaggcatgttgaaacatttatcctacttatattcttggtttctcatcttttctgtgctagcatccatttgatgttttgaattttacggcttctacaggttagggatcct

SEQ ID NO: 60463 - DNA, 18335 bp, Oryza sativa
ttctacaggaaatggaagaattgacgagtgtcattgatagaaagaagaagagagaaaagaagcgtcaatcaaagcgccgtgcaaaggtatatcagtcatgagatatagatgctgccattgccaaatgggtggttaatttgagttatgtgctaatacactggtcttttcgttccaggataaagcacgcaaagcaacaggaatgcaaatagatgctacaggagataattacggcgatcctgatttgttttctataagtgctatcaaggttcatgctgtttctgtagtcatatcctgtgtggttcttaagtatttagtactaatatttgtttaaaatcataggacaggtgttcatttgcatggctataattttcctgaatttgaaagtgtgcttcttttctttgcacttgaaatatgcaacgttcgtgctcctcagtaaagtttcacttttattgatctctccatgcgacaatttcttagtgtggtagcctttatcagtattcacaaacttagtaaattgattttcgttatgttacgctttctcaaagttactttccagtatgagctgtatagtctacacttgtcttgtgtaatacttactatcatctaaatagatagtttgtgtcatttttctgtagggcggaaaagaactccaagctattgaatcggctgagcttaatgtagaagatgcccaaggagatagtgagaatgaggatattcaaactcgtgaatactctgatgaggaaatggattctgacgaagaacagcagaggtaaatttcgaaattaacactcaataaaacatacaataagccggtcataaatttttacaggttttataattttaccgcaatcccaaaaatgtgtaacatggtaatcttcccaaccaggtatgatgcccaacttgaggaaatgcttgatgaagcttatgagcgttatgtaactaaaaagggtggtgaagtgaaacaagtacgcaagcgtgcaaaacgagtaaatactgatgctgatgaagaattattagaggtaatctctgacacatggatcttgtctcaaccaaatgacaattgcatctttcggtctctctgcatgcaattggggtagttaattatgccaatttacacactgccctttatataactagattgcatgggtggtaatagttgttatccttatggtctgaacttaatagggaggtgaagatgacggtgacgatgttgacatggatcaaggttctgatgaagagcaagatcaagagaccaatccccttttattatccctagatgcagagaaaccaacaaaagagcagatgatggagcagtggttcagccaggatgtattcacagaagcaggaacaggtgtggttgagcagagtgatagtgaagatgaaagagagcagctaactaggattgcaaaaaagaaggcggattctggaaagaaggaaaagtctgctaaagcaaaacacttgcaacaggacgattttgagattgtgccagcagaaccagtccgaactgaagatgactcatcttcatcttctgatgagtctgatgaactagatgaggacctcgacgatgacacaaaagctgaagtactagcctatgcaaggaagatgttgaggaagaaacagagagagcagatacttgacgacgcttacaacaagtacatgtttgacgacgagggtttacctaaatggtttgctgaggatgaaaagaggcataaccagcctatgaagcctgtaacaaaagaggaggtagctgccatgagggctcagttcaaggagatcgatgctcggccagccaagaaggtcgctgaggctaaggctcggaagaagcgcgtcgccatgaagaagctggataaggcgcgccagaaggcagatgccatcgcagatcaaaacgacataaacgagcagtcaaagaggaagatgatcgacaggatttacaagaaggcgattccaaagaagccccagaaggagtacgttgtcgcaaagaagggcgttcaggtgagggctggcaaagggaagatactggtggataagcgtatgaagaaggacaagagggccagcaaagtgaagggtggcaaaggagctaagggcaaggggaagaagggcggcggccagaaaggcggtatgcgagggaaagctgggaggaaagcccaaaactgagtagcaatagagcatgactgaattttctactgaatttttgttcagtggctctactgctcaatttttgtttacttataacttaccgaattcatatgtacggaatttttaaatgcgtgaattatcagttgtctcgtcagattatattttcagtcccatcgttttttaagcctacaactgattataacctgtaacgcttaaataatttctggggggaacttttatacgtgttcttaggaacttaaaatcacaatgctgaaattagcaacttaatccaactttgaaaaaacgatagaggtgtttgtgtcataaaatttgtgatccattcagttccactaatccattcagagcctgcactggcattgctgcatgttgtagcgtttgggaatcagcgggagtggaacccacgcgcgtttccttgtcaagggaaaagaaagaggagcggcgctttgcctttgaatcccggggcacggcgatgcagattcccattcctcaagttggcgccgatcgatcagccttaggatcgaatccgaatccccagctttgcgctgcaaagatttggaatccggccgtcgcagtgacggccactgagctgaatcccgagctgctacttgacgattagagcaagaataatactagtgagctgctacttgacgattaggatcaagtggctggcaggaatgatagtatgataccgactaatgatggctcacagctcagggaataataatgtctcaggtgtttgtttaatttggggattaaaatgcattttagttagcactatttggcagatactgaagatgctgcaatgtttaaggggtttaatactatgattaagggagaagttgaccgtgttattcaggctggtgcatcttctgaagtttcaacgtcaggcaaggaattccaagaaccaaacatctctgtagatcaaaagcagacggtacaggataatgtaatctgcgcagatatgccttcttttctgtcccttttcatctgaaggcaatactgtagtcaatccagaatctgcaattctgcttgatgctaataaacaatttcccaattgaaatgtttgttctttttctttttaaaagaaaaaactagatcagttgaattatttcaaccctcatgcgtgacagattgacaatgataagcacagtttggactttggaccaacatgaaaagcaaacgagaactcaggctgcaaatccaaaatcagcagaaatccttccagaatgcatgagaaaagctttgcacagcatgtcaattcactagccagcatctcccagaaagcatttgctcggatggttcaaaatatcagagggaatcctgcatctttccgatggctttatgcagatatgattcccagagagagatctccggtggcctggtccatgctgcaggaaggaatcaaagatgctgcttgcaagcacttgctgctctccaatggccatttgcatccgatggaccaggatcctacacgacacagttcatcacgagaaatgccatgccaggcctttggaaaggtcaatcaggcccaaatcagatcttcataaacagggggaaaagaaaaaaaaatacagaaatacgatgcaaattccatgaccctatgagcaaacggcaagccaggaacaagatggcatgtcgtcaaattcactttccagagtcattggagatggaaaagatacacacatagatatatattctttgggtccccaaagggtattttccacttcactggctgcttatcttcctttggaatatgttctttggatagtagcagtaaagtggatggctggctgggatcgcgcaaaacgcgtccattgtaaagaatggatgttcttagcccacatcctgctattctccaacgaattacatatccaaacagtgcatgcatgagcaattgtttctaataccttctgaaccacaattagaaattcggcaccatgttgagagagatttgtgaggtggattcatacaccagcagattcaccgcctagccaccatgggcggctgcccagcctcgtcagcgaatgttctactgaattttttgcatgtttttcaaggattgggataccatttccacagcaaatattagctatagttaggtatgtccgggctctaattttttctggatccaccactggatttataggctatcagcctatcatatcaaggattggaataacaggatcatagatctttcaaagaaaaaaaagaacactgaataatgggttcggtttgcgcacctttgcagttctgaattctgaagaagcacaccttcggcgcaccttgcagggcacaggcacagcctattggttgatgctcacacgttacaagctcactgctctgcatctgcagcctctgctctcatgcatcgatcgaacctgcactgcaccatgtcaggctgatggctgacacatcaccattcacagagatgctttcattcgtgatgtcagcagcatccatggattccatgctgccacgccagaattctgtatgcatgacataaccatgattcagaaatagggtttattaatgaaacaaagtgtttaaggacaagatagcatgcatgttttacatggaccatagaacatatgcagatgtagtactgtagtccccccctcttccttccaaggccatggcaacagcctacaggtaatagactgataatggcaactactaggtccaggggtgatgctcaagaaagcctttgctttggcacatattcttccgatctttcatgcatgcatgggccatgcctgtagcccagacaaaaacaacttcagctgcacaaaaggttaggctaaattgtttgcaaaccaagctgtcagtgtgcataaaacagaagttaaacactggaattagactagcttggtaggcaagctgctacttagaggggagacaaagcaagatatacaagatcactgaaggcttcataagcttatacttggagagcaaggccagctgcttgctaagcaggaaggaattcatggcaaagacgcatgtatccggatgactgtgcgatctctgcaggatgacaaaacagctacgtgataaaatcttgatggatccatagattcgttggcgctttaccttgatgttactatcctttagatctgatcactttgatgttaccccctttcttttctctgcctctttctgatgctgtttttagcttcaccgttgcttcagtgctccagttcgagcaaacacaggacaaaactggagaatggaagcttgatcagaaaacgaaccaaacatgggaatttatatctcacttttttcactgataggttgtggtaaagtctggccacctttaccttccattgaatgcaaacgcgcctgcgcgtgctcagcacaagatattgctttgtcttcttctcagaaagtgtaaagaacatgaggcaatttcaccatgctaatgcttgggggatactatgacaaaatggcacatccaagtgctgtgttgctgtcgaaagatgcactccatgccatgcgtgcatagtagtgatgaacagttgttagctctgcatgcagcatgatgcctcgatgactggaacgctcggcgcatggatccgagagaagcagctgcatgcaaaaaacaaaaacgatcggcgtttgtcagtataaggattgagacatcgggatgcccagctacatgccaggtcagctccttctcagctgagtgacacatatactgcagctccagaatatttaacttctatcttcagcaccagaaagttcaccacaaaaattttcaatgttcaggcatgccaatgtgcagccatgagccacactaacatcaagatgtaatctttaccagaagctcatcaaagttaccatgttaggcatcatgcaccatagtctcgatcgattaggctgctattttttttgccgggagattaggctgctatagaacacagccaatactatcaactgctgtaattggcattttccatcacacgctgtctgtgtccctttgctccaaaatctgcgaaccttattctcctcggccacctttaatgcacagccattattccatacagcttacagctcatacacacaacagcacccaaggccccaggccctataaatagccgaccttgcaacactgaaagcacaaaccaccagagcttctgaaagagcaagaacattcagagctaagacacagcaagatctttagcattagagctttcagtagttcagtgtcttaccaaggccactcttgaagatgtctgggtcccggagctcctcccccaactcgaagtctgagtggagcaggaaggagaacaagatgttcgaggaggcgctcgcctactacggcgaggacacgcccaaccggtgggacaaggtggccagcgccatgggaggcatcaagtccgctgaggagatccgctgccactacgaagacctcaccgatgacgtcaagacgatcgagtccgggcgagtgcagttccccaagtacaagacgcagggatactggacctgaggtaaaaaaaaaaaaaaaaaaaaaccatgcatgccacctctcaaccaaacctgagctgcaaaaaagaaaaaagataacttgcctccaataagttttcagaattacagtcgagtagaagcatggtagtcataactaagtcagtgattgtttacaagcttactaaatgcaatgatgaagaatagaccatgtatatttggctgtttatagatggttcatggtttaacttgaagatacaacatgcagggtttagtactttatattctttccatgttgccaccatgcatgactggcatcataagcatacttagacaaagagtcagtaatttatgagtgtctttgtaatctgacgccctctaatcacgtgggatctaatcctagcgctatcagaataataccttccaaaagaaaagctttggtcttagagaagtacagtctacctcgtgcttccagcttacagccgacatgcacttctcatagtcctttacaagtcacagctaagtgccaaaaggttgatctcccatgctttttgagagggtgctggtgggtatgctttgagtgggttcttgttcttgttgttttgttttctttttgagttggcaattttgcaatcgcaacactttacaaatataaaaggcagctggttgcaagctagagtttgcaatgagatcaacaaaagtacatcatacaagtttaaaaaaagcgaaagtactaggtctattttgctagtcttggttgagttccaaactctttccgtacctatcagcctaacttgatgtctagttgaacaaagcaaccaaaagagagaaaagaagcagctctctcctatcaggcatccaaaagcaatatatagttcatctgagtaaagttttttgagctccgataaacttacagtacattatatttttcctttttcccaggatgaaccattggaagctccgatagacagaagatgaagttgtataaactagatccctaagaaagacttgctctaggaggaaccaaattaagtaatccagcattgcttagagaataaaggaagagaaggggtgtgtatgcatatagtattgggttatgagcaaggttaagtccccatgctgttgtagattctcgtctacattcgtcaactgcagtattcattaactctgtgaactaaattatgaagtaacattgtgatgtaaactcatgtgtttgtccaattataaaatgttatgttcgattgcattctgttgccccaaatcactaaatttgatggacgctatgttcaatcttaaatttctgagctttaaaacgttaaagaaatacagaatcattgccaccactgctttcgttttcaaatgtcggtctcaaaaaggagaagtcactgaattgtcttcaagaacaacagaaagaacctaatgccagaatgatctacatccaagcccaccaatgttcactgttaagaatcactcattactgtagggtagaatcaagaacggtagttacaaactcacaggactagctagaaacaaacatttctgaaaacattcttgtcatgtttctgctgactgtatactcaactactataactactgaacaagggtttgcatccactggtctctgccgagacgacgatatctcataccatttctgaccacaaaatttgccatcttgatcacagtatcagcagacagcagtaccaatatcatttgtaattagtaacacaaaactggcctacaaatttaccagagctcacataccaaacgaagatacaataatgcaaaagtagtaacattcaatttgagcatattcagaattccgattgcaactttgcaagaaccatagtgtgagcatagtcacacacacacgcagcactacactaatccgggtaagtagaatctaacacactgccatctaaatttgacagcttggggacaacaattctgaggcacaccatcaacaaattacatggtacagtacatacctagcaactcgatggcaaagtggcaatggcattgctcttcgccttcttggccgcggcgcccttgctctccatgaggcgccacatgtaccacgcgcccaccgaccggtacggcctccaccgctcacacagcgccgccatctcctccggcttcggcagcgccggcagcccgtacagctcctgcacgcccttgcgcacgccgaggtcgccggatggcagcacatcggggcggtgcagcgagaagatcatgaacatgtggaccgtccactcgccgacgcccttcaccttggtgagctccgcgaggagcgccgcctcgtccattgcggccacggcggactccgagagctccccggccgcgaacctgccggcgaggtcgtggaggtaggccgccttgcgggcggagacgccgatggcgcggaggtcggcggcggagagggcgagcaccgcagcggggttgaccaccgcggcatcgggatcagcggcggcggggatgagcgcgaggaagcgagcgtagatggcggcggcggcggagggagcgagctgctggtggaggatggagtgcgcgagggagtggaaggcggggcgggaaggggacgagatgaaggccggggcgccggtggaggagatgacctcggagaggagcgggtccgcggtgcggaggtgcgagagcgccgccgcgagctcccccggcgaggacagcggcggtggcgatagtacggctgttgttgttgtggcgacggatttccctttggcgggtgtgctcttgacgatcttgcgggagcggaaggagatcttaccggcggtgatgtccgctgcgcctgcgccgccgccgccgccggaggggcggggagtcgccgccgctctggtcttgaccattgcaaaggttgggtgttggagacgagacggcgtggattactggaccgtggagggaagcagttggccgttttgtcgggtggtcccttgaggcccatttatcactcgcgtgggcccacccgtcctcctcgcgtgacgggccgtgatctgggcccataaaaaggctaagcaacggcccgtaactcggaacgggagtacgtaccaaaaaggttagccgtcagtgtcactgctaggtgggtcctaccatttgatggagaaatgcctaagcaaaatctttactccgattcgcatccgccgtttaggcttcatcgggcggcccccatctcgcgacgggattcagggaaacctgcgctagatgagatcggcggcgagatggtggcctcgccggtgaggcggtgacggagacagcggcgaatccactcgcatagttgcatgagcatatatttctactgttatctgatggtaacaagtgaaccttatcttatttaaaaatttgtttagaacatatttgacatttcgtcttattcaaaaacttttataaaatatgtaaaattatatgtatacatataagtatatttaacaatgaatcaaatggtagaaaaaaaatcaataattatttaatttttttaataagacgaacggtcaaacatattttaaaaaatcaataacgttaaatatttataaacagatggagtattcagtttcattctgctggttttctagtggcatctaaaatttactctggatgcagatctcagatgtgatcattgctttggtctttcattggcaaccagacagctgacaacttatgataaccgttctatgtttcagcaaggcgattttcggttttaccaactgattagtgattacactacacatgaaactgagaaaagcatccggattcaaattgaacatagtattcctgttgctcacttcggatctggcgacccttctgccacccatcggcagcttggtagtagtgaagctaaagtttgttggatttttgccacgctgagtgcatgtttcttgtcagcattacagctgcaagttgagacctcgtgttcgtccagctgggttccagtccaggagcagcatcgcagcatgctctcgccacagacaaccagaatgcatggaagcaactagccaacgaccacgaggcaaagcagcaagatatgatgatgatctgtacttacaacagcatatggtgtgcaactgtgcattccatgtttgtttatttcaagcccaaaaaaagagaatggtatagaagaaagtaatagctatatcaatctagaattggattagatatatctcgatattatgaatctggataaaaacctaatattagattggacacatcttattactatgaatctgaacaaaagcttatctagattcgtagttatgtccaatctaattataaattattagaaattaatgtgttcaaagataataatagaaaggtcatgagcttaactagaatgaactgattgtttgtacatatatgtagtacaggtggtcggatcagggtgaatgacaaaatggtccacatgcaacagttacagaaaaagaagaagcctatgttctatttctgtttcagttcagacaaaatcagagtagcctccttatgtgtcactgacagtgggccccacaggagaccaacgaacacggtcaggaactctccccccatttcaacggaaaaaagtttcctcttttctactccctctctctcatccatttctccggttgagcggcgccgcggcggagccgaggcgagcgagcgagcgggcgcgatgaacggcggcgggagcaggcggggaggtgcgtcgtgcgccgacgagagcggcagcgaccaggacggcggcagcggcggcggcttgcggaagccgctgctgaacacggggagctggtacaggatgggatcgcggtccagcctcgccgcctcctccatggccgccatccgggagtcccacgtctccgccttcctctgcacgctcatcgtcgcgctcggccccatccaattcggattcaccagcggcttctcctcacccacccaggacgccatcatccgcgacctcaagctctccatctccgaggtcccgtgcccgttccagctgcgatcttgcgtgcttttgctgcttcctcttgcttattgcgtttcttgtagtgtgaagttttatctttctgatgcagttctcggctttcggttcgctgtccaacgtcggcgccatggtcggagcgatcgccagtgggcagatggcggagtacattggccggaaaggggtgagaatttgtgcttcatttggtccttatctgttcttccactagaaggccatcctgtatctcgacgacgaacaattgatactttgatagttgacaaggtcaatacgtcactgttgtatgatttccggtaacaccaataatttgccattaaagaaagtgagtgggattagaaatgctggtcatttcctgtgaactgtagcttgtgaaaatatgaaacccaaaatttcaggttcagttagctatactattggggtttgaccttaatttcaaagttgacgagttctttagttgtgattgccattgatctggcaaaagaggagttagtatgacagaaaatgtgtagatgaagtttttgtgacattttctttggttcatacttcataatcacttaatcagatcagtagttaactacagtgaagctctattattttactctaatggtcttgctgattgaatctccagtcgttgataattgcggcggttcctaacatcattggttggcttgccatctcctttgcaaaagtacgtgtcacatatttctcaagcttatttttctctgtttgctctttttcactagtttcattcttgccgatctttgtttttcaggacgcgtcatttttatacatgggacgcttgcttgaaggttttggtgttggtgttatatcatatacggtctgtatttaccaacttcatttcatgtttatttgctgcttagaatgttctgtggcttcactgcttgagtacttatctgactgagactgagatgcctgtagaatgaggcagagcatcctttgctaatgaagcttttttacatttttgttgccagaagaactttggatcagttaatagttagtgcatgtataaacccttaatgtgtgaattatatcgtaccaggtgccagtatacatagcagagatatctcatcagaacacaagaggagcacttggctccgtgaaccaggtgtgcttatcgtcagaagcatcttatcttatgcgagggaaatttatggtttgtttatgttggacttaccatgcagtttttcattatgtagttgtccgttaccattggtatcttgttggcctatttgctaggcatgtttgttccttggaggctgcttgcagtgataggtacaaatcaatacctgatgtctgaatgttttctatttagggatatgtaataaataataatgaatttttaacttttgatatttgctagtaccttttggacttattgcaatttgtatgtgcgttaaatgtctggtacctctgattctgattcaaatatctgggttgccatgcttgtaggaagcatcccatgtacattgttaatacctggtctattcttcattccggaatccccaagatggctggtatgttatacacctaagttggatattgtatcacaaatctgaaatctgtagcaagcactttcctacatctatatgcaggcaaaaatgaaaatgatggatgattttgaggcttctctacaagttttgagggggtttgagactgatattactgcagaagtgaatgatataaaggcaagcaattttatttttcttgattaactgactacaagttatttgcggtttcgcgtgatttcatcttagtaagattttcactaacacaacacttgggagatatgtactttcatttttctggaagactaatatggttcaaatccctgttatgcagagagcagtagcatcggcaaacaaaagaaccacagtccgttttaaagagttgaaccaaaagaaataccgcactcccttactggtaacttacataccccttttgttcagtttataccaaagtcattaatcatgttttgtaatggtaactacgctttatgttgacagataggaactggccttcttgtacttcagaatctaagtggaataaatggtattctgttttatgcaagtagaatcttcagagatgcaggtaagttgtggatatctcttataggtccttagtactacagtcacgttgtagtaaattttggcttgtaatcttaacacgcaaagaacttcagggtttacaaacagtgacttggccacatgtgcactaggagcaattcaggtaagtgattaggaatatcctgatctcatctctgtaacttatatcaagttgcttacagaaatcgttggattacattaggttcttgccactggagttacaacatggttactggacagagctggtcgacggatgctccttattgtaatttcctcttcccaatgaaatcacctttttgttagttgtctgtaacaataacatagtgactcacttaaaattgcagatctctactgctgggatgactctaagccttcttgcagtatctgttgtattttttctggaggtacattcagattttttccagtataccattgtgataaaaaaaatcatatgttgcagtctctttgatagcctacattgtcgcatggactcttcccctttctcctcagttcactcaatatttcaatattactacaatgattatttgtttcagggtaatatttcacatgattctcattcgttctacatcttaagtatgatctccttggttgctcttgtggtatgtctgtcagttaaaccatttcttttgaaaattgctccaaaacctctgccggaaaatttacctcggtcacttacttcaggcttatatcatcaccttttccttcggcatgggtgccattccatgggtcatgatgtctgaggtataatgctttgccccatagctcacaatgatgttagtatttttagagcattgacacatccaccattttgttgcaagtatctcaggcatcagcttaagtaatctaaagatttcagttaaatctttgtttgttcttagatcctcccagttagcatcaagagtcttgggggaagctttgcgacacttgccaacatgcttacatcctgggcaataacaatgacagcaaatttgttactcagctggagtgctggaggtccgtatttctataaaaatcctctgttaccaagaataaaattctgaactgatttacctgataaaagttaaatattttattttaatttcaacaggaacatttttgtcctacatgattgtgagtgctttcactctcgtgttcgtcatattttgggtgccagagacaaagggaagaactctggaggagatacagttttcgttctgctaaattttgagtttctcgttgcatccagtggatactccagttgagtacaaggaaaggatttacttatacaattaggaaccttggcttttcttttaccaagtcgattactggttgaaggccaagcatttttattcagttcattttttttgtatattcttgtgtaattttaattcagttatgcccaattggcttgtaaatgccagtgcagtggctcaaatcaaattgcttcctacttgtcttcgacgttatataataaaaagatgcataaatgagcaatttgaatccctgactgttttggaaatacttctgttctgaagttcagctatctgccgatatttccacagttatttggcaccttcatcagaaattcagagttcagagacacttatttggtgataaatgaatatatttactccccttattccttaaagaaatgcagacattgctggttgaatatctgtcatgtactaagacagatttctgccgtttttggccggtgatgcatccctatcaaagctgtgattaggaattttgccatgatctgcacatgtccattggcatcatgtctgcaaactggaacatgtttgtttctttcagctgggagcatcattatattatagtgtccacgagaagcacgacagccagaaaatgttgccgtatgacgtggctttgagcaagcaagtagccagctaccacgccacgccatctatttccagcagactacgccttctgcgtgattaaattttagttcggtttccataaaattcgttcaaattttttttggagaaacggggtggtttgaaatctccggcccttttcaaatggtcgttgttcattcagcaagcaatcgctttcctcgtcatcacgatcttatccagcttagctcgtgaaaatgattgggatgatcctaatgagatcagaagaaattaaaaaagggacacggctagatcgcgcgcgctaatggcatatcactaaccagcgacgtccttctcttaaaaaaaaaacaacagttatacaagccttttttttccttcctagagaattttctcctaaattacttatccgatctataatccgattacaccattatggttgttgcaattaaatctttataacaagatcttacacgattatattctgataaaaaatatctatgttgcaaattacttttattatatatgtaagttacttttgtcctatacataaatcacttttagatttaagctctttaataacttatatcttttaaatcacgtattattttcatgatctatttatatcattgtactctacataaaatatgagacaaaacaatatccatattgaatatattcaaatattttattaatttaaaagtaatttatttaaattgtagtagtaacttagctatgcaatagatataacttagctatgcaatagaagtaagttagcacaaaatagaagtaagttgttacaacattagaagtaaattcgagagaaaaatattttgtatctaaaaattaaatttaaagtccataaattatagaattgactaaaaactataataaacataatcgacttaaagcattatgaatatataaaaagtaatttagtcaaatctaaaagtaacttatatatatgataaaagtaacttaagtatataataaaagtaatttacaagtataaatatttttttatcgtagtataatcatgtaagatcttgttttgaagatttaattgcaacgaacacaatggtataatcggattatagatcggataagtaatttgagagaaaactttgtaagaaggggaaaaacatgcatgtgtaatagaaaaaaaaggcatgcatgtgcgccggcttctccacggcttctatggttggcatcgcgggataacacaatatcgagaggcctcgccgattagtttttgcgttaaaaaaagcagtacacgtcgttgtctggacatgttgtgcacttgtgcacactagtacatctgagcacgaacttattaacgtttttagtatttatgccataaaacagtccaagaaatacaattttaattgattatgtatgatttctggatgattactcttttttggtagtttatggcaaagaaaaatgaggccccatttattacacacaggaataaaaacctagaaaaatagaacacaagaatgcttgtgttaaccagcgaaatgaaaaacacatgaaaaatataatatgggatgtttggaagaaaggattcattagtcaaactgcagctgctttaaaacgaacatacccgtaggcaagtttccaacaaaatttagcaaatatttgctttcctataaaattggggaaaaagtgcatggaaggaatcaaaaacctttaggaagactatccaccaaattctttgttcaaaccgtgaaaataatgaaatcccttaaaatttatcttttgcttatacttatgtttatagctaaattttgatttttcaactttaaatttaaagttaattttggagttttttcagcgtagtttatattttaacatttgcttttaaatcgttaagaatacgtatataaaagttttattcacaaattattttttatttccaaatattcctcctatcaaacagaggtgggcccctttttccatcccggaccaaacgaaatcttctcccgtcggtgactgacaggtgggccccacctgccaaccggtcaagccaagagacaggtagacacacacacgacgcgatccccccaactctcccccgcttcaacggaaaaaaaaaggggtcgcgtctcctcgtctcgtcgcctcttcctccttccaattcatctcgtcctctctctcgtaactcgtaaagagatctcgtctcgcctcgggaatccaaccattgccggcgaagtagagatcgggagggcggcgccatgaacaggggcggcggcgtcggcgtcggcgatgagagcggaagcgactacgagagcggcggcggcatgcggaagccgctgctgatgcacacggggagctggtacaggatggggtcgcggcaggggagcctcaccggcgcggggacctcgtccatggccatcctacgcgagtcccacgtctccgccttcctctgcacgctcatcgtcgcgctcggccccatccagttcggattcacggggggcttctcctccccgacgcaggacgccatcatccgagacctcgacctcaccctctccgaggttgctgcccgcttcttcttcttcttcttcggttcttcccattacccccccccccctttttttttgtcccgaatctgaacgacgcgctgctgctgcagttctcggtgttcggatcgctgtccaacgtcggcgccatggttggggcgattgccagtggtcagatggccgagtacattgggcgcaaaggggtgagaattttttttctttttttgggtacaca

SEQ ID NO: 60464 - DNA, 8956 bp, Oryza sativa
ttcaatggtctactcttttaagctaactgaattgtttggtgaattttccagtcattgatgattgctgcaattccaaacatcattggttggcttgccatctcctttgcaaaagtatggcattacatggttcagaatcttactttcaccaccttgttgctttatacaatttaagctcgatgcctttgctttataggactcatcgtttctttatatgggacgattgctcgaggggtttggtgttggtgtcatctcttatacggtttgtatgagaaaacttccttcctcccttttttatgcgcacttatagtttgagtacttaacttctttgttcaagaaaaagaaaaaaaaggaataacggatatgtcaatattttggaggaaaaactctgcattgccagctatgttagagacttactattgatctgtgtattatgtgataacaggtgccagtttacatagcagaaatatcacctcaaaacatgagaggtgctcttggctcagtgaatcaggtaaccttacttcacaggaataatctttttgacacaaagacaattgcttttctatgtttttcttgtttattttaagcaccttatgtgattgtttgttacacagttatctgtaaccgttggtatattgttggcatatttgctcggcatgtttgttccttggaggcttcttgctgtaataggtaatataaccaagttctgattgtattgctaatgtgatctttttttcctttcatttttttatgtctgcgttctgatatttcagttcacaagttcattaacagcaaatgatactaatatgttgacaaacatagctaacatcctacaaacattgcatgcaaatattttcatttgaatcatagatggaatgttagtcattttcaatagccagcacatatttttttcacaagtattaaagtaatagtttggatgtcatatatgcgtctactaggagtaaatggtttttttattcaaatctgtgttttttttgcatgtaggaatcttgccttgcactgtgttgatacctggcctattcttcattccagaatccccaagatggttggtatgtattattgtatatgcaaaaaatcgatatgaaattacatcatctgaatcatttttttatagccatatttttatctctatatatctctaggcaaagatgaacatgatggatgattttgagacttctttacaagttctgaggggatttgagactgacatcagcgcggaagtgaatgatataaaggtaagcacttgttataacattgagcacactgatatatgcaccacaataccacatgcttctggaagtaacagcatcatctttatgcagagagcagtagcgtcagcaaacaaaaggacaacgatccgttttcaagaattaaaccagaagaaataccgcacacccctaatagtaatttccttaactttataattggtattgtacttttatgccataccaaatatagggactaaattttataattggaattgtacttttaactgtggcagctaggaattggcctacttgtactgcaacagctaagtggaatcaatggaatattgttttatgcaggtagcatcttcaaagcagcaggtaagttgtgtcgtgcttccttctttgctagtaaaccttttcattacactggttagggctttaggcatagtaaattgtatgcatatattgggatatcttgccaactttaacggtagtgtttgctaaattaccatcagtgtaatcatctgttcatcaaactttagcccagaaggaatagcatactagatttcaaactactaaatttgggaccgctgacctgataggacctctaataggtttatgcatatgtaatttccttcgtctctctgtatcatagtcatattttagccgatttggcttcgtgacacgcaaaatttcttcaggtctcacaaacagtgacttggctacatgtgcacttggtgctatccaggtgtgcaactataaataccgttcctgtctctatgcaatcacttaaaccacacactagacaagtaaacatgtccttaagttgctcacggcatttcttgtcaggttcttgctacaggagttacaacctggttattagacagagctggccgacggatcctccttatcgtaattctcttcctcctgaaactaaagcatgctaattttctgtattctgtgaccataataaagctctcgcttcaacttctagatctcttctgctgggatgactctaagcctccttgcagttgctgttgtatttttcctcaaggtaagttcctaccagtaaaaaagaaaagggaaaagtttcatctgttgcactatatgcaatattccatatatggcttatgaattttgcaatatatcacaggtctcttctgtcaatccactgaatattttcatattgttattgtgatttatttgtttcaggatagcatttcacaagattctcacatgtactacaccttaagtatgatctccttggttgctcttgtggtatgtccctcattatgttgttttctctaaaaatatgcatcacaaatatggaagctgtgacagaaaatgttgactcgtacacttcatttaggcttttgtaatcgccttctccttcggtatgggtgccattccatggatcataatgtcagaggtatagcttcatggctcataatcatacggccttggaatttagctgaagagcattcacatggccatgatttttggagcatttgtcagatggtctgaagactcacttccaacttgtatattttcagatcctcccggttagtatcaagagtctcgcaggaagctttgcgacgctcgccaactggcttacatcctttggaataacaatgacagcaaacttgatgcttagctggagtgctggaggtacatacttctacttctctgatctctctttcctgcagtggaattgttcttttcgttgagcgagactagagtagaattctgaatatccaacctgacgctcatgctatcttcttaaacatcaacagggacctttgtgtcctacatggtcgtgagtgctttcaccctcgtgttcgtcatcctttgggtgccagagacaaaaggaagaactctcgaagagatacaatggtccttccgctgagccttgtggtcttcgaaaatatggccattttttcaagtacaaagggaaggattgatttgcgcatttgcaaatcttgtgtattctatgttccgagtcaagtatactggacaaaaagcaaagtattctttctgttcatatattcttgtacaacattgtttcacgtattccagatcgacttgcaaaggcttttgtgcagtgacacactcgtgatctcatcctaattgcttttcctttttgtcttgagcggctgcatgagcatgatcaatgtaaaatatgagtatactctcaggcattcttgacgcctttgcttgccttcgaaaatatttttcttgtcaaatttcaatagtctgagaaatttctggagaaggtagccggcgatccatagcgcagaggcagagccttgatgaagaagaatttgatccgaggaagacgacgatggtgacgtcatcaatgccggtatgggccagaacaggaaagcagagtacgtgccattgggccgtaacgggatggcctcttacgtgagtgtactatatgggcctatcaatatactgtagtagctaattaggcccaatttcttaatggacattttgggctggtccatggtgcaccgctattgcggtggaatccggtcaggtacatatgttccttccagagttgaccggttgacccgctttttgcagttagctccctgtttggatctttttctaattttctaggcctgttcagtttgttgcaaaaaaaccttaccacatagttaccaaaattttgacaacttgccaaaattttagcaggatttcttatatagttaccaaattttggcagcaaactaaatgtagctatttttttaataactttattaaaatttggtaaagaccatagtttttgatagtaacggttcaaaatctcgatttgctatcaatggtagcaaacaaaatttgcctagtaagatacggagatacagatgctgtgatatagggatatgacattttctattaaaaaaatacatatacaaggtccatacatacagaaattaatgaactcttgccgggaaacaaaacaaggatgctagctagtttttcagtgttacgtggttcctggacaaaacaagcttcagattcccctctgggaagtctaaaataacaccaagtttttactgagattatgatttgaaccattctagtttgactctcactgcgtcatgctgagtaacgagttcagccaaggaatgaggtttctatcaattcatggtatggtagcaacttgttaccagtggtcctgaggtctccagaatataaacactactagttggcacagtgatctgatcgatggattagagcatttaaacatgtgaaagatccttggctctgtagttccatgtcttctactgatagtctgatactgctttggacaagcatttttcttcacttgtaacagtagaaatgttcccggtattttttttttagaactatgttcctggattcaaaggtaggtctccgaggaacgcagtgtcagtcagttctgccttggtgggcctctcattgcgagatgacatataattgggcccgataaggtttagacatttcaggacgatccacagaaacaaatctgatatggtttgggataccacatttcgcgtattattattaacccagttttggataatggatttctatagttatttgagatccagtatttttcactttggctcctgatccaacatttcattttttttcatatctacaacgttttctctataatcattgtttcccacccaacatttagccattgtcactctccttcctccagtcctccgtctgcatgtgtgattggttggttcgactgataaaccctagaaaaataaaaggagccaacggaaaatgattttacggtagaacttctgtatttctaactttagtcttatgtcttagtggtttaattaattagaagccaaggctgaaaacaaagggagtgttcgacaggccgactgcaatggctgtagctgcgaatgtgctaagtgagtacgggactattcgtgccggctgtggtgcagccatgaaagcagcagccgaacatgcccaaaataaaagaactcaataatttaaaattaacttcaataattcaaattttgtttggtagtactacttgtaaaccaacgaccaaacaacgagcatatcaaaggttcggtcaatttaattgcccaaaaaaagtggttcggtcaatttaaatagctaggcaacagctcaaacaagatcttgtaggcctctgatcaaaaggagaacccttatatgggtcccaagacatataaccgtgatgattgatcgatggtacctcacatctcaaaagcccaaacatatatccctccacatatatatccacttacctttttggatcaaacgatgacgatgattagtgcacagtggaaagtactgttagttaaatcacaaaagaaatataaagaacaaatttggcacgcgagcaataggaattatactgctgctagtaactaattaatggtggaactagttaattccaaacagtacaactctggtcatcgatcgatcgatctcattgcttaaactaaactaaactgatcaaaattagttcgtagtagtagtagtacactgatctagggtctctagctaagctaatagtattggaacaggccgggccgctcgccgacggcgaacgccggcgaggatggcatcatgttgagccgccacgacaggcagggcccgtcgtccgccgcgtcgaacatcgcgtacgacgccgacttcgccgcggcctggccgtagcatccccactgcggcgccggtggcggcggcggctgtcgcgagtagcagtacgcgtacccggcgccggtgtccagcgacggcggcggcgtcggcgccaccgccgccgcggcgcgcctctcctccttcttgtaccggatcccgcacgcgttgcacagcgactgcaaccaacgacagaagaatatttttcatgtgatgtgacgtttgtatagtagcacttgatttgcacgaaaggcgttcgtgcacgttgctgcctacctagatggcatggcacgcaggagtacgtacgtaccttgggtcccctgggaccatttcgccagagcggcgtcgacatcgtgttccagttggcgcagcggcaaggcagccgcccggcggcgggggcctccttgtgcaaggagccacgccggcgccgtcctgcttgccgccgccgccgccgccagggcgcgccgacgacggcacgtcccacggctgcagcccgccgccgtacgcgcccgcctccgcgcgccgcgtggacggcgtgccgagcgacagcgtgcagtccaccgccgcaccgccgccgccgtacggcgaccgactgtcctcctccgcgacgccgccgcactgcctgtagtagtactgcccgcccgccatggggaacagcagcgagaacgccgacgccgccgcggcggcgccaccgcacccgccgccgcagctgccgtacagcatcccgcacgtgcacggcgccagctcctgcagcattatctcaacctaacaatggtggatcgatcgatcgatcggcgagagatatcgagaggagggtactatcgtctgtctcgttggctgcgatcgcgagccgtggtcggcgaggcgaagcgggcgggggcatgtgagctagcgcaggcgcggcgtacgcggtggcaaatccgcttattataacgaggagactcgatcgctcagccgctcacctgtgtggggtttgggtttggttggcgttttgcgggagaagtggacgagattttgcgtcgccggcgcggggagcgatgcgatgcgatacgggtgggtgggtgtgtgtgcgcgcatgtctgcctccctgtccgtctcggcgtctcgcgtgtgttttgtgttcgtgcgtgtgcgtgtctgcacgcagcgctgcggtggcagaggcagcaggcggtcaagagagagagaagcggggcagctgcagcgagggggggtcaaaagaggagaggggcacgtgaaacggggaacagtctcccatgcaactcctggggacgtggtcgttagctaccctacccaccccagcccagagacactactcgctctcttgtgtgcagtgcagtagaatcgcacttccccgatcacgaggtgcacagtccgatctgttcctcctcccgtaccggatcgatcctgtatgatccgatcccctgtcactagctacacgcagtacatacagcccgtcatctactccactaccaatatactccttaaaaaaatactcaatttaaaaggaatctattacaatgaatctgaacaggacatgtgtttatagtttaggtcccgttcttttctccaataaaaattggatgaagattaagattttcgtggcacgtttttcaaactgctaaacggtgtgttttatgtaaaactttctatatgaaagctgctataaaatatcatattaatttaagagactgccaatcttcattttcgtcttaatgagaaaagaacaccacctcaatttgttcaaacggatagcggagtattttgcatgtaccagcaccagcagttctgcgattgcttgatcattcgctggaacggggaacagataaaaagactgctgctagctactccttgcattgccacagtggatattctcaaaacgtcatgtccttgctttcctttgcacaaatgaaaagcgtgtcgcaacccttgcctacattatcgaatccagcaagctgctgcatgcaaaaacttctatcaaaacaagaaagaaataaaggagtaggagtagtatagatcgaagagagaacaagggtgcaaaagaaaaaataaaggcgaaatgatcaaaagaagcaaaagggtaaagagtggcaaccagtaaccaccactagtttccatgcatgcatgcatgcaggataactcaagaaaagacgtggagatataattgcatggatatatggaatggatggacggatcatgagttggccacgccaatgatgagacctctagctcagccgtccgcccgttcacaaaagcaccccgggcaaaaccggccaaccggcccggccggtcgatcgactcgaactagatcatccctgcttgctatgttggcttcattttccctataattatatcttgagagtcgctttatattattaatgagtctgttcagcaggctgccatgtaacacggcacagccgtgaaatcagcaaccgaacatacctaatgtgatatcaaatatatgggtttatatgaaaatacgacaacatcgatcgataaaatcaaattagtttaccaaaatctaccataaaatatactactccatatgtcatattttgtatgaccgttggatgtcatatattaaagggtagatgtaatattttaatagtgtatttatttgttatattataaagatgttggactgttggcgtgtcttactctgagctctaggccttttttttcttttctctagagaagtttaacttatgataaaagttaaaacgatttagcatatataatggagtagagaattagctgcctgtcggttttaatgttttatagaccgattaaggaagaagcaagcttgcagatgtagggatcggtggcaatgtgtcatgcagagaaagccaagaagggagtggagcccatcattccatttgctgcagcccatcagtgccgacacgactgcatctgcacctgcgcgcgcgctgcatgcatgcgctgatgatgcgcgttgcgttgcgttgcagcagcatggcccccatgactctctgcacacgcacgtactcatccatgatccgtctgcaccagccgtagtagtacgtgcggtcgtc

SEQ ID NO: 60465 - DNA, 4538 bp, Oryza sativa
caaagcgattaaattgtgccacatgcctgcagctagctagcagcatttctctgcataagatgagagcaagtataatagtaggctataagccggctaaatgctgagatggaggagagaagagaggagagagaggagaagcgggctataaacttatagccagcctggacacaagaaccaataaactttctaagagagacaagtggatcctatattaattgtaaagagctaactattatataggtagactaagagaaggctaaaaaaaaacttataaccaacatgttagctgtattattagccttgctttgagggggtgtgcagttctgtgtgtgttgcgtggtgaggggagtgcagccaatccggccgaggagatcgtcgttcaaaaagttgtcccgacacggccagagttaagcctagagattggtggcctcatgtcctttagtttttgatgactgatccatgagagagaacacggaggaagcaagcggccggccaggcaggtatcttttggaatttgcaagccttttctcgcttctccaagtttgaaccattcatccctcgatcagcactacgactagttgttgtttagttcagtgcaccaccttaaaattgcagttaagtgcatgtaatcctctcttatgtacaggtcgtaaacagtagaaaaatgaacagcagaagcaggttgagaggagaaatccaatgttttttacacgtacgcttctcaaaccactaaatagtatgtcttctcataacaaaaaaatctctacgaaagtttatttaaaactcatattaatctactagtatgtttcaagcttaaaataattaatactcaattaatcttatgctaatgattcaccttgtttggtgtatattctcaatattttctaatcctctcctcccaaacactccctaagcaatcaaaataatttacctaataaacttttatacctgtattaccgacaatttgagagctaagaaaccctccaaatcaacttaaaactaagttataaaatttaaatttaagatgcgggtaataagcaaacaagcacagtcgatcacattcacatgcatcgatctcgtggactcctgccgatgtggcacagcacagtcgaccagatggattagtactataggactagcaaaaatgcattcaaatgattaggtcgatatgaccatatcattagcaaaacattggtctcggccggaggatctactccgctaggatcgatgcggagaacgtacgccgccatcatatccaacccaacaacccatgccgggctttgcttgctttggcgcctaacggttggcgggcccacgtgacatgacccatcagtggtacttcctgcgccttttgaaaccccgcttccggggcccacgacccggcccacctaatagctggcctcgggctcgagattgactgacgcttttgtcccccctgctttcgagggcaaattaaacttgggagtagtgaaggagttcatccggaaagcccaattgcacatctaggagtagggaaggaaaaagggcccagctatgtgctgggccgaatctggtttcagctggattttattagcccatccttgaccagcctgaaacacttggtcaggccagcccatgacactctgagcccggtacagaacacacacacaacctggcctaatcgaggccctgaaacggaaagtaatgttgcagatggaatgcatttcacgacatgacagcatccgcttctctccgtgaaaataccgtgcaaacgcataggtacaactatgatcaccttaaaaaaagtagatcgatatattttggaattgataaagttatcactgtcttattatcgacaagtatatcgtctatcactaaaaatataattggccgcaaatacgagtatcttttttcttaacacatgaagacgcgcacacgcaaaacacaggtgtcactttcgatattggtggtcgttttcttcagcatcgatctatagcaaagcatgcagactggtcatgaatcatgatatttgtcacgaaacctttgacgccgttggtcgtttatgcacgtttctttgactcgacgcatgcgccgttgattagtgctgtgtgtttgtttgttaatctttcgatgaacatattggactagctagtatgctatcaacatatcaattaggcaattaccatcaaaggatggcagcacttggggccacattggcattatctcaatatctcggaatgatgtgaccgaatacaaggaacatgatgcggatcatgattcgctggatcttgttttctatagtaaagaacagtgcaacacatgcgcgcaaaagattagtgcaaaattgagatgattattgcacatggatgcatgatgcaggagggttcactgtctaatactatgactgcaatttttctctccgacgagacctgtgtgatttgatgattgatcaatctctctgtacacttaaggtccataaatatatctggcaaaaaaaaaaagggttcatgaataatatgcatagtgacagaacacctatcactttttttttctatagaaagcaattaagattcatctttttgtaccacacaaggtacaatggtagttcaagtaacatagatatcccaatcatcatttactcattcagtacgtcaacatcttaaagatgaactacatggcacaaaaaatcttgtcaggctgaagcagatgttgatttggagagcatgactcttttgaacagaagaccatgaactatagctgggggaggaaaaaaacaactgcttgattcttgaacttcctgtcactgaaatgaggaaattctttgttattgcacaacgtcgaacctacttgcgaagtttttcagcacatcatccaacgacatgtaaataactaacaagttgccttttcttgttattgaacttcagttggtataccagtgcactcttgcttacgataggttgaaagcacatggaaggaaagcattgaccagcttgattatcacataaaagaaaaattagataatccacccttagctgggatgtgtgaggtagacactgatgtcaaatataaggattgaaacaagacatgtgtgaatttaaaagaaacaacttccaggagcatcgatatcttgttgtatagtatctgatgaagtatacattgatgtcagctacaaggattggacggcatttgcgagaacttcaggatcacatccagctaaaaaccattaatacatcagggccagtggtaatagctaagcaaaaggaaacttccaattgaacatgacaaatacacagcacatcgatccgttcatcataggttggcaggatcaaaacgcccttgccactaacatcaatcccatgtgacaaaaaagaagggaaaaaaataaaagaaatagaagaagaaaagaaaaggaaaacaaaattcgacctttcctctggaccactatggcagtatctagtggagtaaatgacaatcggaagcaatggctaaagagacaacaaagtgtagtgtacataatacaacaataggaaggcctaccgatgacctcgtcagcaaagctctgctgctactctgtaaaacttacctgatgatccatgaagtacagaccagtgtgatcacagagtagagagcagagttggcagcagcaaagtctggagattcttccaatgcaatcatgtcctataaaagcaagtgccattatgtcattctcactaaccaatcttttgaggatttttggtttgatccatgatgataaacgtttgtgtttgttgcaccaatggaggagaaggatggatggatggatggatggtgttattgctgcgtgttgttgtgggtggcgaagccgtcgacgagctccaccgggtagcggtcaatgcaatcctcccaggggctctccggcgacggattgacgttgcggagagcgtgccagacggcgctgttgcacttgaacccgctgccgaacgcgatctgccagatgcggtggccgcggcggacccggcccttggcctccatgtaggcgagctcgtaccagatggagctgctcgacgtgttgccgaagcggtggagcgtcatgcgagaggcctcgacgtggaccggctgcagctggaggttcttctccagctcgtcgatcacggcgcggccaccggcgtggatgcagaagtgctcgaacgcgagcttgaagtccgggatgtagggcttgatcttggcgttgaagagcttcttggcaacgagcgtggcgaagaagaggagctgctcgctgaagggcaggacgagcgggccgagcgtggtgatgttggtcttgagcgcgccgccggcgatggccatgaggtccttggacagcgacacgccggtcttcccctcgtcgtcctgctcctggtacacgcagttgaaggccttgttgtccgcgcccttgtgcgtgcgcacgacgtgcttgagggcgtacttggcgcggcggcggtcggcgccgcggttggagagcagcaccgccgcgccgccgacgcggaacaggcagttggggatcagcatcgacttgcggttgccgaagtaccaattctgggtga

SEQ ID NO: 60466 - DNA, 1402 bp, Oryza sativa
agtggtggaggaactcgtcgaagcggaccttgagcttgtcgggcggcttgtagcaggcgaagtcgacgaggtagacggggcgtgggcgggtgaggacgtagacggtggcgccgaagacgaggacggcggagaggacgaggacggagacgaggttgtactggaggtggagccagagctggcggagatcgtcggggtcggtgcggccggcctcgaggacgatgacggccatgagcggcagcagcaagagcgtgaggaggtgggtgatgaggtagtggtaccccagcttcacgtacttgaggttcacgctctggaggaagtccggcagccgccggtggctcggcgtcgccgccgccgccgccgcgtcgccgccgttcatggctctcgcctagatctgatggcggaatcaatcacccgagtcaaagatgtgggtgctcgtccgagattgcgcgtggactggactgcctgcctggtggatgaacggattgttcgggggcggcgatgattggggggcagctggagaagagtgggagcggaggaggaaacggatgcgaggcgattccgccgccggcggatgcggatgcggcggcggcggaggaggaggaggaggcggaggcggacgcggacgcggttgtttggggctttgtgagaagggagaggtgagggatgggtggataaatagaagtagttaaccacaggcgaggcgaggtgtggtatagttaatttgaaggaattttttcagggaacccctcgaagtgttggagtattaaagaccgcaggttttttttccttttctggaacccctcgtagtgttggagtattattgcgatattaaaggccgccgggtctgcctgttcaagcgatcccattccctcccttgttaatgtgattgtatttaataataatgttgtttgcttagcaataatattgggcctacattgtttattagattttcacttatgtgctcgaatcctctaaaccagtagttttggatgttccactgcactattatacaattttttgtgaagtttaacagctgacatcagttttttttttaattctgttcatttttcgaagttgataatttgaaagtagcacagagctgatagtttcatatacagtcctaagtagactataacaacgaggaaagacaattaatatccaactattttcaaatagaccgctaattggtatttttggtaatgcacacatgcattgttaacttttactcatacaagaaaaacaaatactcgcatattttcatcttaaaacagtcagttcagattcctttcaaaagaaaccaaaagaaacaggctcaaaattttgcagacaggacgagatgcccaaacagaaatctctgttctcaccagggcgtggctgaaaagaaaggcatgaccagagtgaa

SEQ ID NO: 60467 - DNA, 2868 bp, Oryza sativa
ggacggctccggctggttcgtcgccggtccagtggacggcggagattctcccaagtgagtgagtgacggatgaacagatcagaggaaaaagcggccggccgcgtcgtgcgatgagaagatgtgatgagcagttgatcgcgacagcggcgacgttgcgcggtcacgaagagggagatatatgggcggagtttagctccaaaatttttctttaaactattaactttttcatcacatcaaaattttcctatacataaactttcaattttttcgtcacatcgttccaattttaaccaaactttcaattttaacttgaaaacacacccacggtgtgaatttacgtacccctcctgttgcacccgtgtgccattgtcgtactcatccttgcaaagggggaaaaaaagaattccagctgaaaatagtagttgaacaaacgtaccaacatatactatccaaatatgacctgtttggttggagggagtttttaaaatggattggaagtttagagggatgaggctattaactattttgtttggttgtgggacatgggaattttagtgggatggagatatggaattgagaaataaactccctccttttcaatacctgggtaggggcagctaattaggagagaatttctcctttactttgcctaaacaaatctcagccatccgttttcattaatgatctaatctccaactaaactccctatcaatttccaccacctctaccaaataagagactgggataaaaaatcaaattcacatcttaatctcaccatcaattccctcgtgtaaacttccaatccccttccctcaagttgccaaacaagccaatagggtttgtttggctgcatgatacgaacaacactaaaagagtgcagccgaacatcccatagacattttttccttatcaaagggtctgagcgagagtctgagccttcattttcattaatagaaatgagactagaatatagaggtagcaacagagtcttaagagtctttagataccacaaaaacaaaaaataataataaaataataaaaaagacagagctaactacttaaggaagccgtttcgcttattcacggaataagcaaaacggtatctttgcaaacaaaaataatttgtgaataaaacttttatacacatgttctttgcaatataaaagtaaagcctgaaaaataaacttcaatgaaaaaccctcaaaatcaacaaattcaaattttggttgataagtataagtataagaaaaaagatgatgcagcagctatattacacagtaaagaaaatgtatagcactgatcttacaatgcattgttactgaacaagaccatagttgcgggtgaaattttgtaaaaaagattatgaatacaaatgtggtaagcctagacctataacattgctcatgactcacccccattggtttattttgtatgcctgcaaaaattccgaagtaggaatagtaggtgacattgtcaactccccaaagaaaaaaaaaggacgtttgctattagtttgatgaaatttgctcaacaaacttacctgctgggttggctgcagtctgcactctctcaacacatgattaatctggccattgacgcatggttggcatcgggaatttggaagtttgaaggagaagacgatcttttttgtgcaaaataatgttttgaggagaaaaaaatttcgaggagaagacaaagtcgctgcacctgtccaagcgtcctgtttgatgtgtagacgactttgcaagttagctagcggtggccactgccaagaaaattccgactttgcgacgactcgacaaaacgaaaggaagaaatcgcgaagttttccatggccatgcacgtccgatctttctagagggatgagtaaagtgtgacatgaggtttgtttgagagtttttttaattccgttgtactccgtagcttctctaattttttaaaactcttttaaataggaacttcccactccaatagttcattctactaccctcgtagtatggttcagcttttttttttcatattatgtaggtgtaataaaatttatataaaataaattagaagatggttttctcagtttgtttagattctcatcaattagattttcactatctgctactcagaatttagaactcccaaaagaaacccataaaatttcatcagacgatgctgctcttttcaggaaatttccgagccaaatcggcaaccagacgagcagccgggagagcgagttggtgagatttggttaagtagctgcaacctgcaaatacgtagtcactgaacttgtctatccatccaaagtcatctgagagattgtaaaagagtcctgaatttttgtggcagtttgttgatctgatcacagagacagcaaaagtggattaaccactggaacatccattaaccaactggaccaaactttcacataaacaatcatgcatcttcttcgaatcagagaaagcaagagaaagacagcgaattcaattcatcccctcttcttcttggtacagaaagggacgtgaccaacttagcattaatgatctcacggcagcacagtgagaagttgacaggtactgagagaattgctgtgatcatgccatgcaagatcagacatcctacctgctccagcgtccaattccatcagagaacaacaggttagttaatactttcagagaacaacagtgtattggaatgttcttgaatctaatcacattgatgaagggatcaattgaacagcggtgattcgttagtatgtatcttgctctttgatgatgctgtccttgtctctttgagttcagctttgatggatgaactgataggttcatcatcgccagtcgccactgtacttctttttttgttgtgatatctaaagct

SEQ ID NO: 60468 - DNA, 1662 bp, Oryza sativa
gttaggtctgcgaaacgaaaattgcatatgtggtgaccaaccaaaacccatccaagtttcgaaattgattgtttagcatgaagaagtcaactagctagctatttatacctccgttttttaatatcaacacacttaaccttttcttgtctcaaactttaaacatcattttttaagagaaacgaaaatagtaccgtcagaactttcatcaaaattactttaagcatatccatttgcttatctatttgcagaaatatttctaaaaacagaaatattcaaatgaattaaaaagcaacctatgtcgtactctccctgtttcacaaaaaataaaattctaataatgaatctcgaattttttgtgaaactgaggaagtagagtatactattaaaaagcggagggagtagtacggtagtaaagttaggtataaccaataggtgaggagtgaggaccattgagcaacacaggatatagtcattacattctcaattacaggcaagtacggcatgtctgtgactgcagtggtggaggaagctgactggtgagcagttggtagctttgacagactgtactgaatctggagatagcaatccgagagaccatgttcatgacacaaaaattccggcctggcaaattcagatgatttgctagaccagcttgggaccatgtgagacaatcagattaatttgccataatgcaatttggtttagaatgcaatggcaatttactggtacaacatgttttccaggtggcatgtgaaaagaggatataatgcaaacctgtcaaaaagctacgcacccttttactgtttcaggcctttcagaaaacacctcctttttgtaacagaaacaagcaggacaagcactgtaaactcaatgatgctgcaaactgaagaaaatactcaaaactgaagaagcatcagaaacactgtatggctgtaagctttcatcattgtacgagtgacttttggacccactatctgaccatcttctcactccagttgctatacaacaaagagatgcacagataaattgaatagacaaggcaacttttgaaagagcaagataatatttagacagtttttccctaactatttgggactttttctagtgcatggtcttggaaatgtccccctgttaccaccagcatcaggcatccaggcatgtgcaaaaagattcaggcctacttcttggagacaatgcctcatcgatcttgcaaaggcatggcaactcaccttgcagacgctacatgccattgccctctaaaataaagtaactttaggtgtaagatgcaacttgtaacatgagctgttcctcttggacacataaaaaaatggaagggcagaaggtcatgcaatcttcagttaaatatatcacctacatctggagccttaaacaaaaaggtttacttgcatggatgtttgagagatatcataatcttcactgaaataacagagatgagcatagcaaaattgtttggtatagtagtgctatcacacatagcaatttgaattttcaaacttaaatttggagccgattttgaagttttctcatcgaagtttatttttcagtcttcgcttttagattgctaagaacacatataataaaagttttattcacaaattactttttgtttgcaaatatatcgacgatggctctggtacccca

SEQ ID NO: 60469 - DNA, 13765 bp, Oryza sativa
aggtcaagaggtcacggatgtacgtatcattaattatcttaatctagactctgcactttgaccagatggacaagctttcctaagaactttcatgagcagagtttagcagccataactcgttcctgtcttgcgtccgtagctggtgggttgagctaaggttgatatccaaagaaatgtgaaaagacaataaaaaatcatgcataatcttttatatcagataaataaggcaataaaatttgttgtttaaaagttaaatctgaaacatagaccataatatttcataaaatcaactctaaatttaaattttagctgtgtctaagccaacaagcagataacgaaagcgtgtgtaactggttactgtagccatgaaaacatggttgaattaagctagctcgatgatgctgttgtaacgtgcatcgtttgacatttagaatagatttactgatttagtccaagaaccatcgttctaacctcaattttccttttctcccgcagggaatggcacctcaattgtcatccatccaacaagaatttcaacacttaataccagcttggtgacgctgttgtaacgtcaattgtttgacattcagattagatttaatacaacaaccatatagtggagtttctaacctcaatttccatttttttaatggggaatttcaagatttcaacacttaagtaccagcgaagtgccgggcgatttctagttggatgtatacgaacagagggtacgaattgatgcaagcaaaccactgttttttctcggtctgatgctaatataaattcgtgcagatagtacaagaaccatatagtagaaatagatttctgagtgaattattatcatgggctatctacttgattataaagataaattaaatattttaaaaaataagttaacaaaacaggttagaaaaaaagtttaaccaatcagtagattttttaagtaaattacacccacagtgcaacaacttgagagcaataaatgtctaagtgcaacaacttgataaatgagtgtattatatagtgcaagaaatattctggggcaacaacttatgtaagtacgtgctattttggttaacaagtactaggcgagttattttcatgatattaatataacatcatatagcaattctatagatattgcctaatcttagcaattctatggatattacctaatcttaaatttaatatttaaaatttacatggcacatccaattcgcatcaccggtttgatttttttattcaccttctgaaatctcaattgaagtataatattttctacatagtaaagattaattgactttcaattattacaataaaaaaactaaatatgtttatgcaaatccgtacaagtatagtaacaaaataagtactaaaaaattaaatatgtatatcaaatgctcaaaataattaaattgtcatatcacttcttaacttattggactaaaatgaaaccgtcctcacaagttgttacactcgtacggtaattagaaagtttttgcgctaaattacaccctcctgccttgttgcaccgcaaatataatttactctttttttaagaaaacatttttgagaagaatggatcaaataaactataacaataatgtgaagaagcagccgagaagaacgggatctaagctagctcggtgtcgctgttgtaacgcgggttgtttgacattgagattagattcagtacaagagccatccggtggaatttcttgcctattttcccccctttcttttctcagggaatagtacctcaatattcatccattcaatttcaagtttgcactcactcaatatcgatgaagtaccgggcaatttttctagtttcgatgcagacggacaggggatatgaacagaataaagaaaacggctgttttttttttctcgaaccgattgccacaagaaattcgtgacagttacgtgctctagaaaatgaaatggacagggtgactacgagatgaagtcgagagtgacagagcacgtgtacacttggacatggacgtgtagaagaagcaggcaagcagcatatagccctgatctgatgacctcgaaagtgaggaggcccaggcccaaatatctgtcaagaaaatcacggcccaatactacaaggcccatatctctcgcacgctgaaccgaaccgccattctcccccgcggagtaagcccgcccacccacgtgggctccacgtgtcgcttctcccgaggcccacgaagccactccatatcttcgccatatttagcggagcacacgcgttcgtggcgagaagcagagagaggagagaaatccagagacgcctcgacccctccatcccgatcaaggcgagaattcgtcggcgacgatgctgcgcgcggcggggaagcgtctcctcggcgttgggctgcgcccggcgggcggcggcgctggagaggcggcggcggcggcggcggcttcggcggtggccgttgtgaggaggagggggtaccacgagcgggtggtggaccactacgacaacccgcggaacgtggggacgttcgacaaggacgaccccgacgtgggcacgggactcgtcggcgcgccggcgtgcggcgacgtcatgaagctgcagatccgcgtcgacgaggagtccggtaggatcgtggacgcctgcttcaagaccttcgggtgcggctccgccatcgcctcctcctccgtcggtgagtaaacctagatccccagtatcggtgtgcttgtgaaaatctggtgggtaattgtacgaatgatggaagtgactgatgtcgcacttgaatgtggcgatgaaatttgtaaaatagggaagttattgtaggttttggttccatttcaatcaaattctattattgcaaagcccttagtattgaatagtgccgtccccgctagttcaaaattacgaatatgcctacctgagcattgcaatattgtgaatctgagaattatagtagatggctgaaattgagtttgacttacttttttgtgatgctattggttctaatattctacgctgttgccttaatgtgttcatattagtttttatagggtatagatatatcgtgtgggcattgtatatttgtagatatcatatatcctaacacagaaattcccatttccacggctagtatccagattactttgtggatcctatgtcttatgttaggagacaaggccaacatgttaggagagcagtcactgaatcactcacaagttgttttgaggttgatcaaccaactgattcagtgactgctcttgcttactatgttaagatttgagatagtgataagcactcttatgttgaaaactgcaaatatctgtacattattccataaattcgcatttagcaattgaactctgttgaccttttaattgtttgcaagtgtcttttaggtaataacatgaggacgtgccgttatgtatccaattaattgctgtctccctaacatgttggacttgtctcctaacatgttgccattatgtagccaatctagctgtcattgcggtcacaataacatttgacacacttgatatgcatttagggtgcaccaaaaatatattgacttcaatgtttaagaagccgaaaaagttaattttgcatggagtgtcaatcagttaaacatacttgagatacaattttttttgggtttagaagtctcttttagatataatatgcgtgcttatgaagttataaagttgaaatggctattggctggctctctctagactgcatagatacaattcttactatcatgcatggcttttcctaatatcattattactatattacaattgaggttaaaaagtttgtctctctaatatagttttaatttcagccagtgagtgggtgaagggaaaacaaatggaggatgcagcttcaatcaagaacaggtaaataactgctgtacttgctgatctagtccttttttttgtggggtctttgttttcttgttgatgtagtcttttcattatatgttagttctcagcaataaaggttgttttctatgttagttctcagcaataagattcattagtttcttgtgagatacactagagtgtcctctagatggctcggtggtatgggcttcaggatatgggcttgattttttttgcagcattggtagtcataggatattttctgttcttatttgcttgatgatatctatttgcttttatagatttgagcacaatgcctgattgctgatttttcttggaagcattggctgactcatggtagtgactaccatgtccattgagtctgcaaattcattgaaaataccagggcaaatgttaaattcatgtatccttaagttttagcctgtcttttttactatagtttgcttggagttttaatggtttccaattgcatgcctgggacaacgaccggtttttctggtagtgcaccagcacatctacatttatttttacctcttgcgcagctgtaccctgcatctgaatgttaattgtcggaacttcatagtaatacttcaggactgcaaattttatctagtgtaaaatttagtacctcaatactgattggagaagaaggagaaaacaatagagcaaactgatataaaagagagaagttttaacagcaagctgaaccactttatcttctgcaaaacccaccccaaagtgtgttgtccaggcctgcagtaggcagtaggcccacattggtgttcatctcatatctgtgaatggttagatgcaagataaggcatctaatccaaaagaagaatggaggtggaaaacttaggtcttctaaatcccgtgaaattcccgaatgcttagttatctattaactaaataaagtcatctatttgatgttacaagttctctcttttatgtcagcttgctccattgtgccttggtattaggaggtaccaaattttttttataatagagaattattactttctgcattttgtaaatgtatgatactattaatataaatgtctatttgcacaaatatttatagaacatatgaagttcgaaatgaatttaaaaaagtcaacgatgtcatacatataaccagaggtagtacatctcagggatcgtaggctcatccctcatttttaggaaacatcctttaccatattattgtgagtttcacttacaatcctattgtcttccgcctgtggctagcattgcttgggcacaagctttattgtgctcattggagttctattgacttatcatgtcctgttttcagtgagatagcgaagcatctatcgcttccgcctgtaaagctccactgcagcatgcttgcagaggatgcaatcaaggccgccgtgaaggattatgaagcgaagaaggcaaagttggataaggggaacgagtagacatcctaaagagagaacaggggatagtccagtagcatagcatgtactagtatcataaaatgtgtgatgatgtttatattgccacggaaataaacgcatgcaacgttatagtttgtattaggcaaagcctgcccctggcagcggttcgtccagctatagtacaccacatgttgtcgaaggtgtacacgaaggtatgcaatacttgccagtgtcgtttgtacccaagttctgtacatgaaaagtgtttgagactggtgagtctaatgtagaaaaggcgtttaaccaacctgtaaatgatacagtaccctagtattgtagtacttcgtccgtttcacaatgtaaaactttctagcaatacacacattcatatatatggtaatgaatctctacgtatattgtaggatcgaaacacaaagaactaaaccaaccagagggggatgaatggttggtatacccaaaaacccaaagtttttgcggaatcaaaagttacccttaaattcgacggatcacggtaaccagtttgaccgcctggaagtcgtcgtttgactgagatagtaacaccggtcgaaccgccgagatcagctcctgccgtctgtaatcgttgccggtctgacagcaggtactccgtcggtctaactaccgcgatgctgccagtctaaccaccgatgtctcgctggttgggccgccgcacccgagaaaacacaaatcgaagaactctcgaagtagatgtctcgccggttggaccgccgcacccgagaaaacacaaatcgaagaaatcttaaagtagataacactttattactcttatatgtgtttacaaagtgcaacaacagactactcaccaaaatctcgactaaattcgaaaccctaactaaatgctctcaaaagtgataccgggaagcctcacactccctctctatttatacacgaggtaggcagcctaaagccacgaaccaaactcatactagaagtcctaatccacctaggaaaccttctcgtaccagaaacaaactttacaaactccaatcataacaaatttggactccttccaaattcaactccgtatcccatgtgcacacaatacctccatcgtatgccatatggaatcttcaccaaccacgtacattgaactctagcctaagcatcccgcatgatatctgaccgtcacggacatcgccttatccccaagtcaactcccgatccatcaccggcaatactctcccgagacatcgagtcacctacacatgaagcaaataaagaaaccatattccaagaccaatctatctccaacttgactcattagtagcaaacaacagtattacatacacatagtatccttctagaaaacataaacataaaacaatcacggatatccaaacaaacaacccgaaaccaaaaccaacacagggtcggccgatcaaaccgcgagctggccggtctgaccgctcgataaccgccggtctgaccggcaacccatgcccggtctgatcggaccaaatccagcaatacatgtttaacacctgtaaatccaatcatctccaaaaccacttcgtcaataatcttcaaatatgaaaaccaataatcacatatgtcaattgttcatcacagaataataatcaaaaacacctttgattttacacatatatgtgtttagattcattaatatctatataaatatggataatgctaaaaagtcttacattgtgaaacggatggagtatatgttagaacatagtcaagggctcaaggctgctgcctgttgtgcaaccctgtcctgtttcttttatcggggctcttttatgattgaaacgcatatagacgtcgatagtccatttcacagaggcatgaaacatgtggcgtaatctgtggactttgggctgcttacggttaccagcagaaagctaatgggtttggcaaatgtggcttccagcagtagtggtgcatttgcacttcagctagcagctggaaatgaaacagtttggtacagacgttacgctcttcaggattcaggaacgtggtcttgtttgtagctatggaagttgggcactagagtacacggttttcattaactcgggttcactcgataagatacttgcagaattaaacacgagtaccctcactctcatgcaccacgcaaaagcttaagatccattgcaaccttcaagcctgcaagctgcttatccaagcaacaatagtttaaggaatagcaaccatatatctttgcctatactccatccgtcccataaaaaatgaatctaagatcagatgtgatatattatagtactacgaatctggacatatgtatgttcagattcataatactaggatgtgtcatatccggtactaggttggtctctgttcataaaaaaacgaatctagaaccgaatatgacatattatagtactacgaagacatatgtatgtctagattcatagtactaggatgtgtcatatccggtactagattggttttttatgggacggagggagtatgtagttagttgcctgcttacacacaccgttccacaattaattcgtagtgttgttccttagtacgatttgtctctgatgtgtcttgagctaatctttcacgcgattggtaataccacgatgtactactaactagcaggggaatttactatttgacatcctccaacaatcagtttttaaatatcactctcctaaatttctgttgtaatttactacccgatcttcactaattctctctcgtgtgtcactctttgcccaattcctaactacgtggctggtttttttattggcccgtggatgccctcataaaaagaccaaaataccctagggatcacctacaaggagcggcttaagaataggccacactattgcagtcactacggtcagccgcactgatgagcaggatggcaacggcaaaattgcccatggccgacgagtagtagaggatgagaccacctgaggaagccaccagcacacggcccccacgcatggtgcgagcgtggtagaggttccaggaacggtccatagcatcaaagacgagcagtgagtgaggacagttaaagagcatgagcaaccagtggtccaacgagacagggcacaccagttgtcgtggaggtccttgttgtaggtccttgttacaactacagaggttcgtaacagtcctcaaccctcgcggcgggcacaagtggtagggaatgaaagtttagaaaagtgacacttgaaactgtctttttggaaggacggtaaataataaaatctcccctaactagcaaattcagcttcatctccctgctaaaaattaatcagctacctagtcagagcatgattgacagattgagactgaactttgacgtggagatccaacctagctccacgtaaacatttccatggaattcgcacgtgcgaaataaccaatggagaggaaaaggtacatagatccaaaccaatggcaattgcacgtaactatgatacgatcagttgccgaagaagttaaaggcagtgcaaggccaaacgagacgatcgagcgcccgtttgatgcgacacgccaacccctgcagccgtttcgggggctcccggcgagcggctttccgagttaggcgtgccgaagttgctatccatccatcgtatcatcatcatcagccacctcgcgtcacgtcgtgccagcctcccccgcgcgcgcatgctgttcttcttgtacagtgcagtatataagcgtggccgtcgcgcggcgaggtgtgtacgccgccgccatcgtccgtacgtcgttgagccgccggtagccatgcagtatacggtggaagggagcggcggcggcggcgtgcagacggtggaggcggcggtgcgcaaggggccctggacgatggaggaggacctcagcctcgtcaactacatcgccgccaacggcgagggcgcgtggaacaccctcgcccgcgccgccggtacagtggctgtggcatggcatccatatgctccttgtcaactgattggtccttaaccattagtgatgataaaagacaattaccattataaccttctagcttttatacctggcccacactcttaagtacctttgcatctgtaccttctatcttagctctaatatataccaagcatagtagaaaatctctctctctctatatatatatatatatcttcacgccatcaagctgcagggcttaaccgtaccgggaagagctgccggctgcggtggctgaactacctgcgacccgacgtgcggcgcggcaacatcacgccggaggagcacacgctcatcgtcgagctacaggccagatggggcaacaggtaacgcacattaactcgatcgcctccatcgcaaaatattgctatgacatacagcatttatgattccgagatggtcttccgtttcgggctctggcggaatgacggttttcacgaaatccggtacaaagccggtagattccgaacaaatttcgtaaaccaaactttaaatacaacttccctgagtttaccgataagctcgcgaaaaccggtcagatttgttaaattccgagcaaaatcatcgaaatttcatcagtaactagaaaaagaggtaaactgagattgtttttctttttttaatttgttattcttttctttcgtactgtaaatttcagtaaatacatggaatacatcttttttttattttataaatatcatactatttataagattttatttaatttttttttccttttttatcaattcaaatttgaatttggatgaaactcatcaaaatctcagacatcttctattttggagcctcgtcgaaacctcgaaatttcgcgaaattcgaccggttttcgttggaattgtgaaccctaacgacacatgctaatattacgaatctacgtatatatatatccaaaattatagtattagtatgtctcatttagtactggctgacaaaattttggaagggatcatcgatagattgatcacttggattcttcaggtggtccaagattgcaaggtaccttcctggccggaccgacaacgaggtcaagaacttctggaggaccaagatacagaagaagcacaggaaaagcactgacggaatttacgcgacgacgacgagcgaaagcatcatgcctgcggctacagtgcaccagaacacggtggccgaggaccaaggcagcagcagcgtctccggccggaccaccaccgccaccgtcgccgtcacgcaggagtacgccactgaggcgccgccgccgagcggcatgagtagtggtagctacttggaccagctgcagccaggctacgcgagctcaatccatggaggacaagatggcggtgctgctgccgccgccgctggtgacgtcgtcgtctccgacgagttcttggcagcgtcgagcgacaacttctgggccctcgaggatttgtggcccacggtgcagtctctccacggcaattgctgaatggatcatgggtgattgtgttcgatcatgtaggccatagcaaatctatctattaacttatcaaagaaatagaaaaaatagccttcacattcgctctcacggcttaaaaattcccacattaatcggagaaaaagaaaaatagagtccatatagaaatacaatttagaaatagttgaaattcggaattaaaaaataagaaatattagaagataagactagagtacatatagaaatacaatttacaaatagttgaaattcggaattcaaaaataaggaatattagaagaggaaactggagtctatatagaaatacaattaagaaataatagaaattcagaattaaaaataaggaatattataagtagagtatagagtccatatagaaatacaattaagaaataatagaaattcggaattaaaaataaggaatattagaattagagtatagagtccatataagaatttaaaactaactaaaattcagaataaacataataaaattaaaagtagagtttagagttcgtataaaaatacaatttacaaataactaaaattcgaaattaaaaaaaaggaagaagagtataaagtcaatataagaatgcaatttagaagtaactaaaattcgaaattataaattaaagaatattgaaatatgagtttagagtccatatagaaatacaattaaaaataataaaattttagaattaaaaataaataatattagaagaagagcctagagtctatataggaatataatttacaaataactaaaatttgatattaaaaataattaataactaacacgtatataaaatacaatatgaatactatacattagtagtttcgtaaaggtagtacaaaatttaaaattatgttgtcattttaatatatttcaataatacattgagaaaacatatatgttattatgtgacaaaatataatgatgctagccacgcaatctgcgcgggccaccatgctagttagcaaagtatctgtatatgcacatcaattcttcaaaggaaatgtataaaccggaatgtatgatttggcaaatccagttattcaattcttgcagcgaaacaacgatgatacaaaatgtctcgaggtgtaatgcaacacaaaaaattgagcaagatttgggtgtcctagtagcctagtgcgtgtgttcgtcagggaggtcaggcgattgacaccttggcgccgacctcctcgagctgcttcttggcctcctcggcctcctccttgctcacggcctccttggccttcttggggagaccctcgatgaggttcttggcctccttgagcgccaggttcgtcagcgcgcgcaccaccttgatggtcgcgatgcgcgcgctgctcggcacctcctcgatcaccacgtcgaactccgtcttctcggcgggcgcgccgtcctcgccgccgcccgcggcgccgggcgccgcgacgaccgcggcgggcgcgaacgcggccgcggacacgccgaggcgctcctggaggtggtccacgaggcccctggcctcctccagggtgagccccgcgatggcgtccccgagctcgagcaccttgggggaagaagccgccgtggagttgcaggcgacggagtggcggccgccgccgcggccgcgggtggtgaaccggagcgccgcgggagcggaggaggcggtgcggacgtggaagaggggtagggtggaggagacggcggtggaagccatggccatggcgagctcgcgggttcctggatggcgcgctctgctctgcgacggggagaggagaaaaacgcgggaggagggcgcgcgcgataagataaggcgtagatgggttcgagtgcgatgtggccacacctcccgtgttctacagccgttggatctgagatggacggccaggaataactcagaaacttgcctatgcctgacgtggcatttcgagctgttcaaattattgtcaaaaataacatttccaaaatttagcaatggccaaattttagtacgctgataacatccccaacattaccaatagtattaaataacaaaataaatatttattaatttactaaaattatatagttcaaaataacatccatctaaacaggtcctcctgagagtggattttgatcccttgaggggtttgtatctcgctcaaatggttataaaaaaatataaaaaaaatttagaagatgtatcaacatgtgatatattactctagaaacataccagttcaaattgaatttctacatctcacaaaaaaaaaattaaactacagctagttaacatatattcacagtaaaatttatttttttgttatgagatttagaagttaaatttgaacttacatgtttgtggagtggtatatcacatgttaatatatcttcttaattttttttaatttttttcataaccatttgagtgacatgtaaccacaaggggacaaatagtctcccttccatcgtacttttgcactctctatctactgcctaatgacacacactgccaagcgatccttctttgttctgctcaagattcatgcagaaaaggaccagattagcattcagtaacaacttttcaacctctggcttgaacaaaaatccattctctgtcttttgctgtgcacaatgtgtcagaaaaaagtgctaggatccttggctttgtcatggccaaaaaggggaaatttggaaagtagcaaagttccaatcctccccttccacactaaccccagcctttaagctcactccaagcatatttacccaagtgatattaagtagcctccaaattgttcttagctctctctgcactaagcacaggtttgcgtgatgtcgatgtcctcgccggcgacgcctcttctggccggcggcgcgcacgccatgcggccgccgcggcaggacacgtcggcggcggcggcggccggggccaccggcgggggcgggtcgtacacgccggtgttcatcgtgctgggcgtcatcgcggcgctgctggtgatctcctgcatcgtggggcaggtctgcaccaagaagcac

SEQ ID NO: 60470 - DNA, 834 bp, Oryza sativa
cctggagagaggagaggagagagagattaacagaggggagagtcggagagaggaggaagaacaggaggaatgagttggactgacacgtcaggctcacgtgggtcccactatttttttttaatttttttacatgaaactgatatgtgggttccacgagatttattatttttttctatatcaaattgccacgtaagcgccaagtcaatgtcacatcagatgaatatcaagtcaaattagccacgtaggcgccacgtcagccaaaaccgctctaaaaaccgccgaggaacctaatctgcgagattgctattcggcgatcagtcgcgcgccttcctcctcgcgcgactggacacgtgtcgcgcgcggagagggggcggcgatgtgccggagggaggagcgagtttttcggtttttttctccctttttttcgtttatattcggttggttttttcatcggttttttcgtttctgtttggttttttcctccggtttttttgtttctgtttggtttgttattttttcggtttctcttctgttcagcttttttttcctttttttttcaagatgtataaataccaagtttgtattcgtacatacagaaagtttgtatacgcgtatacaaagtttgtatacacatatacaaagtttatttacgcgtatacaaactttctattcatgatgtatttttttattttttatgtgtatataaactttgtgtatgtgtgtatatattttttatgtattgaaatatcttcataaatatatatatatatacgcacgtatatatatagtatatacatatgatgtacatatgagagactagagggaggagggggg

SEQ ID NO: 60471 - DNA, 1673 bp, Oryza sativa
acaggctcatgagaatcagatgttggcaaaggaacttgagaacaacaactgtgagttgccggacaagtttgtggcaggtggcattattgccaaattgccaccttcttggacggactttgctacttctctaaaacacaagaggcaagagttcagtgttactgatcttattggctctttgagtgttgaggagaaggcgagggcacaggacaaccggggcaaaaagatcgagggaggttctagcgccaatttggtgcagaagaagaaccctcacgcatcccacaacaacaacaagaaagtcaaacctgacgtcaaacccaaggctacaaccaattttaagaagaaaggcaagggaaaggcaaaaggagattgctttgtgtgtggcaagcctgggcattgggccaaggattgtcctgagcgcaaggacaagaagtctgcaaacatggttattagtgagggcggaggaacattggggtatggtaaatttttacctacagttctctctgtctgtcactcacttgattggtgggttgatactggtgctaatattcatgtgtttgcggacatttccctattttcttcttatcaagttgggagaggttcctccttgttgatgggaaacggatcgcttgtggctgttcatggtgttggtacggtcgatctgaagtttacttcgggaaagatcgtgcagctgaagaacgtgcagcatgtcccttcaataaagaagaatctagttagcggctctctactgtgtagagatggttttagacttgtgtttgaatccaataaatgtgtcgtatctaaatatggaacgtttattggaaaaggttatgatagcggaggtttgtttcgcttttccttggatgatatgtgtaataaagttgtgaaccatgtaagcgatgatgatgatgagtccaatgtgtggcattcgcaactttgccatgtgaattttggttgtatgacacgcttagccaacatgagtttaattccaaaattcactttagtcaaaggctctaagtgccatacttgtgttcaaacgaaacaacctcgcaagcctcacaagtcatctgaggcgaggaagttggcaccactagaaattgttcattccaatctgtgcgaaatgaacggcgtgttgactaaagggggaaagaaatatttcatgacactgatagatgattgcactagattctgctacgtgtacctattgaaaacaaaggatgaagtattacattactttaagatctataaggctgaggtagaaaaccaactggaaaggaaaatcaaacggttaaggtctgataggggtggagagtatttttccaatgagtttacttctttctgcaaagagtatggaattattcatgagaggacgcattcctattcaccccagtcaaacggggtagccgaaagaaagaaccgcactctaactgagatggtgaatgccatgttagacactgcaggactttccaaggaatggtggggtgaggcaatattgactgcgtgtcatgtcctgaatagaattcctactaagcataaggaagtaacatcattcgaggaatgggaaaggaagaaattaaatctctctcacctgcgcacatggggctgtttggccaaggtaaatgtacctatagccaaaaagcgtaaacttggaccaaaaaccgtagattgtgtgttcc

SEQ ID NO: 60472 - DNA, 23605 bp, Oryza sativa
cacctagcacttctagtcaagaacctattttatcccctgagcactttgtgctgatagaacacattgatcaaacgctagaggaaaattctgaggagaataacattgtagcaactcgaaagagtaagagacaaaggactgcaaagtcttttggagatgactacattgtatatcttgtggatgatactccaagaaccattgaagaggcatattcatctcctgacgttgactattggaaggaagcggtacgcagtgaaatggactcaattatgtctaatggtacttgggaagtcatcgagtgtccatatgggtgcaagcctgtaggatgcaaatgggttttcaagaaaaagcttaggcctgacggtacaattgaaaagtacaaggcaaggcttgtggccaagggttatacccaaaaaagaaggcgaggatttttttgacacttattcaccggttgctcgcttgaccacgattcgagtactacatgctctggcagcctctcatggtctactcgtccatcagatggatgttaagacagctttcctcaatggagagttggaggaggagatctatatggatcaaccagatgggtatgtactagaaggtcaggagggaatggtatgcaagctgttgaagtccttgtatggtctcaaacaagcgcctaagcaatggtatgagaagtttgacaatacacttacatctactggctttgttgtgaacgaagctgacaaatgtgtgtactatcgtaatggtgggggagagggagtgatcttgtgtttatatgtcaatgacatattgatctttgggaccagcctcaatgtgattgaagaggtcaaggactttctgtccaaaagctttgaaaagaaggatttgggagtggctgatgttattcttaacattaaactactgagaggagatgagggtcggattacacttgtgcaatctcactatgtggacaaggtcttgagtcgctttggttatagtgactgcaaggcagctcctactccttatgatcctagtgtgctattaaggaaaaaccgaagaatagcaagggatcaattgagatactcccagatcattggttcattgatgtacttagctagtgcaacgaggcctgacatctcatttgctgtgagcaagttgagccggtttgtttcaaatccgggagatgatcattggcatgctcttgaaagagtaatgcgctatctaaaagggacaatgagctatggaattcactatgccgggtacccaaaagtgctggagggctatagtgattcaaactggatatctgatgctgatgagataaaggccacaagtgggtatgtgttcacacttggaggtggcgctgtttcctggaagtcttgcaagcagatcatcttaacgaggtcaacaatggaaacagagctcacagctttagatactgccacagttgaggccgaatggcttcgtgagctcctgatggacttgccggtggttgaaaaaccaataccagcaatcctgatgaactgtgataatcaaacagtgattattaaagtaaacagttcgaaggacaacatgaagtcatccaggcatgttaaaagaagactgaagtctgtcagaaagcagaaaaactccagagtgatagcattggactatgtctagacggctaaaaatctagcagatcagtttaccaaggggctaccacgtaatgtgatagactgtgcatcgagggagatgggcttgagacccacttagagttgcacaatggtggaaacctgtccattgtgatcggagatcccgtgaatttagatggcgaaacaaactattgtgcaactgagagaagagaccctaaaatgagtttatcttcatgatgcacttctcttctaatctgtatagtaggatggtatacaccttaatgtgatccgagtggcttttcataaagaagagatgttggcctacagaacatcttagaaggaacacacctatatgagtccgactgctagtcacagtctatgagatctgggtgatctctagatactcatgaaaaggccaggagtatgacttatacgctccaaacagaggggatgcaaatggcagcctagtaccagttaagggtttgagtgaaacctgaatcgcacaagactgacaattcaaggcatagtccattattcagttgtgatctagtgtagctcttttcctaggtggaagttcaacttaacagtctccaccgaaacgctggtataacaaacaggatcagaatcgagagcatttcctgtgagccatgaaatttggtggggattgttagattaatggtctaggcccaattaaatcctaataaattccattggcccacattaagtgctatgggtaataataccaccttggaaatctaagtgaagaggtctcaacttaaatacagagctagtggagagtctctgttgaccggttgagatggtgctcggacaaccaggcggggcgaggcgaggcgaggtagacagctgctgctgcgctctctcgttttgtaacggacggtaataaacacggagaattgattttgtatcaatgaacgcttcggttacggaattaaacgtcgtgaattgattccgtcggttacggaattaaacgtcgtgaattgattccgtcggttacggaattaaacaccgtgaattgattccgtattaacgagcgcatcgattacgaaattaaacaccgtggttgatgactccgaacgttactctcgcgctcgcatatatatactccgcagcgaccagaaggattgacgaagttcttcctgactcttgcacttcgagttcctcctcctatgttcctgagctgcagaatccttccccggttctgttcacctgcgtgcacaggtgtacgggacgagcaggtgcctctggaactccgttcgcttgagaacttgcacgggtagacgggcgatcaagtttttgggtagcgcttcaagtgtggctgctcctgttctttgttcttcgacgacaacgttgcatcttcctctacttctgcttcaccatggcttctactggagagaacagaggagacaacatcaacggaggcaatacgaatgcctcaacatcttctgcaccattctctgggtataagattctaactttatttgattttcttcttgttatttacatgttcacaatgttatccatgggacttcaatcctatgtgaatgtcaacgatgtctatacttattttaccttaagcatgctcatatttatgtttagccttatcactagattgcttctcattgtgtatgtcatgtttattgtcttaatattttggattaaaatataccgaattatgaccaaatttccaacaggtcaaatactactgccctttttctgttgagaaatttgcttacatttgaatgtgttcaatggaattatttagtttggaaatactatcgaattattgcaatttgacaattgcttgaatttgacctgaaacagatggccaactgatgtagaccgggcctagtttaagcccgagcaggcaccaaagatttaagctgaattaatattctcgcttgctcaatcactgaattcaaaccgtaaaaattcttataaatgaccagacattaggaagtactggtaaggaagtcaggtgcatcaccattttacagctacaaaagttactcacaaaagcaggcattttagagtctcaagaaatagttcagctccttctccagacccgttctaatctacatttcgccttggctacttcctatgtctaataacacgttttttcatgcaaaatatttctatataaaaatgtttttaaaataacataaatctacttaaaaaattcaataattactccctctggttggacaaggttaaggttaagcttttataactttgaccatcaataactttaaaaatatttagtttaaagaaactagaaaaacatatatagatttgtctttcaaaacaatataataaaagtaaacatacatttatttattgtatatattattatagaaaaataaggtcaaaggtatatcttgtagaacgtgacattgctcaaagcatcaattaaaatgaaaccggagggagtaatacttaattaattctatattaatcattttcttgttttgcgtccggctaataatccgtttcaaaacccactttggaattaacgaagcctgaaattcaggcctggactgtcatcatgctcatcttttttttctctacatccttttatatgttcgatgcgaaagcatattgagtttacgcaaaccattcttgcaggacgatctcggataatggacagttcgtacgtagtagtagtacgttgggataaaatttggcaatcgaacaatcactttccagcactcgcgtctcactcaccctcacctccacattcattaatgctcgataggtgatggtactactactagaagatcccacccttgcaactgcaagatatccactgatgaccaattcatccaccactaattactcatctctacaggctcatgtcgtcgtctagcttcagttctcaagctagctagctagatactacttctacttcctatatatgtactcatatctgaatatctgatacagtagcaggcaggcgattcgtggtcgttgaagcggcgaggcatcgatcgatcgtcgccgtcgtggtcgcccaggtccagcaggctgtgctcgatcgcaattaatccatccatccaggacgtacgacggcgtcgctttcgccggtggcttgcaaaggcagcctctccggctttgatgggacccaaacgccgactcgctgtcgctgatcgttaccacctcgatcggtcgccgccgcgctctggaccaagctagctacccagccaacccttccttttgccgcgtactcgctcgcatgaatcgacctgatcttttttattttcgcaaacgcgcaaaatgatcatcagtatattagaagaaagtaaagttttaattacacaattgccgtggaacaaggacaaaaaaatggtctccaaaaccaccaaaaaccgacgatagaaaaaaattgaaaaccctgaagcgatatgatcatctgatatctccattagaagttcacgagtaattgggggagaatttaacgaaacttgatcaaagatgaatactaacaacaacctgctagcttcagtactgtgtatgcatatattgatatatgggaaacctgatcatgaacgaacggctggtgagatttgacacgcaacttgaccatttcttggttggtttggacatctcactagctagctgaactgctagatcgttcccaagaaaaaagcagatggatcgatcgatcattttgaccaaggaatatgcatgcagggcctatcaatacaagaacgtttgtacgacgttttgcaagctagtcagccagccaaattaagccttttggattcacctgcacacacgtacatgtcagacagtccgagtcggtgttaactcagtcatggagatttcgatgggtttggatgaagctgactttccttttgattcaaaggtagccatcgatcgacaccagcaagtaatagcagcttgcattggtcgacgccaattaatgaccggtgcaacggcgaccatcgcggttaattaactagctgttgagaccaagtgtcgttgagtctaagagtggattttaaactgtagatagaacgtttacacgttatttgcatgttactttgagggaatgttcactttgatgtcaaaaaaaaaccttaccaaattttggtattgccaaaattttgataggatttattatataggtgcaaactaaatgtagccacttttttgacaattttatcaaaatttgataagattaaaaatgatatcaaagtgaacatgccctagaaattaacttacctcattggcgattttgatgtaggtatacaagtcagcgagcttgatggatgcaattaagcagatggaaccggcggccgggcgtgtctcgcaagttcagttatctgcccttctgctggggcccttgaatatgctggacaacacagggttaattacgatgcgatgttcttaattagtagtttgcagctggactcatagtctcatatgcggacgtattcactggggccttaattaatgagaacttttactggtacaatatactaccagtatatactggcagtatataaaagggcatattaaaaatttgatagaaaataaaataacactttagtaattttctgttcagattgaatctaattgggagtacccggtcctggatcttatcgtgcgctaggggaggagcatactgaccgccatttgatgacgaagcacgtaatgatagcatgatttgatgatagaataacgaagaaaagacaaaattacccttcaaactttatactgcaatctaattaactaaaaaaatcaaatcaatttacaccgttagatcatatatacttgcagtatatactagcagtacattgtaccataaaagttctataattaattaattccgcttgcagtactgcactgtttccttgagcgctcaattttttgaccttcagagttcagacaacgagtctgcaaagtagcacgatctctcgctcataccaaagtaattaagcattgatctgatgacccagagagaacatatagaagcaattgagtaggagtgtgcgtgtgtgtgtgtttatgtatgaacaatgagctggagtgaggtagaacctcataaggaacataccaacaaagttcatgcatattgaaattggttgtatacacggactaatcatagcttcaattgttaggtccaaacaaatgcacttcctgcaattaattttgtctcagattttcagatatatatatatatatatatatatatatatatatatatatatatatatatgacactcatatggggcaccatggtgcccgggcaccatggtatctaatgcacaaaatttttcaaattgtgagtatatacctagttataataatttgattcatacctatacttatcaacaaaacaactcaaatttaactttatttcacaatccatgattacatacctaactaattatatgtatggatgctatatacctataatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatagtgccggacaccatggagcaccaaacaaatttactatatatatatatagtaaatttgtttggtgtatataggtgtttgttcgttgtagtactagtacatatatatggaagatacttctcaaagtatcggatgaccctccattttcatcaaacaattaattaatgaaaacaaacacatttttgtgtccccttcagtagacggtgatcatagctgtagatcaaagctagcaatctagctagcaatacctgggattgagacccagtgcagttgttaatatgacggtaactctagcagttgcaaggtagctgatggatcaaaaccagcggcccgaatcattaaaaaaaatattgttcacgatttactgtagccaattcctcatgtggcaattactttagcgtctaatgtgcaatagggtgggagagcaaatccaagccgttggctgcatcgatccaacggttataatgtgctccgactgctaaagttttagtactactacgaccgcactagatctcattccaatagctgggtaattaattattgttctataccttgatattgaagtacgtactttattgtatatgaccagggaatggattctaatttctaaaccctcaagagatgtaccctcgtttctgtcattcaatgtaaattttctttaaaaaaattgacaagatggaataatatgtatgtgatatatcacatattaattaagctagcttattattttttaaagaaaaacataacttttaagatggcatatgaaaaacaagagaatgtttgctcgagggattaaaatagtttcatgtacttcatctgcaataacagactcaagaaaccatagatgaacatgaaacagaaacgatttacagacacgcacatgcatgcctcttccctaacaacttctgaacgtactgatgatatgaaggagcaacaacaagtgtctcatcatgatcatgcatgacaaaattataatcgagctagatgcatcgcatgcatggacaatcgtgatgttgataccaagaacaatcatgcatgcatgaacatcagaagctagccctcgatcagctgctagctagctggtcccatgattataacaaacaatcaaaagtactactatgtacatactcctagtagctatcagttggagtcaattaaggaaacaagagcatgaaattaccactgctagctcatcatcagtattcagtactactactgaataatgccccccaaagtgcagtgcaagtctgcacgtacgagctcatgagaatcaggtacatgtacaacaacttctactactagtagtatactactgctgctgccgccgatgctgcatgctacaactaggctacttgctagatcatcatcatagtactacacgtaccatcgtcgtagaatgcatcgtatacagatcaatcgatcagatgttcagaaccaaaaaaaggagaaattaagttaacaagatgcaaatcactatcagagtatatcagtagccggccatccagctcgagctagtgatcatcatcatcatcatcgatcaacggtggttgttgttgttggcgtcgtcgttgtgcaagaacggcgacgggatgaacatgtcctgcaggaggccgtaatcctgcgccatgaagtgctgcatccggagaggagtagtagcagcagcagcgctccccgtcgccggcggcggcggcggcgtggtggaagcaccggtggtagaggcgatgatggcaaccaagccagcatgatcaggctgcggcatctgctgcatggcggcggcgtgcagtgatccgccgctcgccgccgccgccgccgccagctgcatctggtgctgcatggcatggagatgctgcgcatgcggcggcgccaggaggccgccgccgagcgcgtcgtgcggctgcggaggcaaacggtggccgacggcggctgcgaagtggccgggatggtggtactggaggccgccgtggtggtgcgcggcggcggcggcgccgaggaggtgcgccgtgccgcgcagcgtcgccgggatcgggtgcgtgtgcttcccctcgtaggtggtgatcaccaccgccgcgtcctggtacgaccgctccaccctcttcttcaccgggcacttctgcgtcgtgcaccggtagtagctcctgcacccatccatccatccatcacacaaacgtaagaaccctaatcaattatcaatgatccatatatatctcagctaccaaatgcattcatgattcataactaagttcttactcgttccatttcatattataaatcattttaactttttttctaattaaacttttaaaagtttgatcgagtttattatagaaaaatatagctacattaattttcaacacgaaacaaacgtattatcaaacatattaatttaaatgctagttttgatgaagctaatttggtgctatagacgttgctaaacattcctataaatttgatcaaacttaagaaaatttaattaaaaaaaattaaaacgacttataatataaaacgaagtacctgggaaatgggctgttcttgacggctttctggccgtacttgcgccaccggtagccatcctcgaggtggtcgacctcgctcttggtcatgaacgcgaaccgcggctgccgcggcctcttctcccccttccccttccccttacctctgcaaatgaaatttttttttcactcacatcaattcatccagtcatcagttcatcacacatcagctagctatgctaactaattaacagcaaggtcaattcaatgacagtactactatactacccaacaagctacatatttttggtgtgtgccatagatcgagcaagatcatgttcatactagctagcttaattagctgcaaattgagattaattatactaatcgatggatgatcagttgttggtccattcaaacatagtggctgcgtacagagggtagtagtagccgcgtaggtacgtatggacggcacggcggcgcgggcatctacacatgacgacttcagagttcacacggccatacatacatgcgtacgtatgtacggcctggtcatatattttggtaggatctactgatcaatttgtgatttaactgctagctagacaatttggaggaggggtcagggtcacatttacagatgcaacaaaaatctaggagttaaagttgcaaggtaaattaagtttgccatgaaaacgatagatcgatgtgttcagttaaacttaaaacttggccaccaactgagattgatcgatatcgatcgatcagttgagttgataggctgaatctgcagactggtgtgatatattatcctaattaaatgcaattcatatattgtgtgtgtgtgtgtcgtaatataatgcttgcgaactaagaacgcaccatgcatatctcaaagagatatcagatgaagacaagaggaagagatcaagaaagtgatgcaaagactagcaaaaggcgtgagcaaaaaaacattgatcaacttttttctgaaagaaaaaaactacctaacgatcaagctcttttcgttttgtattaattgctcggcgagcatgtgctagctagtgagaaaccctagcgcatcgagttcacacgtccttgaccgaaaccaaaagaggagccaaaatgcacacatcttgaccaaaccaaagaggaaataaattaaaacgtgaagaaaattaaacatgctcaaatctggatacagtcattcaggaaacagacggaagaaaaatcaacatgaacacaaagagaaaacctgttcctgattattaatctttttttgtcacattaatgtcaccaatagcaccagtcagaacagaaaatcaaagacttcgccaaatcaacctttctaaagctagcaaaatgaatttcaagatacagttcaagatgggatgaatttcaagatccagttcaagatgggatgggatgagatgagatgagatgaaagaactcaccctttcttgttcttgtcttctccatcgccatcccccttggtcgtcgacgatccttccttgccgtcgtcgtcgccgccgtccccctcctcctccttcttgcacttcccggccgactcctcgtcccctccggcgccgccgccgacgccgcacgcctcgctcgacgtcgacgacaccgacatgctgttcggagtcatcggccccgccaccgccgccgccgccgcagcagcagaagcaccacccccagggaacaacccgacgccgtccaccaccagctccctcttcacctcctccagaggcgccacgtcgtcgtcgaactccccggcgaatgcctcgtagtccagcggcggcgtcgtcggcgcgctctcctgcatcaggtggtggtggtagtcgatgaacgaccacggctgctgctgctgcagcatccccggcatggcgccgttcggcggccgctcagcgaacagcgacgccagctcgtcgtggaacgggaagccctcgccgccgcgccgccgcccgacatggagctaattaagcaaactagctagctagctagctcagatcgagctaagctttgctccaaattaaactggtcgaaatcaatcgtgcaagcaagcaagcaagctagccctcttctccttggcgtttgctcacatatagatcgtacttgctagctagctagctagctactggctagtggtgtggtgatgcagtgaagagaaggagatgagaggtagacgacgagagagagatagagaggggaagaagaaagggagaggtgtgtatttgtgtgtaagcgagctagcacaagctgaagctagctagtgtgatcatgtgtggggatagctaggtggttgggtgagaggccaagggcttagttgaaaattcctagttaatcacgggctttgtcgcataattgaaattaacaaaaattaattgatttgatttgctcttgtcatgtgtactatacgccactgtactttgcatgcgcaacactagtttttctacccttagatcgagttagtattcggtcgcaggttttaccttctagtaacatcttgttgtttgctttaccaattctcaatgcttcatgcatttctctatattatcaaccaaacttttgctcttgtttaatctcttatacaaaaaaatgagaagaagaaaaaaagtgagtacaagaccatgtcaaggcttgtgagttactttacctttcactaactttctccacagctttctaattgcagagtcgtggatttattaaatgacatttggaacagtagtaataataaaaattattagggctcaaacaatgtcctaattgcgaacatggtgggaatagctagaaggggagtggtccaaggtcgtatagggtttagtcagcgacggccaccggaggcagccggtcaggtgagtcaacaggacggggctgcgtcaaaccattcaaaccattcaaacccatccctcaccggcacgtgtccgtgtcgctttgaccgggcccactcgcgtgaccgggcccaccgtcgatgggccagcttgatgacgttagcatgacgctgccgatgcctcctcgttccttctccgtccgatggcgatccgacggctgtggcgtcccgacggtggaaaagcgagaggccgtacgtgtcaaagggaaaaaaaacggcgtgcccaataaatcgtaaccgaaatttgcaagccaggaattcatcggctggcacgtattaaatgtgactgattttacttgttaatcacatttagtaaaaaaggacactactgctttacagctttctttttttacatgtgtctaatcttcagatttacagctttttttttaaccacgattacatgtgttgcacggaaaaatgcgaccaaatgtaagttgtaattttaaatctcgatcggataatgattcttcatcatgtaaagtggtagcctgtgtcaaaaagaaatgtttcattaattacctctcctaaacctgcacgtaactactactccgtagtaatttgtcagaaaaggcgtttcacctgacgaggcaggcaggccgggccgggccggtgcgacgacggctcacgctacagcgagacatgtcgcgtacgcgtcgtgtcacggtgcgaccgagtccgtgtccgggtcgcgaccgaggttggtcgcgggcgggccgaccacagcctggctcggcgtacgtggccccagatccggccgtccatccatccccccgccgcggaaaggaacccgggaaattttgacttagcttgggggtatagcgaccgatcgagctgttgatttcgctgccgttttcttcttttccggcaaaaaaagtttcggcttaattagtttggtccaacctgcggccgcgacgacgacggcgatgtcactgagatagatgccggtcagctagctccagcgccttcaggtttgtatcccatactgatcgagcagctaggatcgcccgatgaatttgtcatgtgttttctctcctatcaaagttttattagaagtatctcaaatgttttaaacgaaccggtactagatgtgttaatttcattgaataaaacatgagtaaaaagtttggtgaaaggaaggttgtaaacggagatgaaaatttcctaccaagcgtttctgattctagcgatatattgaatttatgtttataagtttttaaaacgttgtattgcaatggtcactaaatagttagatgggtggaaatatttaatttctactcaactgagaatcattttcatagagatgctaccgtttctaactgttttcgttcctcgtatattcataaaaaaaatttgaaacaaaaccaaagttgttttggaggaattatggtgaatgaatcgaatgtgggtactaggtaggtcataattcatacctatttatcacaaagtagttttatctacctgatgaattcggagtttttggtaaggtgaagaagaagaagaagaagaagaaatattcttcatcagtctacaagtggtcctgttggtgctgcggagattccttcgcgtagctagcacaacggattagctataatagaattttatcattctatatttttcagttcagattaacatatgacgtgaatttgactaaaatgacgcctagcttcagtttaagcaagactgctcactagctagccaagtacgatcagcatatataatcgtgatcaggtctatgggttggttggatggacagtttttataatgaaatcgagttgaatcgcaacgaccaaaccgaactgtctctgatgcagctgagctagcgatcttcatgcttgcaagttgcaacagtattccactctcaacaaccatcaataatgctatcgagtctgaaaacctgaacattgcaagaacctgcgaaatatatatataactggaatataaatattttctgcgttcgtacaggcatattttatcttctttatatatgttgattcgttgaaaagttgaatcccatcaacgtttggtccagatggaaatgctgcattcatcagtcaagggtgtatctctaccgttggcacgtcagaacaaccacaatattttcagtttttcagtcactagtagcatcgcatagcatatgcaactgaaaattcagagttcagacttgacaccaacacattgctgaaacagaaagacagatttaatttacaagtgctagaacagtagcactacacaatgggataggaatctttttgcagagtttattaatttggcggttgcttgtcattactgtcatcagttaaactaattaactagcgctagtaggaagctgccaaaccaaagtcaaatgcaaatctgaagatgtattggagaaagattagaaaacgtaccgatcgatatccacaaacaaggaggagattaattacctttatttctagtccaaataaatctcccatctgatgcgacctggtaataacaagcaagcaaaacaacatgcagttaatcagccagcatccaactgctaatctacaaaaaagcactgtctttttgtgactaatttagctagcatgctaacctcacgtacaaacatctttttgcttagttaatccagtaagagacactgtgccgcgtgaggctcattggtttgacttgtgccaaagtcccaataggttcgtacataattatggattagaataagtttggtccaactccttgctcgattaagtaggacggtgtctacacctaatccgcaccattacggcaacaagcatcaagcaccgtcctcctagctagatatttcgtaattttttatttctctctagtttgccctaccattcacgtgaatttccatgcatctacatatgaacactcatcaatcatttttatccccacaagtttagctctgtactatacagagaatagtgtgcagtcattgcttcgtctgaaataattttggtgcttattcgcaagaggatttttatagttcttgagaaagtatcttgagatacctaaattttacattaaaattttggtatcttgagatacttagtaatttgagatactaaattttacattagaaaatatggtacctctaaatactttttcaagtacggtaaaattaccctattcacaaagaatgaactcacaaggaaattaaaggcataacttgtccaaaaattaaattctcctaccaagttaagggtaaaatgtactgagaaataccaaattttctagtataaattttgatacctacaaatattttctcaaatactataatatttctaggtattaaacacataatctagggttattcagagagagaattcaaagtgtaagatctttcttgtgctcatctatatagaatcatatatattgagggcccctttgaatcaaaggatttatgtaggaaattcataggattcaaatcctataggaaattttcctatttggccctttgatttaaaggattgaagctttccaaatcctatgaaattcttatggaatggcacattgcatgtggattttggaggaaatttagcaagagctccaacctcttggaaaatttcctttgagtctatctctctcatccgattcctgcgtttttcctgtgctctaatcaaacgaccattcctgtgtttttcctgtgttttgcaatcctctgttttacacttcaattcctgtcataatactatgttttttctattccttcgttttttcaaccctaacattcaaaggccctgatggattttctaggtgggcatggatcatgcatgttgcatggggacctacttaagcctgagaatattgaccacagggataatcaaggtgtacgtcttccgtacttgggtggcggattccaccatgagaaaaaaaaaacccaagcagatgaatgattccgcaggcgccttttgaacagtggaccaagctgcagactccgttcaaccaaacgaccggcgtctctctcgtctccggccagccgacgtgccgccgtcgccgtcgtcgctcgcgccgcaagcgtgtacgaaccttccgagtggtttccactcctcaaactgaatcgatcgaactcaactctcaactagcgctagtgggatctctccgaaatttgcaacttgtgcgggttaattagcatgctaatttgcagctctacggaggttagggttcatcggaatgagtagcctgcttgccgatggacaaggagtgcactgcttgctttcctggaaaaaagaattgttcttttgtctctcttttggatgcagaaagatggatcaaagtgtgtacttgcacgcaagatagacagatatttgtatatctgtacccctgcttaattagctacatcgtgtagatcattaggctgccaaacaaactttccagtgtgagattccaatgcaagcacacaagatcaaaattcttgggaatcatttatcagttctagatcactgtactgtgtcaacaattgtttaatatatggtttttagaggctgggtctgtgtttgcttatggggcaagagatccatagacaggggttagaaaatatcaaaacttatgcttgcaaggcatgaggcaatcatgaacatgacaaaatgtttattaattaattaattttcacaggcttgacttaatccggttaattggacttaacctccccaagtcaagtacagctcttggactgcgttccaacatgttcaacttggactactgaccatcatgtcactgtcttcaaatggtgtgcctttgttaaactaaactaatctacccaaggaaaagggtaattaaacatctcatatgtatatatctattgatctatataacaaccagttaaaaagaaggacacattaccttattttttagataatgaagtggtagttgccaattgcatccattgaactttgaatccttcacaattcaggcatctttggaaatttccttacatattgtactgatcaacaaatcctgaaaccttctagcacatgcatctgttccaacatcctgattcctcgatcgcaagatagattttccgaactattctctgtttgaaatgagcagcatctttgaaaagttcatttgatgaaaacaacatcccatttgcttgccctgccagattggtatgagacagacaaaaaaaaaagagcaaagtttttcctcggagaaaaagccggaatattttccttgttcaaacggggtgtactgatagacagcatcaggcagtacaggccgtataaattccacatttccactgtaacaaaaacatccaaatcgagcacgttttggagccgtcaaaaggctgaaaatgccaaggttttcaactatccggagtttaccatggatcacaagtcacaacctttctcagccaaggcatcgacctgaatgactgagtcgcaaagctggaccgattactctgatgcccgtaagaaaggttcagaaaagtttgcagctttcaagtgctagttgataggcaatgggtaggaatatttcacatttcaatatctcgtcacccccactgagagacaggatgtagaaaggttggctatctctgatccttccatttcaaagagaagccttttctaatctgaaataaaatgcactttctttatatcaggcttttgtaatatgaaaactcttattctgtagattctgaaagtgattttagttcagaattggagctgttggcagtagatggtccaagctaggatcaccttttatttaaagagcttatccatatctctggaaaattagttttaactgtaatcttatatctgtggatcttagaccaatttatccagtgctaagaaaactgaaaagcagctaggttaatagtactgggtgtaactcagtcactgggttgtcttgtgatttatggatgtatttcttttggcagaacatagaacatagtagtactagatatgtttttctcacattgttcataagctctgatgtgattttttagttttggctttaagttacataaaccgttcctgaaacaacaattattagaaaatcagtacctatcagtagtagatgttgtgattggtcagcagaacagatctaaaagttgagagtacggccttgtttagttctaaactttttcttcaaactttcaacttttccatcacatcaaaactttcctacacacaaactttcaactttttcgtcacatcgttccaattttaaccaaacttctaattttggcgtgaactaaacccaccctacatgatctagagaaggaatgcatgctgaactttggtgaacaaagtcaagagatgaccactgttgcaaagagcaattgtgtggagatccacctcctcattgttttctgttcttgtttcccctttggaccagtgccatgagcagcagccaataaaaattggaagctttcagtggtttcagcaaggctctacctcatgtgatctacccttgaaggattgttaaaggagagaccatgatccaggcagagttttttttttgtttaatatgtggcaggtgaatggaatttattctgaaataatcatgcttatgtttggctcttttgacttgctcctagcacatcagtatttcttttttcttctagtagtattatgatattatctgcctctttttctggggcagcagaactgcagggaatctgcttacaagagccccatacttgaaagttttcacactgctaacgctaggtttccaaagattatcttggcttggttctaaagggatggaaaataatttatatatatgtttcttctttcttcctaactgatgaggaattcttgtactttccattctcaactgcctgtcaataatacatcaaacagaaaaatatcgatctgtatgactgtatgataagcaattctttcaggcctccattaaccagctcaacagaaaaatacgaattgatgtgccgtagttggggattcagacagcggttggtcatttttggctagtttcagataactgaaacactgaacttgcagagcacacgtagtactcccggaatagccttcacctcgagtctaggtccacacaaaaattttacaccctatcacatcaaacatttgacatctgcatgaaatattaaatatatgttataaaaataactaattgtacagattgcgactaatttatgagatgaatcttttaagtctaattgctccattatttgataatatagtgctacagttaacatttgctaatgatagattaattatgcttaataaatttgtcttgttatactgatagattatataattagtttttttattagtgtccgaacaccccatacgacaccctatataatatccgatgtgacacgttaaaactttacacacttggatctaaacaccttcttacaattgtgcagatctcacatgaacagttgacacaatttttctgttcgatctgcagcaagctatacacacacgcgcgtgcgccccgcagcagcacagagtgcactcgaagtcaagccccgcgtgccatctccttcacactcgcaacccggttttacacagaggaattcgaacaagaacacagcattattgcaccactccactgtggtcactcactagctcgcatcacagccaccatgcagcagaaggcttagccagaaacgcgtcttgaagagatcgagtagagacaagcgtgtgcgctcgtcgcgcgatgcatatggcccatgccgcgccgatctcgtcagtggcaatgcacatagctagctagattcttctcttgtcgcaaaggtcaacgactccggtaaacttttctccataggtcagtgactctgtattaacagtttcaacccctacacacagtcgcatgcagctagtagtatacagtaatgtcaactgcaaggagttacccgaggattaagatatggtgcatcgatcagaaaaaaggaagtaatagtaaattgatgcacgagcacactcatgagtgacatgagagagatgtctgtccctcctctgagttgctgcatgcgtgacagcgtgatttgtgctagcttagctagctccttggttttggttttagcttgatccatctaaaacaatggacgacatgcctcccaaaaagtcagagcacatgcaagcccaatcagctgctcctgagtccagacagagatgtgtaggggccaaagtggcaaatcaaatctgaagaaaattcttactccgtccgtcctctaatataaatgattttaacattttacttatactatttgaccactcatcttactcaaaatttttttggaattattatttattttatttgtgacttactttattatctaaaatactttaagcacaattttttgttttttatatttgtacaaatttttttaataagacgagtgatcaaacagtgtaagcaaaatatcaaaaaaatttatattaagggacagagggagtatatgagtggatatattcttcagtaaaatgtaaagctcagagtaaaagactgaatctttgatgcagtaaacggaaacaaaaggctggggggtcaaatgctggcatgcagccattgtggcgacaatctattcatcgttttcttggtctaaggcaggatctcaatctcagcaaatggtacgggggcaaatgggttttgggttgttggaagatcgaagctagcagatgcttgccgatggtggtggtcaaaatgcttgactcgacttctctgctcggatcaatcgagctcgcctttaattacttttcgctgcactgtttactcttggactgatttggtttgaacagataagtggccgagattaactgacgaagaagaagaagaagaagaagaagaagaagaagtcgggcgctgtcaatttggattccacgtttcgtgctgcacggcggcgctaagctccggcgaggcacgccatgaacgacggcgtcgatcttgctggaaattgggggctcggagtttaaaattccgaacccccatgggttacagcgactcgattcgtggacaggaaaaatgcgaaataatccgattcgacacgtctgcaaactgtcaatccaagccgaacactcctgactctcgtcctcctcggccggcgccggcgacgacggcgagcgtggggaagcgtcggcgacctggttgggccgtacggcccagatcgagtggaggcctcgaatgggcaggcgacttctgttgggccgagttctgcctgtctttccataagttcactctcttttagttactagatgtgcgttgcaactgatagagccaatttaatttgtacatatgtgtcggtggataaataatccattgttcgtttccccgcaaaaaaaatccattgttcgtttatttatgtgcttatccaaatcatttattaccaaataaaagactatttgtgtgcaaatcttttatatacctgttgttaacgactcaaaaggaaatgctgtaaaataaagtatgataaaaaaacaaaaggttgaattcaaaattaagttctaaaatctaaattttggcttataggaataagcatcagcaaaacaatgagacattcaaacacggctacacgagcttgatttatcgtgcagctttgtctgaagttgggaaggaattgatgacggacagaatcaacaacttcgatcatcctttatttcggttgtcatgttttttccgaaaataaaattgattcttatgaattattgtaacggtatccctgatagtacgtatgagtatgtgtggagactgacttgaaatcatgctaacatgtgacatgaatcgtgccatgtaatacgaatagacgacctacgtgatatttacacggattctgcgagtatcattcgcttggtatccacatcacatggactctcttttgtagtccgcttgtgattcgtgacttcgcaatgaatgttacgtgtgacgggaatcggatatgaatgatgtagcacagttttgacaaaaatatcttcaatttttaaatcatgcagtcccaataggacatgcggcaagggcaaatcgcgcgtgcgagggcgttgcgggcccaatcgcggcggcgcgcaaagacgcatgtggaaaacgaactcaggcgcaacccccgattgctgcggacccaattaatttgcacgcgtctcagataagaggaatactctggtgtaagaaaaaggaaaaagatttgatagaaacataaaattaaaaccgattaaaaaaataacgtatcaaaattctgacagaaacatcttcgaatttcataatagtggagatgggtccaatctaattcgtatgcctcaattgtaatatcggatatgttcatcccccacaattatcaaaacctgtataacctcttctagctgtttgaaagcagttttcgttaacgtaacttatatattgacctaatccaactaatcgagtcagtatgtggctattcttttttacacctctcttacttttatcttcctttgtacaatctcttttctctagagggcggggacacaacgccgtgcatgtgcagtactacataggaccctctctcgacgccgatgagcttgagctggaggaggaaagaagaagtggggcgctgtaaatttggactcctcttgaggcacacggcatgaacggcggtgtcgttcttgcaggccattgggcctcggaatttgaaactccgaacccattgcgttctctgtctgacagccgttcgattcgtaggccaggaaaaatgagaaataatccaacgctacacgtgtggacatgcagtcaattcaatacgaacactccggcggtgccggcgccggcatcggcggcgacgacggacgacaacgacgactggggaatcgtcaaggagctcgacgacggcgtgcatggcgaagcgtcgacgacttgttgcgccgtgaggcccagattctgtggaagcctcgtattgggcggccgatttgtactgggccttgtggtatcatctggcccgtctggctatctttccagcctggcccagattgagccttctctctttacttcttctctaatgggcctcagtgtacctccgtagggcccaacctcgaatggatccaatactcatgggccgtgcggcccacgatatactcagctgcatgattgggctgcagga

SEQ ID NO: 60473 - DNA, 2253 bp, Oryza sativa
gccaggtttgccatcatcattggagccaattagtttctcatcggagcttgcaagctagctgggtgacagcaaggagcagaaaaatgttgcaaagcacaaagcccctctttgctctgttttgtcatcagtacttcttttttcatatgcatattgtacgagcagaaaaaagtgcttttagtctgaattatattgtacgagctgaatctgaatgtgatgtatggagaattagcaacaatggagtgttcgttgcttacttgctccagcttgttcacggggaatggcctaagtactccggatgcaaatcttctgctataatgcacgtgtagtatgtgtcactaattatgtgggccccacttacttctggtccatatgtcagtgacacctactgcatttgcagtacagcataggcggttcctatccggaacagaatactgatcacagaaaacaggacggtttattagcgcgtgattaattaagtatttgctgattacttttttcaaaaatggattaatttgatttttttaagcaactttcgtatagaaactttttgcaaaaacacaaaccgtttaacagtttaaaaaacatacgcgcgaaaaacaagggagagaagttgggaacatgggattacaaacacaccctcagagtactccattgcatgcactaatgcacacagcacactttcagtttcagcattcagcgagcaggaaaagaaatagggccaatttgaactgctaccctaccaaaatttgcagcaaaccaaacatctctactaaaactttaccaatgatataaatttggctttgcctataaatttgtctcttatgggcaaattttgtctttaatccaaataaacattttcaactctaccctaccaaaattttggtagtaccaaaacttgcccaagatttgacactaccaaaattttgatgggacatcaatccaaacatgcccatggtcttccaccatctggcgcttttgcaccatcctacgcgaaaaagaaagaagataaggggcctgttcactttgttgccaaaaaaaactttaccaaattttggtattgccaaaattttggcaattatgccaaaatgctaaaattttggcaggatttcttatataattaccaaaatttggcagcaaactaaatgtagccatatttttgacaactttatcaaaatttggtaaggttgaaaatggcaccaaagtgaacaggctaagataagaagaggctcttactttttttttctttttttctagaactctgtagaagctagagaaagcgtgaagaccgcgtgattttaagcccaaacgctttggactaaaaaggccctgaagatgtagacgatgagttcccccgccgcgtgaagccgtgaaccatctcagccgctgaagtggctttagcttttgatagcaacaagctagagcaattggctaagcaaaacaccaacttttactttcagtctacgtatcagagattcagagatgtgttcatgaaacagcttcatttcagggcagacaaaaacacatcatatatataacagctaccagatttactcaccggccggcctctgtttctcctaaaagaagcggagagaacagatgccgtccaaaagaggggaacaaaaaaaaggagagaaaatcgaacattcagtgaacacactcgcaaaagagaagcagaggatgtgactaggatacgatgtgataacgatgtgacaaatctgcactcagttcgctaagatggcaagaaaaaaaccaatgggaatttgtgaaatgggcatatatgttccctatctagaaagtgatttcttccactcggtttccgcgcgttaacttcgctttcgttcagctcagctaagctttgccggtcacctaccaaagaatctcctttacttcttttctttctgctgttgctgtccttctcctgcagcttcaggaaaaccaaagaattggaagtggcttagcagtgatcaactgatcactgatcagactagcagagtatgatagtatgatcaattcatcagtgtgattgtgtgaagtgtgtttatgccgaatatgtgttatgctaacaatggagtgtgcattctgcattgcattgcagaggcttgttgatgggaaaataacctggattactccactgcacttccagcattctgcacgcatccagagaaggaaaaaagatagctccaccatcctgcactttcgcatcatcccatgcatgaggccggccatttttgttctcccgaaaagagtagagaa

SEQ ID NO: 60474 - DNA, 705 bp, Oryza sativa
gactcccattctcgcgactgctgcgctagcgcgtcctggatgccatgatccagctcttccttggcacgccggagttgcctgacgcattccttgagggcgccgtcgaggtgaacgattctgtcttccagtgttgagttcttggcagttgcagcgttcagctgggtcttcagtgatgctatctctttctcggccttctcccatcctagtaggagaattgcaggtttttgttatgaagatctggcttgtcagttgtcagttctatttatgcatgtgtagaaataacactgtttctaggatcagattaaaaaaagaactctttctaggggattaagcttttgcttcaaatcattagtacattattcgtgaaaaaaatattagtacataaaacttaaggattaggttgagaggaccttagaataagaatgttctttttctaagtcagggaattgataaaactacaaatgagcttttggaccacatgatcagtacaaaaaattaaaagcaagagacaaggaacatatctgcatatgatatgcagtatatccaggtccaaacagagtcatttcttaaattttttggcccagcgaaaaacaataatttgtttgaatttttgcttcatgtactgaacctgtacgattcagtcatgtttaacatcatacttagaacagcttcctccgcaacttatgaatgctgcggggtgcagga

SEQ ID NO: 60475 - DNA, 1132 bp, Oryza sativa
aagtagaggaagatgcaacgttgtcgtcgaagaacaaagaacaggagcagtcgcgcttgaagcgctacccaaaaacttgatcacccgtctacccatgcaagttctcaagcggacggagttccggaggcacctgctcgtcccgtatatctgtgtacacaggtgaacagaaccggtgaaggaagtgcaagagttgggatgaacttcgtcaatccttctggtcgctgcggagtatatatatgcgagcgcgagagtaacgttcggagtcatcaaccacggtgtttaatctcgtaaccgacgcgctcgttaatatggaatcaattcacggtgtttaattccgtaaccgacgaaatcaattcacgacgtttaattccgtaaccgaagcgttcattgatacgaaatcaattctccgtgtttattaccgtctattacaaaacgagagagcgcagcagctgtctgcctcgcctcgcctcaccccgcctggttgtccgcgcaccatctcaaccggtcaacagagactctccactagctctgtatttaagttgagacatcttcacttagattttcaaggtggtattattacccatagcacttaatgtgggccaatggaatttattaggatttaattgggcctagcccattaatctaacatgaccgtcgttaatacataaacagagggaataaagggtctgttcactttgatgccaggatttctcatatagttactaaaatttggcagcaaagtaaatatagccacttttttagcagctttaccaaaatttggtaaggttgaaaatggtatcaaagtgaacagacccaaaatgaacttggcattccaaggctttcttatctagcccacagttcagcctgcaagaagcccaatagcagtgcaccttctctactgtagaacatcgcgtcctccacattgggccgcacataaatatcaatcccgtgacggcccaactactatgggcctaaatgagctcaccatcccatcccagcccaacaaataggaataagttcatctgaggttacttaacttgtcaatgaatccaattttcgttcctcaaccgaaaaaccagacacaacgagtccctcaactatcaaaaccggtgtagattaggggggcgcctga

SEQ ID NO: 60476 - DNA, 1737 bp, Oryza sativa
aaccgcttgttgtatatagatgaaactgattgatgaccatctcaacaatctcgagacctcgcaggatccaaaacttgaatgttcattacattttcttttaacacagtaatatcataagcaaacacaatcaaaactgctttttttcctcgtgattcatgaaaagaaaccaaggctcggttcttcaatttctgaacttgaagcgatagtgctataggttactaggggctcagcgacggaactcaagcgcagtcgcatggaagacttctctgcggtggtgttcaggttcgtgtggtaaggtgcagtggcgccgttgcccggcatagtggccggaccaccggatggacagaaaagcgccaccatgaagcaccagagcgcggcggcgtccatgcggtcgcacatccaccagagcgcgccccggacgtcggcgggcggggactcaacaacggccgtggacagtgccgcctcgacctcggcaaggcgcgtggggagccggggacggcggccttgcgggcatcgagcgccgcgagggattcggaggtggaggcgttcgcgacgactagggccacctctctcgccgtcccttcctcttccgcccacagccaccgtgtagcgtccgttccgtcgtggcgtctagcgggaaaatttaaattctaaaaaccctaattgcgaaaattgtttctttgcttgtagtcagtctccgtgccaattccagatctcaaatccccaatccatcgtcgaattcaaatcccgaatccaattccttcccaaatcgaattcctccgcaaaagtttaatttgcctccctcgggtttggtggccgattccctctcggcccatctttctctttctctctctctctctctccccccctctccctccctcgctctgcccgtgcaccgggcgcgcgtgcgcgtgagccgcgccgagccgagcgccctccctcttcgctctcgttgcagcttcccaccaccgccgatcaaatcgccgtgcaccgttgcttcccgcgcgcgcgctgtggtggccgaccgcgtagtcgccgccgccgtcagcgcctccgcgccctgcccgcgcatgccgcccgtgtcgccgttccgctccacaccgcccccgccgtcatcgcagtcatcacgacccggccccgccacctccgcgtaagcttccaagggatggaggcagagcccctcctcccactgccccgtcgtcctctctctccctcctccttttcccaaagtagcaaggggcaagccccccctttcttcccttctttttcccttttctcttgccgccggcgtcatgccctctgccgccattttggccgcaagcgtcggagcgccagctcactccttgaccacccaaggtcgggttccgaaccgacattgccatcctataaagcccaggcgccctcccttccttctcctcttgtttgtcccatcgcctccactccattctcgtcgcctcccgtgttctgttcgccgccgcctttcgttgccacgcatgccggaggagccggcgcgttcgtggatgcggaaggggactccgggagctcgtcttcttcctcttccccggcccgaggccggagagatcactcccgtgccgtcagcctctcgtcacagcgccccgtctcgtctcggtagagctctcctccgttctccctcttcgctcctcttcctccccttagattgtgtggtagcactcgtagtacccttagaagctcgcaggcgccgcacaagaccttccc

SEQ ID NO: 60477 - DNA, 2513 bp, Oryza sativa
gctctcctcggccccgctcgcgcgtgcggtccaccgcgagccgtgagactgcgtgtgggcccgccacatccgcgcccaccgcgagccgcgcgtgcaccgcgcctccccttcccaaaccctagcacgccccgcgtgcacctcgctcacggtgagccgagccgccgacaagcaggtcccacccgggaccacacaaggtggacccggcccaccggctccctctctcctcccctccccgcgagcccccttgggccgcccctcaggccggccggcccaatggcaaggccgagccgtgccaacccctctcgggccgcgctcaagccgcccgcgaagtccgttcctcctccctctttcttttctttttcaaaagggtttaattaaatcctttttcctttagataaaaaatccaataatcttagaaattcaatatcttcccaaccgtaagtccgtttgactccgttcaacttccaaaattcctcaaatctcgagatctatctaatagcacgcttagaggtcaataatagggctttatttttgccgtttgttgagttgtcccgtttcgcgtgtagtttcggagcccgaagacccgcagtgcgaggatttcgaggatcaagctcaaggtctcgagcaaggcaagtcacctttgatcatcttgcacctataatttaaatctaagtatttcttttccgcaaatattgcatgaataggattaacacgagtaattcggccgcggcttgcgagatagcctgtcggcccccatcctaattgctgcaattaccctccttgaattattgaacacttagacctcctttgttgactgttgtgcttcgatgcacgggccttcgggcacgcgcattggaacacctcccctcaaatttaaaacatccaacgatgggtaaaacttggggttttacaaaagacttggaaaacccgacacctgggtcggtgcttgcgaactaaatgaatttccaaaatcgcggaccggagaatgtaccgggagtacggtttcccgctcttgcacttaaggaccgtttccttggaatttcatccgagcataagacaagtgcgaccacatgggtagaatgggacacccctggctgagtaactagctaatcgagggaaccatgatgccaagagacatatggattcaacggggtggtgccggggagaacccccgggtttcctggcacagtatggtctgggacctaatctggtgttggtctgggacccctctcgttggcatatggtgaacctgtgtcggctttcaaaatgccctgtcatgaaagccttaaggtctctagacgtggccgttctgcacgggctggatgatccgggttagtaatgccgtgtgggtaaagtgtaccccctctgcagaggttattaaactgttcgaacagccgtgcccacggtcatgggcggatgtgaggtgattcctagcgtagttttgtttgactactgctttgtgaaattgctgctgtggaatgggttcgatatttggaaaatcggcggctgatgggatcagtcaggcccgtgtggccgtttgaaagttgttggctgggtgccaaccttgaatcaattcaaagactgatatattgcacatactccgaccgggcgtgatgcactgtctcatccgtgtcgtttgagaagcactcacttagtggtttcaaaaaggagtttaaataaaattaattgcaaaaacaacagtctttccttgaagcctgcattaaacacttaaattcccatggcttgctgagtactcctgtactcacccttgctctatataaataacccccccagttgctgaagaagatgatgtggatcccgctgatgagttcttccaggagcaagtcggttacgatgagttttagggtttcggcctagttcccaagtcgcgcctgtgatgattggtctaagtcttggcttccgctttctcttttgtaatgcagttgtgagctcgggatctgtccacagcccaacatgactgtactcctactctgtaataaagagaccactgttgctgtgatattctgtctttctgtgatactagcattgtttcctgggactggtatcgattaacaggttaatttggagcgtcacgggctagttccgttcggggctagttcggggcgtgacacaccggagccgtgcctacgccgccacgcgtcgctccctcctctgtcctctcccgccggccgccgcgcgccgctgcctctccattgtgagagaggagaggggagagagatgaactgatgagtgatgaagagaggggagagaggaggaagaagagggatgagttggactgacatgtagggttcacgtgggcttcgcaatttttttattaatttgtaaatgaaactgacatgtgggtcctatgaggtttatttttttccatatcaaattgccacgtaagcgccacgtcaatgccacatcagatggagaccaagtcaaattaactacgtaggcgccaagtcagccaaaaccgctctaaaaaccactgagggatctaatctgcactg

SEQ ID NO: 60478 - DNA, 8493 bp, Oryza sativa
gaagccacgtcagcatttaattcctcatggcccacatgcttacacacgcgctcccccactgacatgtgggaccagggagcccccgccgcattccggcacgtggcgtcgcgatcatttttcacacgtcggacgctagtccacatcaggcccacggcattcttaccggtcccacctgtctgtcaccctgggtaagttgaccccggtaactcatatggcggaaaactgaaaaaaattacagcaaggaagcaaacggttcaacctgaaaatccacaccacttagacaatggcatgtgggtccggaaaactgagtattgttgtgggtcccagatgtcagtgatgttgtagggtcagagggtaggttattgttgggtaggtgtggaattgggctctgcttagaactgccattaataaaaccaggctgcttccctccgctctcttggtgtctcctcctctactccgcttctctccacctcgccgcgacgagagagagagagagggaggggggagagagagagaagtatcgatccatccgcgtttatctccggtaagcgagaccttcgagtacctgttcgagttctagcaatggtttgattcgtgtgctttgcttcgggattggttgttgggagtagtagattgtattcgtggaggaaatgggttttagattaaaactcggagccctgtcgctcccgactccggggttgctaaatttcgagttctttggtcgtctctgcttggatggtatcgttcgtgatggcgtttgcgcgattcggtgccctcgcgttgtttggggggtggattcgaggattcgaatgggcgccttccgcggggttccgcgctccgtccattttcggcgaagcagggatcgaagaatacgatttgcgcgcggattatcccctttttgctcgcgttttgaatttgtgcggcacgttttgaacttcaaacacgtgattttctcaaaaatttaagtttttgttttcgtgtctatagtgcgggcgattttctgtgggcggcggtggtttaaatcattggtttcttttacttatcataggactaaggatttggctatgccccgtttctcgtagcttagtcgaaatatcggatatgttgcatcgaaattgttgatcctctttttttaaaaataaaatcaataagtgatagttcggggaattttactcttttaccgagttagcaaaaaaaaaaaaactttgctttactgtagcaacttagcattgctagatgtctacccgctgctctcatgattttgcacttgctgtacgtctaaatactgtggttttcttctctctttttttttaaaaaaatgatattgaattgtacttgctgtacgtctaaatactgaatctgagttagtatattttgtgtagaaactaaacatactaattgaaatcagcaccagcaaagtgtaaaaagactgttattaccatttgaaatagatttctatgctgttatggattgtgtgggcgaggatactttgttttttttttccaggaataggaatacatgattgtttgcccttattgtatgattatgatgaaccaagtaatgattaaatcttggcatggtttgtctccgaaagatgtttttaggtttctcctatccatttgtgtttacacatttattttttcattacatgaaaacttgtactggtttgttgcttttaagtgtattttatccacaaagaaatgatgatggcacgttcatttgtgttctattttgtattcattttgtttttagaatattattctagactcggtttgctttgtaatgaaaatattcttttgtcaaatatttgcagcgtatgtattatagttcatattgccgcagcattcattaatatgctaacattgatgatgaagaacaattgtaatgatgatgatattgggagtgagttttatgactcctttaatttagataataccatagagaatgtacattcacaaaacaataagttggagctggctaaaactggagagttcaatcaatatgagcaaacaaccggattttctttgccttgtggagatctgcagtatggtgagaaacttaactaacagtttctgaatgccctgtgtgtactatgttattagagaaactccactttaatgcatctataatctgtggctgttatttttcagatgtgtacctaaggactcagatagccgggcaggataataagagtggggaaggtgctgattttatggatgatggaacttttactttgcttaaggtaccagttctgctatttcttcctctcttttttttctcttcatgaaaatgttgtacttctttagtcatatgttaatatgatattgatatatgttgcatttattgattctacatttattatttaataattgctcttgatttatgttcttatttgcattcctttgaacttttattgatttgatggaggctatttcatgtacacaaatcaagtcattcaaaaagaatcagaaaaagtttatttgcttttttcaatcccgttggtaagatcactgccgaagtaagaaatgttcttggataacacatttttatttattgatgtatctgccatgtttttgcccatctatgattatctttggttcctttagtcaagttgcggaacaacatgtgagaatgactacttcctttagtcaagtgcaccatctagttcacttgatgtagtaaattattaataaaatgcttcaatcaagacttagcaaagttatactccctctagtcagcaatatttggtgtcgggagcattaatcttagtattcacaacataaaatattattagtccctccgagggactaactcatttgtagaaaatcatctatgttataatgatatatgcagtatgggattgttgaaaaacatgcatatgcacataccatgtttaccttcaatgagatgaggatgatcatgagatccagttgacaagtgaaaggaaaaaaaaatgcagagtggggtaataccattggtttgccatgcccccatccactgcagtctacactttcttctagccatagctctaggataaagaagatggttacgtgaaatctataaatacatgtaatctagaaaacaggtaaacccagacaggctgcactgttctactggtttggccaaatccaatgatgggacaaaattctaagatggtgattaaatgcacgtctcatgctttgattaacaactgttgatcttactcaaatttagacaaataaaagtttttaacctttgtaatattgcacatgataggtttgcttccaaaaatcatgtagcatttagaattgcagatactgtacatttgtttttttttattttgacaactttattaagtgtactctgtaccaacattccttttggttaacatgaactatgcattcgtctcaaaaaagatatgtacatgttatattatttccgttttcttttgaagttgtaactgcatcactctatcaggataattgtttttctctagattgaaggaattctcgcctctagtgctaactaagtggcatatacttgcaggatttggtaactgaatcaagaacttcgtcaccatattatgagaaggatcatcagttaaattcactaaattatgtcaatcaaggtaaggagttatgagttaccctttcccctgaacaagactacactgacctgcttgcgtatgtagaacacacctatttaaataatctgtttagaaacagaccattaaaatgctccttccaagaatctattttttatgggaatattgatttagttattactgtgttaatatgccactggtttactgcaatcgatgcagctaacataattgaggggttttcattgtcaacaatgatgaccattctggattcctgtatcaggctactacgggcatgctaataaccttgactgcatttaggttttcacttattgccaatgccaaagccttcttgcaaaatgtgaaatttgcatgtggttttgcattcccatccctgtcctcatctgatggttgcttcgccatcctcagccccattaggtagtatgttattggacatgggttagtgcaagaaagattgtggaattgttactccatatatctatcaacttaaacacactattacctatttttatcacttagtattaattgtttatctgccattgcatttaaattccatggtaaggtcaaagtcaaataacttttttctaatggagatacgggttttgggtattgtgtgtttctcagatggacatggcattcctacaacaacaaatcctacctgggacttgactcagagttgcaatccgttgaaccattccctgacagaggattctgttcctttcaatgttggtacttcagctggagtcctgactaatgccacctcaaatgattttattcccattgatgagctagcaatcacgagtgggagatatggagtactaccttccattgagaaaactgaagaaggcagtattgccatcgacgaagctaactcgtttggggcaactgcaaccatgtgctataatagcgttcatttctctcattggattgaccagaatttaactggtccattgcctgatttagctgatcttcctgacatatatccagacagtttcttaccaacacctagaaagaacatcactcttgttcttgatcttgatggtaagtaatgaatgacgacctttacacatgtgtttctttccttgcacttgagattaacgtcatattcgttttctttctgcacagaaactcttatccactcatcagcggttgaccgtgatggtgctgacttttcatttcctatgtaccatggcttaaaagagcacactgtgtacgtgaagaagaggccacatgtcgacaccttccttcagaaggtgtctgagatgtttaaggttgttatcttcacagctagcctaagctcctatgcaaatcggctgcttgatatgttggatcccaagaacatattttttaccaagcgttatttccgggattcatgcctgcctgtagatggtagctatcttaaggatctgactgttattgttgctgatctcgcaaaggttgtgataatcgacaattctccagaggtgagtcgtcgtgataatccatcttaaggtgccttttaattttgtccaatttttatggctatactaatgcttagggttttgaattgcttcagtggatcttggctttgagtttgaaacctgaatttatgagttcgggaagggtcctatatcatctggtgcctgaatatttttctgtcacatgtgctgtaggttttccggctacaggaggaaaatggtatacctatagagagttggaccagcgacccggctgacaaatcattggttgagctgatacccttcctggaagccattgctgttgcagatgacgtccgaccaattatcgcccaaatgttaggccgtccaagatcaattgcttagatgttgcgacaaatatcagaaactgctcatttgcttattttacaagaattttttccccatagttgaacaggatacctgtgtggtacatcatcgaactagtttcccattgcttcttttaccgagtttgattcccaagattttgtgaattcttttggtgggaatgttaatttttgtacttgcagttctgtacgtagcgtctaccttaaactagcctatgtacaaacaaattcaatcataggagactaaagattatactccctccgttttttaatagatgacgccgttgactttttcttacatgtttgaccattcgtcttatttaaaaattttatgcaaatgtataagatataaatcacacttaaagtactatgagtgataaaacaactcataacaaaataaattataattacgtaaattttttgaataagacgaattgtcaaacatgtacgaaaaaatcaacggcgtcatctattaaaaaacggaggtagtatttcctttccaagttcatcctctgatttatctacatcatatggatgtggataagtggattgatgttgtccaggagtaaattatatcatcctgcttgatctgacaccccttcatcctagtccatgagtcgggcaagctttgaagatgaagaagagggaggttgaagatgatggacctgaaggcggagaaggaggtcatcgctggaaaagctgtggcgccggcggagaagccaacaccgaatccggtggaggtggagatatatccattatacatgtgtcatgtgtattcgacttctgtgctgcctgctcaagctggtatcatctgtgctgcttgataaataaatttgcttatggttagcactggataggaaaactttctgtctatcagtaatatcagtcaggattcatgagttttttggcccattgttgttgttccttccttggtgttaatttgcggttaatggagtaaacaaggatgtatttgtcagtgagaagttagggccttggtagcaatcaattttgcctgtctagtgactggaatttcagctggtattgatgggtagtagccatggttctttctttggtgcagactgcagaggctttaacttagctgacaattcagtaattccatagtaatatttgtcttgtcctacttctgatttctgaagctccgtaatatgtaacaaaaccacattcttttcaaacacaagaaacatgtcgaccaaatttgattacaattcggacataagcatgatatattttacatttgcatggacagaagaagtcaatttgatttgcttttgcatcttagtacaactttattccatgtaacaacttagcacttgacaagtgtagtatctagcatgcttcctttaaaacaaaaaaaattcaaaaacaaaatcacaaaatctgtaaaactcttttttttttctgaagatcctacaaaattattggaatcctgcaaaattactgggctcgcaaggattccaagaaggctgggccgatgaagaagctctcacgggccatggctaaaagcctaaaacccaaaaaaccctcctcctccctcccctatcctctcgctcgctctcctcttctccacgctcccagcgccaaatcccagcagcttccccgcacgccgcgaatggcgcctcccgccactgcctccgcctccgcctcggcaccggtctccctcctcttcctctccctcccgctctccccttcctcgtgtcgcggcctccccgcgccacacacccacctccccccgcgccgcctcgcgctcgcgccggcccgtcttggcgccgcgctgctctccagcctcggcgacgcgcaggaggaggaggagtacgatgacgaggaggaggaagagctagtggtggtgggatacgtgagcggcgcgcacggggttcgcggcgacgtcctcgtgtcgccccgcaccgacttcccccaactccgctttgccacggtacccatccctcgttctccatcatcccgctccccaatttcggagctaatatgtaatcgggcgttgttttttgttcggttgtttgatcatcacgatcatgccacgctgacagccggggaagagatggctgagggcccgtgccgctgggaagcagcaggtaaaggaatttgagcttgttcgaggaagagctcataccgggaagaagagttggatcgtcacctttgatggggtcgattccgtggatgaggtctggttttttactttgattgcattcctatacagtcatttgctcttaatttctaggactcgtagccttaaatcagcttgctatagttgatactagtttagaagtgcattggggtatttgtaggtcgtcggaaacaaactaagttgatgtttcatccatgctgtatttttgctccgcacatgcgcacatacaactttacaacaacaattatcggctgcattgagatatttataggtcgttggaaatgaactgatataatgtttcatctatgctgtacattttgttccatacatacaacatcaattgtcggcttctggcagatcaagtttacacaccatcactgagtataactgcatgattagttcagctcaacctagcgcacacgaattgtatattatggtcggcatgtgtctagatcagaatccttttatgaatagcattcagtatgtaatgtgtaactaatgcttactataagttggcatatatacctagcttctggtgtaattcgtttattactctattttcaggccaggcaaatagttggttcagctatacttgtgaaagttggggatagaccaaaaatggaggaagatgaaatctattcacttgatcttgttggcatgagagttattgtcaaggtacatattttccttttcaagttcgtgatttagttgttggtttaaataacaaaatgaatctacaacgttagcaaaggcatgatcctactatttggtgcctaggcagtaaaactgaaatatagtggtagctggatgacgtgtacatgtaatacattactggctctctggctgtttgtcttcgaccctgcctttggatactcaataaatgtgccatgtccaacagactaataattgtgg

SEQ ID NO: 60479 - DNA, 1606 bp, Oryza sativa
ctccaaaggggcttcttgagctcaacgcgcgttctgataagagatcaaagaaagaaaggcgtgctatggttaggtctgcatcatccttttcttgcatgttatgttccatgtataaagcattctttcgcacataaaagtaaagaatatgtcaggtctaaagaatttcacgtcattatagaagggggccacccctgtttcagaaaataaaaggttctaaaaaactcaaacgtttatttcagcagctgcacagcttttgcaaatattgaatgcacatgtcacattttttttaatgaatagatgcagtaaacacattgaactctcttgcttgtggtgctaaccaagaacgatgcaatcatatgaaccacctgatattttgcaaataaagcgtgaccagatgtgaaatatcacaggaatggaaggaaaagaagaggttacagcgtcgtgtaattgcagcaaagaagatactatctgaaatggaccagggtcatgttctggaaggtttgctatctggggacaaggttcagaaggcttcacttgcagaacagattgggtccattgactttcagttgttccgacatgcaatgcatagtgttagcagaccaattggcaggtgcagacttctgacaaccttttctgttctgcctaaatccttttcaagagaagctgacttgtgctgcaatttttcactaaatagatgtcagtaatttgcctctagttcttaatctagcttccttttttcgaacatgttactatttgcagcttgtcaaaagatgtctttgtcaaatcctcttcatcgaggaaaaaattgatgagaataccttacgaaaccctcttgaaccatgaagagaatgcgaacttcgctagtgaactcaatgaaggcgctgggatcattcagaagtcgaaagcagccaccatacttattacaaatgactctgataccctggatgctgagtttcagggattgcttaattcttttaataagttaatgaaggtatgcatttcatgattgtttattgcagttctttctgtatgggaactaaatatgcatgcccaatttgcagttttatgttctctctgattgttccagtaataaatttatatatgccatgctgccataaggagagagagattgaagatcgatttagtctcagtctctctcatcgttcatagtactaatctatttagctacaacaaacattaaaattatgactggttggtttgtgcttgtttgcttcatgtgctttgttgttaagagctttaggctgtgttcttctcccattttcctaacccacctctctcgttttccgcgcgcacacttttcaaactgctaaacggtgtgatttatgcaaaaactttctatatgaaagttgttataaaaaatcatattaatccatttttcaaaaaaaagttaatacttaattaatcatgcaataatatgagcttcgttttgtgtgccggggaggaggggttcccaacacctcctgaacacagccttagactctatttcattatgaatgtttggagaaaattgatatatcttttgcttgatacaggttgaagaaacccgaggctctatcccttttgttattgtttgtcctgctggtca

SEQ ID NO: 60480 - DNA, 1978 bp, Oryza sativa
ccggtacctgaaatgtatcttacctgtacggcagatatgcagcttatccaataagccaaaccttgggcatccgttgctgtttggggctgtcagctcctttggcgcggatgctggcctcatgcttcgcaagagcagcaaggaaacagaagatgattttgatctgattctttccatgaaccacgtaaacaagatgtgcagagatgttactaagctcaggttctctgcgcagcaggagcaacatgtgcacgtcgagcatgtcgatggccaatgggtcgatgtccaaccagaggcaacgaactgtcatcgcttgcatgcagaggtcactagtgtcttgaactactgctctcctgacaaggtgtgtgtcatagagattgtccagcaataggttctacctgacaaggtgtatcatagaaatacagtaagcacaaggtagtagttttgtttttgagaagtgttggatggtagatttaacaccagttgacccattcatgtgcggcctacttgtatgttcttcggcaaatgccacagagaaagatggcccgctagaatatgggtcgtgaataatatttgtggcttgatccacttaggagtttggacatcaaaattcaacgaatgatatttttgcaatccaatttgtccgtcagaatatggatcctgcgtgagatgcgagcagaggaaaccaggcgcccaagcctgaaactgaaacaaaggtacatcaaataaattgctctttctattgacttttgtttgcttgtttaactgggctggaggctcaaatatcactagcatattttgcttcctcatttcaacaagattaaactttggatagctagcataacattctaccaaataatccgccgtctcaattttttggcgaatgattcattttcggagtatgcttttgcaggtttacacaagaagcaacagcttctagcaagaaaacaagaaaaaaaaatcaagggttgcaggtatgtacacaagcccagcctagtgctgttattcacattttctccttttctccacaacaaataaagtgcgagaaattccaccatgaactttctctccctcttttcctctttcaccatcgcgagctcactgccatttcaaatggacaatggccgcctgagatggaataggagtttcccttctcctttcttcaaccttcgcctgcatccatgaccagatgcgaccaattcccttgccagccttatatctgggtggatgggcacaacacaaagccatgctccggcattcccatcttgctcatctatggagcaattccacaactgcctgactaaaactctagtacatccttgaaacaccatattgaacggcaccaaccttgctgtatccaccagcaactgctgcgatgccgttgaacggagcaatgccgtatagcatgctcccctggagtgcagccctgtctgttagatcagttctgggagcactcctcgtaaagtagtattgtgaagaccgtatgtccggggctgtatctggagcaactttagcatccatcaagtgttgtgcaggcctgtactgcacacgatctttctcaagctcttcctgatgttgcctatcagagtagtctgactttaggttgtagctgtatcctgacttgttggcagctgctggaggaaccatcggattcctcaccaccctccgtgcgctgtgcggatctgcggcgcctggattctcgaatggtaataccggaccaaccgttcttcctggtctagctgtgagtgacaaagatgaaatatatgagatcaatgctctttgaattcaaaattaaaatgtacactggattaagtcacaaatggtaaagataaacagatacctgttgggatcctttgagtaacttgggatgttgcatctaggccttcatttggaggaattgatgtagagtgaactgttgtagccctgcaaagagccgatcaaaggtcagctgcaaagttcaagcacaatatctaggatctgacag

SEQ ID NO: 60481 - DNA, 4822 bp, Oryza sativa
tgcatgcctcttctgcagtaggtcgatccttcggatcaaatgctagaagcctttgtaagagcttgagtgccaaaggatctacatttgggaacttttctgaaaaaggtactggctgcttcctcctcatgctgctcagatacctccttgccttgtcattccgaatctgaagcagtcaaaacatggaaaaatcagacctggaataatttgtgctggagaattaaacatgtcaatgtttctgataataataataagtcatacccttgaaatagcatccattgatggtgtacccaagagatcagtcatcaagtccaattgatgaaccacatttttaccagggaacaaaggttttccagtcaaaatctccgcaaaaatgcaaccaatactccatgtatctatagctggtgaatactgcagaaaagaatcaatttagtatcaccaacttagcataggaatggaggtaaaaatgaaggtagggataacaaaaaacaactacagcagattttacaggagtacctgcaacattaagcagtgtattttggcttgtcaaaaatatgttcctgaacaagcagcctgctattaatatgctgctacactactctaaaactaactgacatataataaccaaagaaggacactgacctacgcaccaaccatgtagaatctcagtccttaattttattgctctttatgtgtatgtgtgtggcatctcaaggtcaatttcaatagataagaagaagaaattggaacatgttgctaaaatttcttatgctgtagagccctatgaaaatgaagagcacacgaaataatactctgataaagcaacccacaggttgggaaatttgattataccttagaaaagaaagacccacacagctcaggagccctgtaccatctagttgcaacgtagtcctgttgcatggtgaagcagacagtgagacttatgttgcatgacaaattctttggtatggaacacgacatggcatctagttttccatagagaacttagtgttgaaaataacataccgtccagaaaactgttgtaggagtgtcattaaatgcaactcttgctagtccaaaatcacatatcttgagcttacagttagcatttgctaatatatttttgggctttaaatcacgatgataaacattagctgcacccacaaagacttctcatcagaacatagataaatactcaatgctcaattgagatataataaatttagttactgcagctagcagatccaaagacagaatttgaacaggattcatacaacagaagactttctgaactgaacacgacttgatagctattgaattgagagcacatttttggcaattggcacttatgtcaaagaaatttcaatacaaagagaagagctctatataatctgaacctcacagctatcttgggaaatcaatagaatcatggttaacaccatacagacaagacagaagaaatggcactaggaaaatttcgactgctacttcaagaatgcacaggacaataagactaagactatcgcattgcttaatagaaaactgtaactttttgtgcaaatgcactacttagaattgctcataatcctaactcagagaagctccaatgtgataccatgatagaagaactttcagagggtaggtaagatttcataatatgcttaccagtatggatatatttcaatgctcgaagcatttgatacagaaagaactgatgatgttccttcgttaagtcatcattagccttaataacctggtggaggtctgtatccatcagttcgaagacaacataaatatctttgaagtcccttctagatggaggtaacattatatgtttgatctcgacaatatcaggatgccgtaaaagccggagaagtttgatctcacggaggatcctagcagcatcagatagatgctcaaagatattgtgtattttcttgattgctactttgtcaccggtatgttggtcaatagctgaacaaacaactccataacttcctttaccaacgatttcttgaattttgtatcggctggagtcaccatattcactgaagaaatccatctctgttgtgttctggacaaaattcaagattgaaaattcagcactctgtctcaaaacacaatggcatccaagaacaattacataatttaggcaatggcatgtgaattggaacaaagcacaaattcactgagttacatcttccccaagagctaagcagctgcaacacaactaatcacaaaaccaagggtttcgcattatcgggatactaagaagctttgccaaaaaaaaaaagttaaccaattacatacagcttgcaattgaactcctaataatactccttgcaccaaagacatcacaaccaaaaaggcaaaaacaaaaaccaatgaaacagtaacctttgcctagtctatgctcgacgactggaaaccacagactgaaggtctgcaacaagtaattcacagaaccggattacagaaacatacagatacactgcagcctgaccaaacaaaaactgacctgacctctactcccggctcccgctgtggtgaactaatgatcgccctaattcttgacaagtctaatgatcagtctggaaaagatacacctttggctcaaacctataagtaaaaatatacctccttttttttaagtgggcaaagatatctacagtgctatatcccggaaagaaaatacagcttgcttggattaggataaacttacccattaccccaagattttgaaccaaacaagaattaccgtgttattacgggctaatagtagcgtttatacaagtcaatcagccttgtagtaggagactacgttttaaggaaagagataaatggcttcttgcagatgcacaggaaagatttcaggaaacgctcgcaaagctcaggtaggataggatatgataggataggatcttcctacaaggcaagaatccgctccaaatccgggagcaatttcctgacgccgtttacgctcacgcgcaggagcaggacaccaaacttcttcggatcagaacccacaatcccccaaaaaaaacaaaaaaaaacaccaattcgtccagcctatccaagttcagatgaacacggcgacgaaccccaagaacccagagaaacaaaacgaagcagcagcgaaatctttagtgttctcccacggccaccacccaccttgctccgctgctccgccgccggcgccgcccgcccacccgcatttgcctcaggcatcgcgagacggccgccggggagatctcgccgggagaaaatccaagcctcgccgctcgaatccgcagcgatgtggaggatgaggagaaggagaagaagaagcagccgagccgagtagtgtagcggtgcggtggtggtggtggtggtggtggtgtgttaaaaaccaagcagctctaccatccacggtgggtgacgtggcctttttgggggaatggacggtcttgcccttccatgacagttgagtcgaggtggacctaggggtatttgtaggggtattttcggtatccatgtgaaaattggtgctgctgctgctgccgccttggtggttttgcgtgtgaagaaggatccaagcgtcttccgtgacgaataaatgtgggattgtctcgtgtgatattcggatattgttggtgttactagaatagcgtttgttgtatagaaatcttaatatgggattgtgtgtttttttgtatgtgaagatggatcgaagtgtctattaagataaactaaatggcaaatgctaacatttcgatattgggttgatccaacctaatattgtataggcaacataatgtgaaattgtgtgtacgaattgcacggagggagtattgtggtcaagaagacaagaagcatcggttcgaataggattctagaagttacggagaaccaaaatgatcaagatttcaatcacactgatttatatctagaatgattatgaaaaggacgtatattagcaataatgtctgcaaatacatgtcaccacaacgaaatactctcttcgtcccaaaataaatcaattttgtacgggatgtgaggatgtacggtgaatttagacccaaagtcacatctagatctggcacaaaagattaatttatattgagacagatagagcaggttccaacaagaataatcttgattctctgtagtagtatccggggaaaagaatcatatgggacagtagcattattttctgaaacaaaactgatggaaattgatcattttttttgttaaatctaaagggtgactcgagcacaggacgtattttgtcagcgatggcttcgtcagcgcggtggagtaggtggcgcgttccgttggcgccgaaccgcgagaccgatcccccaactaaccgagatgtgtcacacgctgccaaaactaatctctctgcctttaatttcttttgcttggcttcttcccctctctctgcagatttaatttgatttgtgtccacacacaacacacgcttcattgcttgctatattgttcaagcaacttgcaagcctaggtaacagtaatatttaagcaagaaaccagtggtgctcatgcaccgggcaatcaacctgtagcatcgtagttgaagttgcagaagtcggtggtgagttttgcaggataacttagataattttgtctgtatctttctttcacatgtatgtaaccaaggataacttaggtttctgtgtttcacatgtttgtttgtttcaagcaagtccacgagggctgtgagtcggatgcttaggatactattagtaatgcttagggtggtatttaccttgatgggtctcacttgacttttgatgacaaatggtgacgcaaaaaatctgttttt

SEQ ID NO: 60482 - DNA, 2650 bp, Oryza sativa
ttggataaagttaatatcaaacttttataactttgattataaatatcttttaaaatatttagtttaaaggcactaaaacaacatatatagatttgtcttacaaaatactataataaaagtaaaattgtttttatttattgtgtacattgtaattgaaaaacatagtcaaagatatccaaattcatctgcatttaataaaggctagattctgccgaagcgaagtggaggccctgccagaggctgggcaggatcgtaataccttttagggtttcacctcaatatatatatatatatatatatatatatatatatatatatatatatatatatatatatatatatatatatatatacacatatacacctcttgtaagccgccatgcggtgttgtaacctcatctcgatatagcgaatatattttgctggctcacgaccgtggtttttctctcctactttgggagggttttccacattaaatcccgtgtcttctgtgattgatctattgttttttatcgtttgtttgtctatcgtttcctaacattttggagaacgtattattattcaaaacgtcaagaattatggaacaaagggagtaaaagtatattgtactttatcaccatattttggaaatggaatatattaattgtgaccaagttgttaattaatattgattatatctttgtccactactacaatataccaatataccttgagcggttatctgctctataaatatataaggcaactctccctccttttcttttcttgagcagttgagtgccctagctagtatatataagtatatatatatatatatatatatatatatcactgttgaatacgccaaggtggatcagaagcgtcgtcggtggcaccaaattgctgtgccggcaattttgtcacacctgctacagctaaattgtaccatatcctttttaaattacttcctatatttgaacttggggcaaaatggaatgggtattttcatccattagacccgattctcgcgggaaggatatgggagagaaaaataagaatatccttctatccgaggatatagagagttgtatccgtccgtatctctcatattatcaaatatatatgaaatatattataaatgcatctataaacatgataaaagattcgttagcactattttacgagctcacaagtaatattgtatatttctccatgatttatgtttttaatactctaattatcttcctaatgtaatatttattaattagagatacatgtagatgtctgttctcaaattcaatacggaggaaaaaatataggaggggtgagtatcatgttatccggtactaaccgtatttggttctgaacttgaacaaaaatatgagttagaatctgactcgatggcaaccatattgtgaccattcatttttttttggtaaatataaaaaatataggccatgcttagaatacctctagtgataaaacacaacaaagtaaataattattactttattttttaataggataaatggctaattaaatgtataaaagtaaattggaccatctattaaaaaccaaaggaaatatttacatcgatgtcgtgccgttggatcgatagagaaatatacgtgcacaacatgtgaatttgcgatcgccctattagagaaacagtatagcatcatgcaatgcaatgtttgcaagctagctagtactaacgaatcaagcacgagccacacacggcaaaacatctagttttaatttccgagtaaacagttacccggatgtgatatcttggggcgccaatcaaacgcggtcaacaagtatatgtatgcgtcttgatcgtctaattaataggacgaggtacgtgtggatcggttgatggacggcctagtcacctttcctctattaatacgccgtctatggcctcgtctattacataatccaagtagtagacgaggccatataaagtgagaaaatatgtagtacaaaccacatatacagtggaaacttagaaactaccgttggatcaagaaatggacgtccgagatttatccacgtcaccatgagttaaaatttaactcgtagagtcactccgagttaaattttaactcatggtgatgtggacgaatatcggacatccatttctcgatctaatggtagtttccaagttttcactatatatatggtttgcactacatattttcccatataaagttgagatcgatgtgtagatcaattggatcaataattcaatatataatagtaatagattgttaattagtcgttgagagcagcagcagcagctgcaactacactactagtagtagtgatcagtgaagtgtgaaagagtaaagaattggcggcgtggaacacgcatgacgcgtacgttggctgtgtggtcgttgttgccaatcagtagtagtagtagcgccacattgtgaacgtgaaaaatgcactcctccaccgctctcgcctcacctgcaggaagaagaagagatattttctcgggagtacacacgtttcggtgatcaaatcggtgccaataatactgccatgcaccgacgtacgtagcgtatgccgaggaggaggctggtggcttagctacgtcgcccgaatcaaaatgacagcctgcctgtgccgtgtgcgcgtgtggcccgtggggctgcaggaa

SEQ ID NO: 60483 - DNA, 7352 bp, Oryza sativa
agcgagtacgggatgatgcgaccaccaaccgcggcttgcggacgcgagagccgttttcgcgggtggatttcacgtgagctaaccctctctcggtctcggctaaaagaattggagattttgaggaggaacgtacgagacgggaacacgagaagaacgagacgacgcgcgcgggagcagctagcgtagctgcactacactagaacggcgtccctttcaggctatcgcactccatcaccagcggctagctagagtactcgtagcttatttatgctaaggcgtgattaatggtcggccattattattttggtcaacttttttcccttgcccactccttacctctatccaaaagaaatggctggctctcctctcttgccaccctacgtttcctcacttacacgacagtaatcgctttgcctacgctcaactgcgtatagtatgcatgattgcctgtacactacatcatactatcagacagcaccacgaaaccgaggacctcgtttttgcttatgcttgtacttatcagctaaaatttaaattttcgatcttaaatttagaggtgattttaaagttttttattaaagtttattttttagcctttgcttacatatcgagataagaacacgtacataacaattttatttataaattatcttccgtttacaaatataccattttacttatttcccgaataaacgaaatgatgggtccatgagagtacgcacaaacctgagccacccaaagtatctccccgtgatttttctccctccaaccgcagcccagccgctccatctgctggctgtccatgtcccggacgatcggtgcatgacacggcaacacgccggtggatggccacgtttttggagcccggacatggacaaggaaatgaggtcccatcccatgccatcccaattgcccatgctacggaatccgggctcgccgctgtccgtgcacgcccgtatcggcgaatccggctgaaaaccacgccgacgaacctgaaaaaaagttactatgggcctcatcggtaagtaacttgcttggattgatcggtcaaagttttcttttccaatttaaccaaagcaattttattggttactccatctgtttaacagtgaaagttattctagcattttccacattaatactgatattaatgaatctagacgtatatatctatctagatttattaacatcaatataaatgtgaaaaatgctagaatgacttacattgtaaaacggagaaagtagcttactttgcttaaatggcttgatgaaggatctactatctatatttggttgaaagtacttaacctaatcagtgagatgatgtgcttcggctgaaaagttttagtccaaatagttatccgatgagaacctactcctactactaggatttttcacgtttccttgttttgctcagggtccagggctccaggcaattttccatgatgaagaacagcagaagaggttgtttcgttggcgtcagcgtcgtggggtcgggtcacttggggggcactcgaatccaaattattcttgaatgcgacgtgaggtatctacgtatggacaggaaggaccacagagaggagagctcgatgagtgcagcaggcagtgtgtgaactctactgattactgaaccaacaacctccgttttaggctactagtgtagcttaccttggctctccacgagggaataatagcagccagttgctgctgcctttcctgcgatgcaacctcttagattccttgtctctctctctccatagatgtgtgcttcacggatataaatcctctgcagcagtgactgacaggtggatccggtctcatatgtcagcggctgctactgcagctgcaggactgcagacaatccacgctggtgcttcactgctactgaaatccaaggcatatggccatttccagcggtttctttctgtatcggtgcttagtgcgatagcacgctatttgttggtactttcccttgtaccatcatgcctggtctgagttgagtggaccagccatggttgcctcctggccaatctgttttgctaatgcttgggataatactgtagtaatagcgatttggccatccattcgagtgcacgtaggaaatgggcatttcagccacgcttgacacgctttggctccaaggatacatacatcatgccaatttacaagcaataagtacaataattgtaagagtagtcaaggctggccgtgacgagtggtagtacaatgccatcgtgacagtgatgcagcgagcgtgtgtatcggataaccctgacacgtaaattaacccaggaacaaacaggtggcttatcgatgatgatgcgtatgggattataaatatgatgggtttgaaacggcattggttgacagcgttatgcaggcagtagaataatgctgtgaaactgacgcgagtaaacgggttctgcactgcaaggttgttgatgggtgcgtacgatccgattctcaccagccgtggtgacaacgatcgagagagaagttgagcaaggcataaacaaacgcaaacaggatcggctagtagccagtaggtcatcttggttgggaaagggatggaatggatggactgcgtgatcctgcgtgttgaatgtgtcacagactcaacagtcacatctaataagcctagcaaagctagcaacacagggagaaatgcagcccaagaaaggatatgcaacgactgaaaacttgtccaaatggaaaggccagtttagggagagcttgcagaatcgcagcccacagatgacagatggttgcatatgttctggttgtcaataagtttattgaactgtgaaagcgtatatgactacagaactgaattcattcttcagactaatgcaaagagtaagaaacaaaaattaacataaccaacagtctcaactcttcaaggaaggtaaaatctgaagatgaaacaagcatacttaaaatctgtaacatttgcagccaagacactaatcaaaacacaaggcaaagactgatacgctctgttaagtctagcagcttgaaatgaaatacagataaacgacagcttcagtagcaatcaacttggattactcatgtgtgctatatatgcctgcggtgtatcaaaaagccatgtagcagtaaaatccaagcttcatttctcccagttgcaaatattgcaatcctaactttggggtacagttcgttcaaaaaacttcgggggtacaaagaacaggattaagggcatcatggctctcaccacacttgctacttgctcgcagcaccgcaccagcagaaacgtattaaagccatataaaataatcaaatgcaagcttattaacgactagggcttattcagttcatatgatttccaaatcaaaggaataggaaaagtgaaggattaggatgtcacatgcactacattccttgggaatttttccaagagatctcacctcatgctaacaatcctacggaattagcttgtaataccacgatcctttggaatttggtaggatccattcctatgaaacaaatgatgcatataggaaaaaatcctaaggattcaattcctacaataatcctatgaaaaacaaccgaatgagccctaaaagtaatttgaggaaacaatgaggcacatgtaatggtttaaacatagtaacatggtcaataaacagccagaagtgatatcaaactaggagtaccaacatagtcattgagcgggcaacttagcatctttaagatgaaaaacagaacagttttatcatcgaccaaacaagaccactgtatcgataacaggcagttcaactcttaaatgtaaaccataaaaacagataattaaaccaaaaaggatctagctggcaacctgaagaggagcccttcaagcggcagcagcttctgcgctcttctcgccctcaccacctgcagaagctgctgcattgttcgcctcagcctctgccgctgcatccatttcctccgcggtagcatcaacatcatctgatggcggccgaacctgttcctcctccggaagtggctcttccacatagtcattctcaaatgcatcagaaggcacctcatagatcctcacttgtggcttcgctggatcttttacaagcacatactttccctcctcaaacttcatgcagatgtccacgatcgacttgacaattccccacatgtttgatgtgttgaggttgatctgtgtagcaaaatcccttggcttgtatcccataacagtgagtatggcatggttgtagtgatcacgggggtgcacacgtgacacatatcccaacttcatcatgtcagcaccagcaagcaaagcctggcaagtccagcgagcaagtttgttggcattgttcttgagctctgtagcgagcacagccccacgctgtgtctcaagcttctgcctccagtcaacaccagtaatcttaggatcaaactcattgagcgcattgagagtaaggaactgacgaccaccacctggatcagcattcacagcatgcacttcacagcgagcaacaatgctgatctcatcatccagcttccagcggcggtagcggtagccaacagatgctgcctcctcgccctcagaagcaaacgggttaggctcatcaaaggtaaccttctcaccatcgcgaagaagcacctgctgcgagaagttctggttgatgtaggtagcctcgacagccagggagtgcgcggagttgatatcatccttgttttctgggagctgctcctgcgcggtctcgttgacagatagcagatcgagctgggaaccatcacgcttgtcaaagaagagcttgttgccgacgcgctgcacgacgatgtcccacgagtggatgctgcggggtgtgcacataagcgcggcgaggatggcgtcggtggcgaacaccgtggccttgtcctcctcagccaggcggcggatgacagggtcgtcggtggtggtgaccttgaagaagttgcgagacttgaagcgctcgaggcggcgtgcggccttggggttgacgcgatcgaaggcgcggtcgtagtactcgacggcgccgcacaagaggaggtcctcgggctggtcggcgacggagaaggagagcttggtaaagttggcgaaggggatctgctcacgcatggtccagtcgggctggatgtcgacggaggacttggccgacgaggactggttgccgcggaagccggggtggtggtgggagcggttgttctggaagtggcgctcgcggcgggcgcgctccttctcggcctcgcggcggcgcgcctccacctcctcgtcgcggcgctgcgggagctgcggacgctggttgaagcgccacttggggccgaaccgcgggtggcgcggcggcggcttggcgtcgacgaggcggaacgaggagtcctccgcggcggcggcgagggagtcgtcgacggaggtgaagtcgaagacggagtcgcgggaggcggcggcgagggcggcggggcccgccgggttgcgcgtccagtcggcgatccgtcccagcttgtccgagcgggagaagggcgcgaaggggatggaggccgcggcggcgccaccgccaagggatgccggcgccggcgcggtgtcgggagggccccagccctccgggttgaaggcgacgacgccgacgtcgaagcccatggtgctcggcggcggaggcggtctggatccgggcggaggctgggggtggcggcgcgagggtttgggtggggagggagaggggaggaagagtggggaatttagggtttggaaataggatttttttttcctaatatttaaggggcatcgacttagcgacttggagcccggcccacatatcttctgtgtggcccacacgtaagcctctgggtttttagcccatcaggactcaagagtctcggtatcacccattcattttcttcattccaaaataaacaaacatataatataatgagatgtgatatatcctaatcatatgatgttcagacttatagtactaactatatttatttgtggatggtggaagtacttgattagtacaaattttgcgatggattagttctgaaatgtttcttattcagccttaacttgtttgcgagcatcacttggccatgtttagaacacggtaatttccagcctataactccggtttgatacagggtggtttgttagaggtatagatatacatgataagagatagagtaaatttcacaaaattacatattttgtggtccaagttgtagaaaaccacacgcactttgacacttgtcacttgagtacatatattttggtcgtgtagtttcacaaaactacactatcgatgtatagattcacccacaagatgatgtggctgtttcacctaggacgaggacatggcatcctattaccagccatcgcacgaaattaatacgatgccacgtccttatactagatgaaacaaccacgtcgtcatatcacgagtgaatccattcatcgatagtgtggttttgtgaaactaaactaccaaaatatatgtaattaagtgccaagtatcaaaatatgtgtggttttctacaacttgaaccataaaatatgtagttttgtgaaatttactctaagagataaaagagtcgaacacaaaccatagggatataaggaaatgttagaggttctgaatacaaacatcagatataggattagttctgaagctcttgttcaccctggactttgatgcgtttcaaaagtacaaatcatttgaccttgtttggaacatggcaatttccagcctaaaatcctggtagatacagaatgcttcatagggagttagtgtcaaaatttctatgaatttgagttggcaagtcaaaacatcgatctgaatcaataacacattaacagcaaagttaaacctttcatctggatcaagagagtaattccccacagttcagataaatgaacagcagccggctcagtacagtacaacaactaacaatcaacgcaagtaggaaaacacatattagaatgtctctttaactttccagtctcatagtcataggctattctgcataactgcattataaagcacaaaaggttatcactctccaagtttccttttgtttactcagatattcagtgcaacacaacgcctgttgcaattccgtctcagattgttacatgcatcaaaacagggagcatcaatataaggatgataccatgtcccaaaattcaaaaatgatttccaaaattcagctaaacctcacagaggcacgagcattacaggcgacggagtacttattaccgaagtaacaaattggcatgagcatagcagctggcaaaatcccgaacaaaaaagacaacttgttatagtcattctcgtatctaaaccgcgtacagtggttttgtggtgaaacttggaatcggttaaaagcaa

SEQ ID NO: 60484 - DNA, 704 bp, Oryza sativa
aatgttgtcttaaaatggtcctcacgtggttctatgttttgtgtagtgcgtagaaagaagtttcagccaagatgactagttgtttctttttttatatattatattagatcagttgaaacttaatcttgttattatttttcacccattgaacacaactcagtacaaagaaatagttgttttgtgttccaatttgtaaaatgtatggagaacctcgaattcgttatggtggggacaagcttacttgcaatatacagttgtacacgtactttttttcatgcctgccttctccagagttggcgtatcttttcccccctttgcagatcctaatagtgccttattctttttcctgaaaaataaatggtttcatcatggattctttgatatttttagtgattatttctttatttataacttggaatctggatattaccgattctccttttgttttttcaatttttttgtggaatccatttgcaggtatgggttctggaagaaatgaaacttccgattgtcagtatgtcctctaagctaaacagcaggaagattctgttgaagtctccatgggagatactacagaagccagcaggaactggggtgattttcagcttgctatcatcaaataaaattttagatactctaaatgaaatgggtgtggagtatgtacaggtaagatccagtgcagttcaccttcttgtcctggcact

SEQ ID NO: 60485 - DNA, 11507 bp, Oryza sativa
gaggccagcaagcaggacagagagtagggttcttgtgtggcttcagaaggttagcacctgctcatcattgtcagagtcatcgaggtcaaagacagcagagcagcagattattcgcacggtctagtgtaattaactagatagggacgcaaattaccttatcctatgcatgtctgaggcaacaatgcacatgaactgggatgctgcagagcattgctcacatctgacagcgccacacctggatctggatctgaccgatctggtcggcagcagcaaggcaaattcagtatactaatctctgtttacctgcaccgattagaaaacaatcatcaaatcaaacctagtggaagcttagtacatcagagagatatttttctctgagatattcctgactccaagcaacaccatgcatgcatttgcacagcatgaaacaactattaatcctcccctgtttttccgatgagccgttgtaaaaaagaaaaaaaaaagaactcttattctctccgctgaattcgggctcttcttcccgttgcgatcttgaatggcggaggcgtcgtctccgcttccggctgagcaacacctacacggatcgtcgaagctgaagctttcggtggtgttgggttcttccattctctgacggcacggcagcaacgacgtccatggatcaggaaactgcagttacaatgatctcccgctccaagtaagtacaccaatctactcttcctcgatcatctctatctctttctgttccactcgatttaaggcgtttgattggaaatgtgatcaaaccatcaaattcagtgaatgtggcgacaatgtattacatgcatgagctgccatctgggcgtctgcagctaatggtgctgaaagcctgaatctacgatctcactcactgaatttcgaacaagatatatgcttctttaagcctgtgattttcttacctttccggccgctacgatccgaaaagcatgacatgatcacttgcagtgtatgggcagaaatgcaggaattgctaggtgctactagctagctttttgcccatgtacctcgacatgtgtgaattgtgatcaacggacagacagatatacagtatagccccttcctaacttgattgccatgtactgctcgtagattttatctgctactacatattagcttttgtaacgattggtagctagcactctcatattttgatcagcaatagtaattacaactctgaaaaacctctgaaacaggtaggacatcgtataggcctaatatgttctttttaattaaggtgtggagtgaccataagcctagctaacttctcacaacgaaaatatttttggtcaatgcactagttgattaattatcgatcgattcccccttagcttggccatatatgctactacaacacactcaaagatattttttcatgtgaataaactatctcaatatttccattttccatataatctttgatcagtttttgcttacatacgcattattttctgagcttatatacacaagattttccggtcaaaatattctaggaattgataaatgcaatgtgcacgccgagcagagatcagaagttcagaaccatcagattcggtccactcccgacatgttccacacatgcacagatgcactgatgccccctctcggatgcagcacgcgtacacagatcttcctcctccagccatttttccagacaaccatgcatcttgttttatcattgatccaataatgacatgcagaaaaaagtcattgcttgcacagttgcatttgtccttgtccagcatctgatcaacgtacttgtcccaaagccccctgcaatctctgaatctgatgatcaactcactcaggcccccccatactcacacagtcacaaacaactctctttctctcactctgaatgaactctcacgtcagtactaatgcatggatgcatgtgaagtagtattgctgggtcctggaacaacaaggggaatcagacagcggatcgagagatgttggcagctacagttcccagctgtactagagcctgtgaatactgacgtgttggcacagtggctagatcaaaacgcacagccactttgctcagaaatggcgccctgcactgcacggccttcaactcacgggtacccaacccctgtcccctcccttcccaaaaggcgtagccgcgaccaaaagcgccccaaccttgcagttttcgagcactgtagctaccatgtcctctctccaagtaaaagagatcagtgtgacaatggcaatggcaatggcatggcctctctctctctctctctctctcaccttctgaattcaaagttactgcttctgctgctgctgcgtctctggctgagagggttaaattcagcttcggctttgcttcagtggagaggaggagatggccaaaactgagaaacatctcttctcctctcgtggcagtggcatgcatttataaccgttgctgtttccggctttgcgatgcgactgtgctgctagctagctgctcgtttgctgacagtaacaacgctttacctgcctcccggtctgacggatgcagcgcatgcgttactactgcgacgtcgtaactactcagctcgcacccgaaccctacctacaaaacgctagcagcaaagctcgccgtgtcacgtcgcgatcatttcctgcatcctctcgagatcgccggcgagttcagtgtgtgtgccactacagctactagctcactcgctcgctcactgacgcgaatcgcgcattgttcaactatgagcagggccatgcagctgcagcggccacggcggtggcgcgacggcgacggcgacggggaggaggggcccacgacggcgggcggcggcggcggtgtggggtgcaggtgccggtcgtgcgcggcggtgatgctcgcggactgcatcgcgctgggttgctgcccgtgcgcgctggtcagcatgctgagcctagcgctcgtcaaggccccgctcgccgtcggccgccgctgcgtcggccgcctcaggagccggaggcggacgctgctgcacaacaagcgcgtccgcgacgtcgccgccacgtcggcggccgccgccggcgagaagaaggcgatcgcgaagccagaagaagagctagaagccgccgacatcgtcgccaacgacgacgacaccgcgtccgccgccgctgccaccgccggcgcgggtgccccgaccgacgaggacctggcgtggctggaggagatgtaccagatgggtcactggggctttggccgcgtgtccatctcggggaaaaccccgtgagaagcgcgcgcgccacgcctcgccgcgccggcgccggatcggatcaagtccacgcgacgcgcgccccggcggcgcaaggcgcgggaacgggtcaacgtagtacgtgcaaaggttgcaccactattcggtttgatgttttctccagctgttttcgtgtacgattgaatttgtcggggtgcacacgcgcgcccgtgtggccgtgtgcgctgtgcgtgcgtgtgtgcgcgcctcgcgcgcgcgtgtggctctggaaagcgtgtgctgcagcctttcgcgcgcacgaatctcaatgtaaaaaaggttcccaacggaagcagtttccgaagtactcatgggccctctcgtatctggcacttactgtagcccgtgcaactgatgggcccgttctactaggccgacgactggatccatcaaacttttgtcgcgtaggcgaacgttaaaaaaaaggagaaagtctaatattaatccctcaatgtaggtctgatcatgttcgtatctcttaatagcaaaaggaatacatactagcatatcgactattaaaacaagtgtaaaatgactccctcaaaagttttgaaggcgaattccattgacgtggttcgttgacctaatcaaaccaacgtcaaacatctgatggtatgccacatggtttgctgatgagagatacgaattaaattagacctatatttcagtgagtcaaattaaatttattttatctacaaaagtagatatgaataagagtcagctcaagcaccagagagaacatcttggcccattaaacccctaaaaaataaagagtttgtgcttgtttggttctctaccgtaccaatttattggtagtgccaaagtctaggcaaactttggcactaccaaaatattggtagggtaaaattatttggctaccatttggattgctaccgatataaagtcaaattcttatagtatagtgaagaaatttctagaaaatgaccaaatagtataagggtactaccaaatatttggcttcaatccaaaataacacgcatactattcaatttgccaataaattggtagggtatgtttttggtatcaaatcaaaacggccctttatttcctccgaggaaaaaatgccttttattttacggaaagaaaaccctgcagagccgttcgactcttttgtgaattcacgggctcacagtatgttggttgagtagcgtatgtactgcacagtacatttacatgtgctgcctttgattttttgctgttaccatggcgtgcatcttgagtgaaacatactttacttagaacggagcagattacccgggcgccatgccgtcaatcacacgccatacagatcaaacatcacaagcatcgatcctaggacaagctaaacggaaccccagagctgctaatttttttctttccttttgtgttgtttccctttcagtttcatcttttgcttctagatctaacccaacaacgtcttctgatctcggtggtaggtgatccatttggagctcaaggaagcaacaagtagaatagatagacaacaataatttttttttaaaaaaaggcttgtaagagacactagaaaacgatgagaaaagcacatggatccaatccattccgttccattccactaggattctttgctgtccagcttgcattctatttcccttccattgcatgccagccttttcttttcttttcctctcccaaatggcaactcaactcaagcatcgtccgccacgtgtcgcgtggcccaccgtggccctcatgggcccacgcaccaaccgaccaaccagctcccccctctcatcactggcgggagattggtggggcccacctgtcggttagattatgggccgtaccggccgtcacttgttgctcgcgacgcgcaaccgcccgtggcccacctcacgcgcgcatctcccgcctccctttagttccgccgccccgttggccacagcgcagcgcagctcgcgccacagaaaaactccaccaccaccagccacgccatggcggaggcgcacgccgaccgtggcgtcgctgccgccgccgccgccgccgccgtcgtccacgacgacgtcctagagtctgacgaggaggacttcaccttcgcggcggcggcggctgtcacgtgtgtggttggaggcggccgcatcggcgctgtcgtgtacccggtcttcggccgcccgcggtcgccgccgccggtgcaggaggtggaggagcctgacacggccaccgtgcgggtgccgctggggcagcttctgctggaggagagggcgtcggcgccgccgtcgggggagcaggccgacgaggatggcgttcttgacggcgtgccggcggagacgtactgcctgtggtcgcccggatcacccgcgccggcggtttctaactctccggcgaggtgccagaagagcggctcgaccgggtcggtcctccggtggcggcagcggctcatcgggcggagccacagcgacgggaaggagaagttcgtgttcttgagctcgggctccgacgtccgtagtaaggggaggacgaccacgacgtcgcgcggcgatgccggtggccgtggcggcggctggagatattacgcgagtggaggcggcaatggcggtggccggaggccgtcgttcctcccgtacaagcaggatctcgtcggcttgttcgccaacgccggcgcgttccgccggagctaccacccgttctaacgtattgtagcgttctttctcgctgatcgtttgcttaattaattccttaattatatatatttttgtcaagtcatggtgtgacttcggattgccttgtggtagaactgaagtgtgacagatttgtagtagcagaaaatctttatgcagattttttttgtatgtgggtaatactaatacttatgtatatatcgtggattttgtattggtttgatcactttgatgattcctactacctttttaataagcattggaattcagaaacgtgtagtacgtttctctctctttccaacgtaaaaacgtgtagcagtacgtgaaacgcgattccgccagccgaagttcgaattaattcgaattcggtttagaacataggaattccaagcaaatagtttattttagaaaatggattaaaaatccagcctttataccttaaaggatgtacgcggtcacagtttgaacaactattggtacttaggccttgtttatttcagtctaagctgcgagttgtttgtttctccaatatatgctcttatattggaggtatataagggcagtgggtcttatagattattagattatactaatctggcttatagattataataatctatcttaataatctacttatttattttagcttactcctaataatacagattataataatcatagactgaatcaaacagggccttcgacgtaatccctccttcctattttaaatacaatcatgagtttacatgtccaactttaattgtccatcttatttaaaaaaaataaaaaatgtaagtcgcgcataaaataatattaatattttatcatctaataaaaataaaaaaactaatcataaaaaaataaaataaaaatcaaataagacggaagatcaaagttggaaacgaaaactcatggttgcgttaaaaatggaacaggggagtacaccttaaacaagtctttccaaacaaatagtttacaataacatttgaaaaatgcaacgcatcatcacaccaaacaatgcagattacccaattagctttagctctctcagaatcaaggacgcaacttgtggttgcggcaatggggagtaggattacctgcttatgttaacacatcttatcgatctggaagcctgaagagtacatcggatcagacgtcgcaaatacatacggacgcaacacaacacaacacaggacacaaaaatcgctgtcaaatcttcagtatctttctcaccactcgattaccaacccttctccatctccttttcaattaagccctgcgctttgggttagtggacacaattaacccggtcgttgcgtctacgtagcactgtaccctgtttcgtaggtgaaaggtacaagtggttctttacttcttttttttttttgcctcttttattattaacccgttacctatagagtcgtcatttgttggcaccttgtcgttgagctattggactcatgcttaattatgctgtatttgtacagcagctagcactcgacgcagcaacgtccttcattctcgtacagtctcactgtacccaaaagggcacttgtatcgagatggggcgttaatcttgaccgctgatcacagcattagagagctcacgtggccttgacacgagatgtgggtttgcggagttgcagcccaagcccacgtgagcgctctgtacgaatcgccgtacaacttaggtgggcccgtcttgtcattgagtgactgaaaaagttcatttgggccccttaatttgacaccgaatccgatttacgtccctggaaaaaaaacagatacaacgggtctccaacttataaaaccagtgcaaacgagatccctcggtagtattgtccctttttttggttgtcgtggtacctactaggctaatttgaccatgtcttttgttccacgtggtattgacgcttacgtggtagtttacttcggaaaacaaataaaaggagcaaaattgaaaactaaataattaaaacaaaataggggcctacaaacaagataaaaaatggtgggacccacatgttaatgggtcctacttcctccacccatggcgaagggacagcgtggcgagccgatgcccatggcgaggatgttgttgaggtcggagcacgatagagtacagaggatggcgagcaggttggagggcgttgggaagggcgggcactgtgtggcgagcagtgtccgtgagagggagttgagatcggtgaaggagaggaaggaggtggagaagacgaagtggcggaggaggtggcggagatcgtgctgggagaggtgcggcggttggaagggggaggggaggacgaacagcgtggtgtggcgagcaacagtggtgcgaagacggatgagacaggggagaggaagaggaggtatgcgtcctcctcctcaaacccattaccgttgttgtcgtcgtcttcggtggcgggaaagcaggttgggaagcgggagctcacccgccactgcccatggcgaggatgccatcaaggttggaggatggcggagacagtggcgggcgccacggtggtgaggcatgagtcctcctcctcctgtccattaagatgaggttaccacgcattacgaggaaatgtaggccctctagagcccgtctggagaaaatcacgactcgttcggcccattacgaaggaatggcggtcgactgcggtccatttagaggaaatgtcggatgggcccattgacggttaattcggcccattaaatagcttctgcggcactctgcggccttattgggcctagggaggcctaacctggcgaaaaaagagacctacctaggcccaataaaaaattcgggcctaccaaaattgcccagcgattcgtaaggctccgctcaggtgggcttgggccgcaactagccacatctctgcatgccacgttgacagcgagtgcaacctaacccaactagtagtacgattcaactgcaacgcgcaatcacatccgttgcgagctgtcaaatatcgtgatcagcggtcgagattagtgcccccatctcgaggcaattcgaaacgctttcgtgcagtacagttgagaatgaaggcttctactactccgtagcttggtgtatataaggagagccatggcgccaagacaccgaggaggaagccgcacacgccatgggaggcgacacgcacggcagaagcagctgaacgcgatggagctcaacgcgatcatcgccggcggcaacatgatggccgacgacgacggcggcggcttcaccttcgccgaggtcccgccgctagccggcggccgctgcgtgggcccgccgctgtacccggtcttcggccggccgaggtcgccgccgccgacgccgccgccgcatcggcaggcgccggagaaggcctcgcgtctgccgctatggcggtttctgatggtggaccacggcccgccgccgccgccaccaccgacgacgcagccggcggcggacgacgacctcgacctcgacctcgacggggagccggcggagtcgacgttcctgtactgcccgctgtgtcccgcgttgccggtggcggcggcggcctccccggcgcggtgccggaagagcggctccactgggtcgtctctcctccggtggcgccagcgctccatcggccggagccacagcgacggcaaggagaagttcgtgttcttgaacgcgagctcctcctcctccggctccgagcacaagggcggcagaggcggcgaggtgggccatgacggtgccctgagctactacgccaacggcggcagcaggggcggcggcggcggcggcggtcgccggaggtcgttccttccctaccggcaggacatcgtcggacttttcgccaacgccaccgcgttccgccggagctatcacccgttctgacgtcgcgaacgtcttcgataccaatgttgctcgatcgattttattctcttctctctgcaggttaagtatgtacttaattacttgccacgataaattcgtgagcaggtttaattaaatttgtttgatgcgtgtggctgataagtttggctgcacgctttaatttgtttgtctgcggtaaatggtaattgtaacaatttattccaaaaaaatgttgagtgtaacagagcttgcataataagtatatattgtatacagagtttttatatgttcatgcagggctactatataagttcaaatatagtcataaaaatgtttttaaaatttttcctcgagtcgcaatattttccacaagcttatttgctcttgttcgcagaatttctagtaagtacaacttcgcacagaatcttcaattcccttattaagaaaataaactagaaattagatgctgggaaagttaccttttataaattctcagaagcaacgtaccaatcaattatttcttataatcttaaacccctttaaacatagcctttgttttttttatcatagagaagtaccgaagtagtcatatgtttttctctttattgttactaaatactccatccgtctctggaaaaccaaattttctaagaataaatttagacaatatatattcagattcatccctaaaagttgatggccaatgctgtatgttggtaaaacagtctacgtgcggctcctgtcatatttctagctctgcatggtgtggtgagtatgtggtagtgcagagattgacttgtgttgctaattaaccaacatggcacagttgtagtcgacttgtaacacttgtttcggcatattcacataattagctacatcattaatgtactagctagctcaacacgtacgtacaggacagatgcaaccttcaaaacaaaactaattaaagtacagatcgatgcaacattcaaacgaaactaattaaagtacaggtgcaaacttctttgtttcaacagggcctttaatctctccaaccttctcttcccctgaccggccactacgtactgatgataatctgatactgaactactctatgaaccatgctgcatgcaccatagatttcaaccatatgctacaaatgaacggtcattttccagatatctccttcgatcaccaactctcctttaccaagctttactcttaattcgtcctgaaaaatatatattagtgcccttaatatcataatctgtacttgtgcaatcatgcaaatccggtcatgcgcgagaatatgctaccaagtcctccctaattaaactcatgaaagttaactatttctccggtcaaaaatatattattagctatatttagtgagagaaagcccatctatgcatgcaataatgtagtactgatttggcttgttgtctcatctaatttattactagtccatcaagatgaaagctaaacaccaagggtactctgaatgatacaagcataactacctaaccaaagttccagaagagcaaagaggtgaagtacaaatactacacacttcggttaatccatatctttcgtataaatgacagctattaaaaaccaaacgagttttagcctactctgtccgtgcttatctccacgatcttctctgataggcatatctctttggaccacgtttgattagcaaggaaggctctgattaggaaattactatgcatacgacctatctgttat

SEQ ID NO: 60486 - DNA, 8709 bp, Oryza sativa
ttatacatgagttatgtaactggatcacacgtatagcagtaatcctctaattaatcaatttgtgggtggtaatctcgctgagcggctgagccgagcagacttcaatgtgaagtagactctgcacgcgacagccggggccaacggcggcttgaccgatcgtcctgctctgctcgctcgtcagcgccccggttgagcgattatcgacttatcgtagcggattatcaatttggttacaaggataaactactccctctgtttctaaatatttaataccgttgactttttagcacatgtttaaccgttcgtcttattaaaaaattttgtgaaatatgtaaaactatatgtatacgtataagtatatttaacaatgaatcaaatgatagaaaaagaattaataattacttaaattttttaaataagatgaacggtcaatatttaaaaaagtcaacggcatcaaatatttagaaacggagggagtaaatactttattacaaaataaacttaacaaatgtcttacaataagtgggtaaataatgtagtagaattttttttaagaaaaggtattttctaatcaatggaacaaacaattcataagaatccaatgaataagcatgtgtttagttcacatcaaaattaaaagtttggttgaaattgaaacgatatgacgaaaaagttgagaaaagttggaagtttgtgtgtagaaaagttttgatgtgataaaaaaattgaaagtttgaagaattattttggaactaaacatggcctaagttcaaaagaatagggcaaagtgtgttatagtatcatcttgcggctgatttatagccggtttcagatagcaacacggtacggccgtgcagggcttgatgagaagttgcatggaatcaatcagcatggctagtttcttgattacatcctacctctgctatacttaagagacaattaagttttttttaatgtattctttgatgaagtcagatatgatccatctatcagaacttaaagtggactgtgacggtttaccttgcaaacagtgcccagaccgatggacctgacgtctgtctacttgtccagagcagcaaggatactgtagtagtatcacttgaaaatcctcgtactggtaattgtttatttatttattctctgatataaattaatcatgcaatgaacatgattagcttttcgttgcttgttgctgcggtgcttcctttctaaaacattgcatccttttcacttgttgctcacagatcttttcacgcctttgatgcaaaatcctcgcagaggtgtgaccatgaagctaaagtatcttcagagacttctttgatggttaccctgccgcgtttacagaaacatcagccctgcctctcgacaaccgtatggatccccaaaatccacgacagggtcgtgtgtggttgacactgctgtattagacatcacgacataaccatcacattaatctccatgccatcgcagactacccaacgcattgcattggccatgaaaacaacttctctagcaaaacctgcatggattctactgtcagaaaggatttttaggtgatatgtgagatcagtacgaccatcaacctgttagttcatagatggcccagtgatgaatgcagtgtaaatacggtaggccatgttaagtagacttacggagcagtgtggggtctactatatagtctctgctgtacatggtcctcaccaaaatacaggaaaacagagacatcacgtatgacacgtctctactgaggcggttacaccagaagcatgaatgacaaggaaataagccaaattggattttctctttttgccagaaaatttacaagcatgaattatgtacagcgaattccgtggtaggggaaaatgctaatttcttgtatatattccatttctgcatctatgtggacatacaaacagtagagtggatcctatggaggtggcttactattatgattcatctggctttggttcaagaatcacgggtatcttctccttttgatctccacgcaatacttccacagtcacctataacacaatatgcataagtacctgagctattatcaatcacagcaatttcttccttacaaaaacgtgtgaaagcttaccttctctccaactttacactgatccagaatcctatacaagtcgcttccatttgttacctttgttccattcacagaagtaattatgtcccctaggataagccgaccataggaatcccgcttggtcgattgcagaccctagcatacaacaagatgtataagttttagttgcaccagtcattttcaaagcaagcagctagtcttctattacacgaacatgttcaaagaaaatacagtgtctgcaataaaaaggatttgttctatcaatcacataaggttagcctttatgctaaatgaattatcactgttatgtctgttcagctgtccttagtcctagtgacgattgaaaacacacgagaggacatcaatcaacatagcatatgatgttatggagtaataactcaggtgttctcccagtaaactcaaattgacacgtaattggaacatgcctagtgcaagaaaaccaatgcttttaagactgactgcaatttacaggaaaccaataaataagatctatggacaataccgctttgcctgctggtccatttggaggagcatccaagacaagcactccacttaatccaagctgctctacagattgatctggagcaaattttatccctagaataggtcttgttactttaccaaactttataagctgatccacaataccaccaacctggatgtgttcaaaagagatgttaatagaatagaaaataaaaaattctgaaactctgagttttgtatttatgtcaagttgcatactgtatcaactggaatggaaaagccaacaccggatgatgctcctgaaggtgagtatatagcagtgtttacacctatcaagtttcctgagctatcaagaagtggcccaccactgttaccaggattgatagcagcatcagtttgtatcacatcctgtatagggcgtcctgttgcagctgaactgatttctctacgcaatccactgcagggaagggggtcaacagaaaaacaaaacagaggtgtctcagtgtattgcattatgaatcagcaaaagacagaatctgtttactcaaacaacattacacctgatgactcctgtagtaagagtgtggtcaagaccaaactgcataaacatagacataacatgttacagactgttagtgatcagtaagttaatgcaagcatgatagaaaataactcagaataatcaagtgttgtaagcatatttttctatccaggaatcaatacgtgctaaaagcctaaagatatcaccaaaacacgcgatacatagtcttagtggcataagatcattttgatatattggttgtttgcatagtgattaattgtattttttttgtgtacaatattctctagcatatattgtattttcattacaatgtcagacatattcatgaacagctagggggatttctaaggttgtttcagctctgaacagaaaagtacattgaaactatggaaataaattattcaggggtgcacatcacaagtaaagaactggatagtgtttttttgagactatgttagaatacattttattaagcttatgagccagttgtcatgaatgggtaatacaccgaacagttggtgtaagaaacactcaccgggttccctatggcaaatactttctgaccgaccagtaagtctgccgacacaccaactggtacaggtcttaatttatctgttggtgctttaatacgcaaaacagcaacatccttatcctggtcaaatccaacaacttgcgcttcatacactgtctgatcagcaagtgtgaccctgcataaaactagcgtggtaacttcacttcgccatgataccgttggaggttattatgtcataagaattcatcaaaacagtatcttagatggatggatgttttagctctatatgcaataatgcattgtcaataagttggcaccatgtagcattagcagaacagtgtacacagcatactagtatatgcggcttagaagaaaccaaaacgcaagttattgttgggctcgggaatgaattattgtgcaccaaatactcaagtgtagcatttaagtacataatgaaaatgatatgcaaaatataatcgttttaaagcttcaaacacacaatcctgtcagcaactatgactaatctatatcatagcacctttgaacatattaaactaagaaaaaggaagccattgaataatgagtcactagtaggaagtgtttacagttcactgaaccgttgtcagttgtcactgtaaccacattactgcagctaaccaacatctatttgcattactccatccatttcaagttctagaagtctagagcaatttacactcctatacaaatcttcatgcacccaaaaaaatctatcagaattgtgaagtatgattcgaattcagctctaagtgggcgacagcagcatgtcattttaacaaacctgagatctgacgcgccacggatgacatggaaattggtgactatgtggccgctcttgtcccagacgaaccccgacccggacccctgcggcacctcgagcacgtccagcgtgaaggcatcctgcctatagcaacccgaattcgcatcagtacgcgtgaaaaaaaaaaaggcaagccgaggaggacgaacgcggcggatttctacctcacggcgaggttggtaatgtagacgacggagggcgtgttctcctggaagaggcgcacggtggcgagctcgtcggcctgcagcttccgcggcgtggcgacgacgaacgcggaggcggagccggcgtcgccgaggatcagcgcggccgaggcgagggcgacgatgagggagcccgtggcggacgacaggatccggccggtctcgtcggggagcaggtcgcggagccgccgcggccacggccacggagaagccgaagccgaaggcgaagggagggcgagggagcgggaggaggagggccccggcgacggcgacctggaggcggcgcacgcgaggtgtttgatggaatggtggcgcgggcggggaggaggggacggggagaggaagcaggcggcggcagaggaggaggcggcggccattggaggaagggcggaatcagtggagggggaggagcagcagccgcggcctcccgtagaactggatgagtggacgaggatttgctgctacttggctcgccacgtcgtcgtcttcttctttttccttttttttttcttcttgtttattgttgttgccctcgtcggggtcttcgccttggttcgggttgcttcttcttttggtccacggatggatcaacggatggttctcgattgttcgagtttgcattttggatggaattcagcggatgatctgaatttgatggcagtttgcaaggctgcttgttattatcaaattttgcgataactgacaacactcacgtactaccaacaagatccgaagaggtttatacggctggcagctccagaacctgaagctgcatctgatacttcaatttgattctgtctcgacaaatgatcatgtaatagctggtgaattctggcactgggaggtggatctggattccaatcgattagtttttttttcctcttttcaaccttgcatcggagcttggcagtatggtctgttacggttttgtttgccataactgataatttgtagtataacctttgggcaactaatcattgtcatcgtcgtcaactaaaagtacaaactaggcttttggtcagcaacagagcttgccatcgtccccagattagttcatatttctgtcatcgatgatcctttcctcagtatttttcgtcgttatctagctcgggctccctagaaatgcaaaattcaatttttgaaaaaagaaaagcaaagtcatccaaaagatcagtttcaccagcacctccatttttattggatgaaaaaaattaatacatggtggagagtgtacctgcaaggagagattaaattctgtagttgaaccagtgtatcgcataataagttactcctgctggtatttatgttctagcaatttagtattcagcaaagtgcccattccattgactaaagaagagagtttgaacaacccctagaagcaaggaaacctatgtacgacaatacattttatacttgcagtatgtaaggctacattttgtaccaacagttttacatatacagacatactctatctgatcttttaagatcaaaatcactaacaaggcctaggcccagctcttatagaaagcactacaaggcacattacagcaggtcacacagctcaaaagcgaccacagctagtaaactctatctttgaacatctataagcaacaccaagggcaattttcagccaataatgctttcttttttgtgtgaacagtttcaaccccaaatcacattacaagaggagctcacagttgtgtcactgcatcatcacggcttctaatcagcagaaaactacacctaccaagtcaagctacaagaaaagagcaccaggtttactatttttctacaagcaaactggggaaacaacagcaaccgagaactaattcatcatcagagatcttgtacggcttgacaggtctactgatcgctcgattcaaattctgctcttgaggttgttcccagctccacaaatccaaccccgttagttatttatcagtagcctctcgcactgcagtagcaaagcgataattagaaatattacacttacaatttatctctagtctttcaagggaacacaaagcaaagatcacaagaattaaaatgaggataaagaacatccacgactatttagttaatgcaagctccaagatacatatatcaaggtgtttccaaaccagtatttcctgaaactattcacgacccttgctaacagccaccccattgaggttttcaaaatttacactgcaccagcaaccaaggttcaggaatctctctagagcacaagtagtacgtactcaaatcctttggtacattgcaattgcgcatttgccctggatctgcggtggtaatgcagggcctagtggacacagacgggcattgaactgaaaggtgaagcaggtgtgcagttagaaactgaaaaagttcaataaaaactgaaagagaattactactgaacagattgtaaaggaaacaatgcattatacaggattggttttgcttaaaacttaccccagcggcttctacatgtgtccaatttgttggctctaataggcaatagagacaagccttgtttctttctggcattacgcacgtaagcccatagtccttggggaaaaaaatagtgagaggcgattcagttcactgctacgatctaaatacttttccacatcactaaggaaatctgggaatatacctgatttaagattctcaactcaggcaggaggcctgaaacttcatagaagtttagaacctgtggtaatttgcacactttcatacgcttgtatcctacagcgatcttgcactcatgacagtccaggtaacactcctcttcaaactcggagacagaacggccatccatataaatagatttgctacattccatgcgggtgaaatgtacagcacagttgtagcatccccactacaaaattatgataatgtaatattcgcacaatacaagcccaacttatgttagagataagggaagtactacctttgtggaggactcaaaaagaagaagatcatttgtttgttgtgtgaagctgacttgcatcaaaaccatattcattgaattctcataatccttctctaagcaccaatagtcaatctcagatagaagctcatccataagagcttgtacattcaccgtcactgtttttggctcccctataatattgataaactaccagtaagaacactgcagatcaggaatttagagtgttcaactatagattgagttaataacacttacagtttctgaaaataaacagggagtttgtgatgcgttgtatttccaaatagtccatcagaatatatttattcaattccttcatattacatctcaagcacagatttcctacgtggaaaagataataaatatgagtggttcacttcaatggttgaggttttgggaacaaaataacatagggatcagattagtacctccaacatgtccaacatcataactatgatgaggaatgtcatctacgagagctctgagaccagggattgctttcaggagagcataagcgcatacctgaaagcatattcaaagggatgatttcctagaattgaacttgattcttttcaagagtaccatgcaacattgtaatctttcatactactactgctccatttgagattagctagatacatagaccctacaaaacatttattataactgcattgtatcataaaccacatcatatctgtggcatgaaattttcataagcctgaaactaagacactcatgtaggctcgcatatcttgtctgctgtaaaacactacttgtgcaaccagatttatataatctcttcggaactttcaaattttatttgcatattctgttaaagtatacgacctcggtttatcacttgcctagagcaagaccttatggtgtacagttttttttttctctaaggtagtaaagcaaggaacagggattattttcacaaaacatgcacgcaagtctgactgcacattcgaaaattggctttaggaaac

SEQ ID NO: 60487 - DNA, 15383 bp, Oryza sativa
aggtaaatagaggtcaaaagcttaaatacaaccagaaaatactgaattcgcctatattttctagaaccgataaagattctgcacttaatttgctagaaacgaaataaagactgaggacaaatatcatgttgaataacttaaatttggtccaaatatatcaagtttaaggatcctataacgcaaatcataaagaacatcaagcagaatctgaaagcctgacatggaaactaggaaattgaaaggatttttttttaattcacccagaggataacttcttcatctgaatcattccattggtaataagagttgccgcacagatgaaaagtactactacattacgactttgcaacttgatcatatgattggataactagtaaaacgatcaaagcggaagtaactgctaattggtgttgttctccagtgtggccagccaaagttggccttggatcgcagcatgtgagattgtgtttctggataattttgaccactctctccttggctggaacagttgttatgaacagaaatgcaaaggacaaaaaattctcaggtctaaggtcatgtggagttgttgttggggactcttaattatagtgtactcgcccacatgaatgatgcatccaggcaaacaggtgatcaactgctgggcctctgtgtccaatgacactgaattttcaggttgtgcacattaacattcctatatattttcagtgcactgtgtgtcaggattcaggatgattcaggaacagatatttcttccatttttttcataatttgcaatgcatgaagaaatgtaattaagtgaaatgcaagtcaatttatgtctggttttttttttcatctgaatttgcagggaatagctaggtttctgtccacttccagatttgtaaatataactttggagcttctttgcttgacaaaaaaaaagtaagagcctactcaagaatttgaccaaatccttcagatatatgttcacgaagagggactaaagaagagaaatttctaggaagaaactgaacaaggattgagttgtatgaataagcttacggcaaacagggtgcgtcggccatggacaaagtcctccatatcgacatcaaatatcgtacccaaatccagaggcccggccaccagctccaaatctgctccagacaaagagaaatgtggtaggtcaaagaagcaagaactctcgtagcatggaagaacagagagagagagagagagagagagagagagagagagagagagagagcgagagagaaatccgaagaacagaaagaaagaaagaaaacaagaaaagaggaaaaacactataattcaagcaagaagaggggataagaacaagaagaagaaatcgtgaaacaaaagaaagaaaagaaagaaaaatcgcaagaacagaaagaaagagagaaaatcgtaaaatcaagaaagcaagaaaaagaaagagagggagaagaaccaacctggagaggtaacagaatcgctcccctccatatcggtgaactgggacacctggtcggagaatgcagggagcggaggggcaggccacacgcgcgggaggcggggagaggaaggatttggatctccgcgaacggggaggaggcagcaacaatggtggacgcctggtcggagaagatgcagggaagcggaggagcaggccacgcgcgcgggaggcggggagaggaaggatttgggaggaagccgagcacgggaagaagaagagaaaaaacatttgggctggccagatactcatacccgcccacggctaggtacctcaaatgggccgggctaagccaagccacaaagtaggcccagtctgatatacaaccagacggcccatttggctgccgatgctaccaccgaggcaccgactagggtgcggcggcggcgaccgggtgggcggtgaggcggcggcggcggcggcataagagatttgagtctctctgtgcagtctgcagccaagggatttcatggatctgccaagttgacgatggctgaagcagatggcggccgatcgatcgaacgattcgagcaatcgatcccatcgcttcaaacttggagcggagcaggacgacgaggaggatatattatagcaaggaggtaagaggtcgcaagtaagcggcctcaatgcctaagagaggacaagattaaagaatcggagaaggatgagcaaatcgacaagagaatggacgatttttttggagatctacagagcacagacctggggaagaagaagaaagcaaaccgtatgtggggattctcgctctagcgcctttgggggttgtttaccatctgataccagcccgacccatctaatagctgagcgactgaaggaataagtccactttgactcccttacctagtgcctgaatctaattcgtatccctcaaccataatagaggatctctcaaccccaactattaaaaccggtgcaatttaactcccacgacggttttgcagagcggttttgctgacgtggtgtccatgtggcatctcaatcatcaaataaaataaagtgggacccatatatcatcttcttcatctctcccatccccctctctctcctcctttcttcttcttgacgccctagcgcaatacgacggccgacaccacgagcatcaccgctactgccaccgcctagctccggcggccactactcacgtaattgccaccgccaccgaggccgtttctcagcgtcatcagtggacggcgcagcagcactccaacatccagcgccacgcactaccactcctcctccgctcccaccatcgcctccgtggaggcgggccctcttggacgccttccagaagcttctggagcccacgccactgatctgatcggagcagcgctgctgtcgcgtgccattgccgatgaggcgaaagcgaagggtaatgtggccttctctgcaaaatggagcatagactgcagcaaagcaaggccaagtagtgccacgaccacgacgggcagtgaggatggagctacaacaggcaagccgcggactcacatggctgcgatgggcggcgatgccgtggcgaagtagacgagtttgggacggagtagattggcgcgatggctagtagttgatggctgattgggggccccgccaaccttctctagtggcggaggatggcgcgcggcgacgggcggcagaggatggtgcgtagcgacaggcggtgaggatgacaagtgccgcgacgaatggtggttgacgtgggatagatgcacgtggaggcgaacgcttcctgctagttgctatgaactgctgctgcttcatacttcctccgattaacaatataagactttataggattgctcatatttatatagatattaatgaatctagacatatatatgcatctagattcagtaacatctagtatatgaatatgagcaatgctagaaagtcttacattatgaaacgaagtcttacattatgaaacgaagggagtagatctatgaagagatgatgagccgtgaatagaaatgatcaaatgagagtaaaccctagctttcttcggtgggggcaaaataaggaaggggaggtgactagctccctcccccttgcacgtgcgggtgctatgtgctattgcatgggcgcagtaccactgtatccatggagccaggttgagttgcgaagttcaattcctgcgtttccgctcggcatggctcaaaggcaatttttgcattgcctcatcctgtctcgagagccaatacaggcagccaaacatatcaaatctgcatgcatggtctgacgaatttgctatatatctctcgtgtgatttttttcttcgtatttgacgttttttcaaccgtcggatctgcaccgcgattaggcgcgacgaatcagacacgcacaaagtggtccagcgccacacgtctcacgggcgacatggtggaggaaacgatcgataagctgatagtaacacagtagacagtagccagtagccggagtatctcagcttccagtcaacagaaaatggatcatgcatggcgccgcatggggcccatgttcaccacggtctccgtgcgatattttgatttgcgcgcccatgcttctctctatttcttttttttctttttctagttaccaaaatttacagtatatttgtactaaaattatagcgcacttacataccataactactatttttacaaatgtaattttagttataaagcactataattttagttataaatgcaatatttaacactttagatacctggacggtttctcaagcagtgcatttatactaaaacgataaatattctagttaccaaattttacattacatttgtactaaaattacagtgcacttacatgccatatctactatttttacaactgtaattttagttataaatcactgtaattttagcatattgcaacccatattgtatctgttttattagtctgtattggcccgatcttatttagacctgtttttgtctgtgtactattttttctaccgttggatacaaatatgaggggataaaaaatctgggtaattttttttcaaaaatcacacgagagatacctagacagtcccatggtctgatgcgagctaggcctagtacaggcaaccaaacataccctaaatagaccctaagtgtccagctacggtcgatcgacatgatataggtgagatttttcgtacaatataaatgtgtataatttacagtgtaatctgactatttttaatgaaaaatagctagtcaaatttgccttactaactgctccgcgtaattatttttgtaaagttaaggccccgccacccaaaatagctcgcgtatagaacagatatattaatttcaggcgtttggtggagtagcagcagcctcgcaatgcgaacagagatagctggactttaagatcgctggacagaacagctgaagtgctgaacgcaaatcgcaaccccgcgcgtcgtggcgagcgacctccgagagtccgagtcctagaggaagaagaaagcgctgtccggtacgtacgctcggtgcctgaacccaatttcgaatcgtatccggacaacgcctgcctattagtttacagaacagctgaagtgttgaacgcattggacgatctcatcatcatcctcgtttagggtgttaagccaattaaggagctgggcatcagggccagggggtttcggttccggtttcgatagatctactggcgaggacaccaactatggagacgatccctgtcgagctatggcaagaaatcttgctcagggcatcaaccaaagacgtcgcccggtcatgttgcgtctcgacgcagtggcgcgacatcgttagggacccctccttccggaagctccaccatgacaggcacgccacggcgcacgatgtccccgacgctctgctcgtcgccacatacaacatcgactcgcaaagagtcgccagcgtcttcccggtcgaaccggccgccgtctctccgacgtcgtccacgcgcacggccacggcgcccatctgccgggtcaaccacatggaaggctacaggatcgccaacatctgcaacggcttcctctgcttcgcctcccatagcacagccaaggccatcgtacacaaccccgtcaccggcgagaggctggaggtccccagggctcctcgcctccctcccgaccaagacaacgctcgctcgccggtcacgttcgcgttggggttcagcccgaacaactgtgtttacaagctgttccgcttcaccaaccgcacgatggatgtgtacacgctgggccgcggcgccgaatccaccgggtggcgccgacacgcgcttcctctgcacccgcgcaacctggtagaaagcaagccggccgttgtcatcggcggcaagatttgtatggcgaccatcggccctgcgccgtacaggcacccagccgacaatggcacgcccggcccggtgctggtggtcgacgtcgcgcacgaggagccctgcacgtacagcccaccggactacgggctcccgtgggcggacgcggcggtgagcgtcttcgagctgcacgggaggttgtgcctggccatcaggacagagaggatgatccagttttggacaatgccagttgaagaagacgacgacgaccaaccatggcagcttctctacaagttcaaggtcgtggatgatatccgattcaaccaatttcaaaggctagtgcccatgagtgcttggctcgacggccacaccaacacgctttgctaccgagagggcaacaacgtgtaccgtaagtacgtcggcactaccacggcaacagtacgacgtttttcttcgacaaaggtcgttattatgtcgtgggacagcaaaatctgcctcccggtggcttcatcgtcgttgtcgtcgttccagtgggacatctacgcgggctaccgtccgaccctgctatcgcctctcacctttgcatccgggcaacatgaggaagatgataacaagtgtgatctgttcatccgcagcttactacgcacactgcgatcccaaaaatcacagaaatgccgcccgtctccgacgtcagccggttgcaccaatgccaagagaatttgctgcataaatccacgcggattctaacataacataaatcccgttcccttttgtataagttcgacctgcacagacgcacagacgcagttgagttcgtgagtgcggtgtacggacacggaccttgtcttcactgtaacgaaaaaaatgaaatacaaatttgttgacaagttttctcggaaaaggagtaagatgacatcacctcgttttttttcatgtcatctaaatatttataaaaaaaatcataacatggattaatataaaatatcacttcataaacatgttagcataaattcaacttctacaaattacaataaaaagaacaaattaaactgaaaatagttaacatattcacaattatatttgttatttttattataacttgtaaaagctgaatttgaatagccatgctatcgaagttacatatttcatattaatatatcttgttatcttttttaaaaaaaaatagtgtgactatttaggtacaatgtgacatgcaagaaaataggaaaagggggttgaaaacactttcccagctttctcttccataggcccaactataacgggcacaacccaagtaaaattacggcccaatattatacaggcaaaatgggagaagagaaacgaggcgaaggggaaaaagggtaaggaaaccagcgagcgatccagggaggccgtagcccgtagcgaccatgtcgattgctccgtcgagctcgctccgtgccctggtcgtccccatcctcccctccgtctcctcctcgccctctgctcgcccagggctccgcggagtggcggcaccggtgcagcacgcgcgggcgcggcggcggaggggggcggcggtcgtggcgcgggcggcggcgctgccgtcggacgccgagtggctggagcggctgccggagaagaagaagccgctgtacacgcacagcctgccgtgcatcgaggcgtggctgcgcagcatcgggttctcccagacccgcgaggaccgcgccgtctgggtcgccgagatgcccctctggcacgcccgcctcagcctcgacgtcactgacctccacatcaggtagattttgcagtaacttgtccgtagattttgctgcccacacgtcgtaggctgtagtagtctctgaaaacttggtgatgcactgcacaatgcgtgctcgtttgggctttaattcttgctcgccaaattgctcctgaaccgtggttttgccaaattaaatctctaaattatgtggtgtgggtgcatcaaatggatggatatgtctactgaatattcactgtggatgtttcattgctgccctttgtagcaatcggcatattgttcagctaatgctgcaatctcttcatagcaatcagcatattgccagttcagcagatatataccaactttatttagtaccctgacagcctgacttccccgactgaaccctcgaatcacactatggaatgtttcggtataaggacgatgattctgtttctcacttatcaaaattcagttactaactccgtgtcatattgtgaatcaggtacttgaagagcggccctgggaatcttgacaaggacgtagagaggagattcagctatgcccttagcagagaagacatcgagaacgcaatacttggaggaccttaatctcatcaggccatcagaggctcaagattagaagttcttgcaggatcttagcttatgggcagcgcagtaggtgcatgctctttcatgagtgactaagaaaagctctgccctgctgctgattggtcgttcgacgtccatcaggaaggagctttgcttaagttcccttcagtcatttgtacaagagaaaattaattatgtatctcaatttcatttgtaataattcaatgtgcttaaggatgagacgtccagctgataatttggcaatttatttaagctgcaactactgttgagtagtactccagcagttttagctatagtctggaagaattttttttgagtagcctcttgacctctgtgcttgggttcttctctggaacagccgatggtagtgcgatgcactatcgtattcgtatctcagagcctttaaatcggtggttctagttttatttttgggtttgttaaaactgttgcgttctctttgcctcgttgcacctaacgagcaggggaactgcatccagctcagatagccagcagtagcctacaaggcacaagatagtgattggcaacatggcatcatccatcaggcattcaggctagtacttatctgaacgccgaatagcgactctacataaaatggaatcaggaagactcgccttgcctgtaattgcataaagttggtgtcccgaatgtagtactacaagacaacgtttgctacttgctactgtcctgtgtttcatttccagatcacgcaatatcgccaccgagagaatggtgcctagctcagctgacaggcagttgctaggagtagagcactggcctgagctcaaatcctctcaaacgcaagtttcttatcattttcttatttagcaattacactatgctaagtttctcattgattccaacacattttagagaacgatgcctagctcaactggcaagctcctgctagcagtaatacgctggcctgagctcaaatcctcttgggcgcaggtttcctcactaatttctcctctatcaatatcaataatgggtactatgtttctctccagtactttcaaaggaaaaacatatcgatgatttgcatctttgtgtatctgctggggcaaaccaggactgatcaatggtcattatagacaaaatcgaccattaacaacgggagaaaaaaacggagtacatgatcaattgatcaggtttccggcgcaaccaacctatactagacgggtgcagatcctctggagttggcttccaattctaaccggtgaatttgaaccaatctgaccccttactttgtttctatgggctagatgtagccatgttacctctttctaattacacatttacaacagaaataatcctatctacttttatttttttgtgttgtccgtccattcagatcaatagtctcggaagagcattatacatcatggagtaaaaaataattatctttaaacttttttaactgagttgttatgaaatttacggtattgagacctgtatcgaactcattcatcctaataatcgacagaacaaaaggcttctatcggtgcaatgtttttgttttgttcttctctaattgttgccagaaagtttgaaggtaacatgttctctacaatactagataacatttttttatagactctacattgtagtatttcttttgaaagaaaatgggccagtagtaaccaggggaaaatggattggatttaatctaatccatcaaattaaagggacggcttggattaagtaaatccaccatgtggatttggaggcaactccaggggatccacacccacactagaccaaggaggagcccccaggatatgcaaggaaacaagaaaaatcattcagcaaaccgagacacggacgaggtatcagtgaagccacacacacgaggcacactagttccaaactttctgtttaaacttctaatttttccatcacatcaaaactttcctacacataaatttttatttttttatcgcatcgttacaattttaatcaaatttttaattttagcgttaactagacacaccaactgaacttctattccaacacgcatgctgcaacgaggcaattggataggtctggtccaacccaatcaccgggcgccccaatccaacccaagccaggtcagggcgggatcaaaaagataagctagctaggccccgtgagctggcacctagtcactgaccgcctcgtctccacgctcgcgtgggcccacccccacactgttcccggcgacgtggctcaatcgcctcctgactgctgcgtaggcgcacatgggcgacgacgtggcaaaattgacgcacatgtcccctttctttttccttttattccctcctctcgcacttactccaatcgccaggctataagcggtggccccacacccccacacgctcgggcccacaaagcccacgccccacggcacgccaacggcgtgggagaagcttccgcttttttgctcggcaagtttttaatagtatagctaattgtggactctaaattatttatagtcaatttaattaccgattcatataataattatttaatagatggtcacacatgtcatatacatatgcatcttgaagttcgacacatgcatcttaaagtctgtgctacaactggctacaaatctatagtccgttgtccttttctctcctgttttatctttatgaaatgtgttatagcttgtttagggcccctttgaatcgtagggttgaaaatttggagaaataggaaaaacacatgattctgatatgaattgaagtgtaaaacagaggattataaaacacaaaaaaaacacaggaatgatcgtttgattgaagcgcaggaaaaacgcaggaatcggatgagagagatgaattttccaagaggttagagctcttgctatatttcctctaaaatccacatataatgtgtcattccatagaaatttcataggatttggaaaacttcaatcctttgaatcaaaaggccaggtaggaaaattttctataggatttgaattctatgaaattcctagataaatcatttgattcaaaggggtcttatatttgctattgtacttgctctagcacgaaaaagtttattttattctgtggggggtgtgggtcccacctggggatgcgggcaccacgtcacccacatgactcggatgcaaagctggacctggagggggcgacgcgtagagcggcgagatggtcgacacgtgagcggacggatggaggtgacgaggaataaacaagtggcccccacaccacgcagcccgtggcccagtgcaccctccacttgccgcctcgcccatcacccgaccccaaattccagacgcacccccccagagaatgtacacaccagtacaccaccaccaccatttggtccatggggcgcacaatgacacaaaccactttgcttacctaacgagcagtcgagcacgcacgtttatcacgaaattagtactactagttcttatcctggagattctatctggtacagaagcttgttggcaactcaattatttgcttggtgcgtgcaatcttagtcgtccagttaatcacaacattattgttcttagcgtggtaggtctccttataattggaggattagcatagaaactttagaggattctaatattatattagcaattcttgtgaaacctttgaaacaaatgattaaatcctgttatatctttgaattcatatggaataaacaatcctataatgatttttgaggaaaatagccaagagatccagtatcatgtttttagttctttctcttttgcaatcatatgttttctcttggtttgtaatcaaacatctcttttgaagtttttatgttagaattgaggattttttgtgtaactcctattcctatgttgtgagtttttcatgattagggtctatttatatacaccaatgctagacaatcttaagctaggggtgtaacaaaaggtacacgtagcacttggggatgaggttcactggctggctgaaggctaaggagatggggggaacaaacaaggtacatcggcggctgacggtgttaacatagtggacgacggcactgatggcaggaagtagtaactcgagcgaaattcaacagaggagtagaaggatactgagggaaattcagccgctcgcttaatttgaatttgaatccaaaacgacctacaatctgtaaaattacttatatacgctaatgtgaatcaatctcaagttggggtgcaataaagggtacgcgtagcaattggcggtgcagggcaacccccggtggcctagtccttatcatagacacgtgtctcgtgacgtggctccagcctttgccgcctcccctttctctcgcctccctccctccctcctctctccgcgcccttctctctctcccctctctcgctgctcattggagatcaatctgctttcacgtctcctctctctctccgcgtgcttcctccgagggtctcctcctccaccgccgtctcgcttcccggcacgcgcgcgcgggcggcggcgagctccctctccttcgccactcctccaacccctgtgcggctactccggtgcggagccggcgagcgagcatgttctaagtggctctcttccttaaatctctctacaagaggcaattgaattgaaggtatttgttctcttcctagccgctgctttcatgagcgataggagatccatgctagcaagttggattgatttgttcactccgtccaaattattagtccgtgtcctcctctttgttccggatttcgatgatgcgttggtggtggagttctaattgcagtttgtatcgattgggtgtgtgactgaatatctagttactgaagcagtttcatgttgatgtatgcgtttgccctgtcctgttcctggaaccaggattaataataaacatatgaaaagttatttgacctcgaaaaaaaaattgtgctctccaatgtaggagaccgacgaaacttttgtttttaatagctgcttttagttctaaaaatcataattcgacttgtatgataggaatttgcatcttatgaaaagattgagaattgtttttacacaagttgatagctttatatcgatactgttgggcagtgtgccaaaacgtccttttggtgaaatcaaacatttctcacatttcaggctcacgcaaatttttatttatttttagttgcttaactgcacaccattataacctgaatttctacttgataagcagacagcaggctttcataaaaggcatggctcatgatgaagctgttgctacacaaaagattgggaaaacaacctcccctcctaaggtaagaatacctgttttagttgtagttgtactgactactgagatattccttgtgatctgttatgttatatcttctttgctgtgaattgaaattagttgtactgttgtcgaaaacagtggcatgaccaaaagccccagatcatgatcaatgtatatataacccgtctctttttccttcactcttttttgctttcctttatgtacctctatctctgtctctcttctctctaaccttaaacttgtaacctgtaaacctcatttctattaatgaaatgactataaggtagagcatgctctaccttcttgcgtcaaaaaaaaaaaactagtctcttaccgcctcttttctaaaagggagagttcttctttctccaaaagtaggggacagagtacgtaaatgaattagcaacctttgaattacatccagtattcccaatctgttaacatgatgtctacactttgaggtcttatttccactacatggcttactctgaggtcttgtgtggaatgacaacatattgtattttctcacctgactcatcaatttcaagggtaggagagtagagctacatccataaacatcttatcaattgccttcatttgcaggatcaaccaactccatgtccatttcctgattggtccgctgttcaggttaagtgttttgctagtaaattatcctataatctccacttccaaaagatagaatatatataatgtaagcatcaatacaaaatttttcaggcatattatggccctggtgtcttaccaccgacatattttgccccagcaatagcttcaggccatgctcctccaccatatatgtggggtcctcaggtaatttattttcgatctatctatgcaatgaagttccaggtgttgcatgaaatctgaatttctctctgcatatctgcagcctataatgccacccccttttgggaccccgtatgctgcaatgtacccacacggtggagcttatccacaccctcttatgcccatggtaaacattaatcttgatgtgcttccatacacttttttgttcaattaaacttgttagttgaagcattaaatataagatttctgcctaaccattttagatagatgttttgttatcaataatggacttgcacaagatattgtagttttgtggaaaatcggacaaccaagtcccatcatatacagtatcaaattaacttctaacatggcagatatttcggaaaagtctatcacggttgaccagacaacacagtatattaaagggaaaaaatgtatgctaatctgacttctgtaatgttgtttacggtgcaccataatcagcactgatttcataccaagcatatcaaacttttaaatgatgtgccgaatactagcttacaggaagaacatacgtgtaggcacagtaacagaatcacattcctaatgatccatcacgcttgttccccttggaccatacagtccgattgttttcattatttcagttacagcgtcagaacctctcatattgattcttattgaaaaattttagccttaatcctatgttgacttgtgattcaatatatttattctgctgactcctattaatttgttttatgtcaattctttcaagatggcaaatccattgagcatggaaccagccaagtctgcaagcagtaaggaaaaaggctccaacaagaaacttaaggaagttgatggggctgcagtatccactgggagtggtgacagtaaaaaaacaatgacgtctagtggggattacagtgcagaaggctctagtgatgtaaatgatctaaaggtaccagttagtttcaaatgcatgctacattgtgttatcttgttgatttctaatgaacatgtctgaatatgcttaaatatactaaaattgtacattctttaggtgggcaagactggcaggaaacggagattggatgatggagctggtatttcactttgtaacaac

SEQ ID NO: 60488 - DNA, 7046 bp, Oryza sativa
  unsure (1)..(7046): unsure at all n locations
caccttcctgagaaaagggaaaaatatttatcaaatgacacataagacacatctttatctttcagtttcttaatggaatggtgactaatcaaatcctgtttcaaatttgactttgtaaaaaaatagtggctaacaacttaaatctctgccaggtgctgaaacatcagcagctgcaaagatggaaaatgctttacctcccagccatatattgggaagtactgcgattttgccaaatcacagctttccagctcaagtaattaggcccagtgctactaatgttgctaattcgagggcattgggcacaccaatatctccaccgcctggtgtgattgttccaagtcatacaggagtatcaacagaattactgatcaaggtatcttcaatctgacatcatttagaaaactgtgaaatcagaaattatgaaaaacaataattttatgtaaataagttaactttcatgtcattgttattccttgaaaaaaattacactagtatatatacatttctcagggattaactttgtggaattcttatatgccaggatgaaagggaattaaagcgtgaaaagaggaaacaatcaaatagggaatccgccagacgatcaaggctgagaaagcaggtatattatagtagcaattaccctgtgatcaatatgagcaaaacccagttttctgaagaagaaaaagaggcatcatcctggaaacatggactgaaactgaaaaccaatttggacattctgttttgggaaagggattttattgcaaatcccagtgaagtcacaggataatttaatcacatacatgtcatgtcacatacaaaatttcaagttagtacagaacatatttccataatgctttcacttatgatgtcagtgttttcgtttaggctgaaacggaggatctggctacacaagtagaatcacttacagcagagaacacgtcacttagatctgaaatcagtaggctatcagaaagctccgagaagctcaggctggagaattcggctctaatggtactgaacctcttttatgcttccacataacccttaacatgtattatatacatttctctgatagaaatgtgccttattattcctaggggaagcttaaggatcctgcagcatcgacccaggcagaaacatctctgcagaaaaccaccacagcctcctctcctcgcgtcgtggagaactttttgtcaatgatcgacaacacgaacaagacgagtgtcagacacacagagcatgctgaacccaagcttcgacaactcctcggctccggcccggccactgatgttgttgctgcaagctaatctgccattttccctgtcacagaggagagactacgcgcatgcggcctggggattttgcaagctcacgctactactcacataacattcggcagtacagtgttaggtgtcaatttggtcagtatattcaggtgaccatctactactcaaaataccgtttccaattgctgttccctgctcaggcatggaagcttgctaggtgagaccaatgtaccacgttttagcagtgttgtaacataggggtgttgtgctgcatgccaacctcaaaccttgtgagatcgctaaacactttttagaattgaaatttgtggagaccaaactaaatgaaatgtaacctaccctttttacttgggtatatgggcccatattctttacatggcttggaactgtaactttgtaagatgtttttagtcaaacttctttaaaatttatatttataacactaaattagtttcattaaatatattatgatattatgtttgttttggtttgaaagtgttactagatttttctaaaagcttaattaaatttaaataaatttaactataaaaggataaactctattataatatagagtaaagtgtacgggcagtacttaaacttatagtggtatgttatctaggtctctaaacttttaaaatacatatccaagtcccaaaacttatcacagtgtgttatctaggtcctaaatcaccgcaacgccttcagcatcctgcgtggagttgatgtagcatgccacatggacatgacatgacattatacaaatggaacccatataattttttcctttttctttttttttctctttttcccgtttcttctcctttctctgtgacccgagcagaaaaaaaaggaaaaaagaagaatgagaagaaaacgaaaaagaaaaaaaatagtaaaaaaaaagaaaagacatgtcacgtccatgtggtattgccacatcagcaccacgtaggatcctagaggggatgtgtcaatttaaacttagatgatacactttaaccagttttgggacctggatatgtattttgagagtttagggagttatataacacaattctgcaagtttaagaactgctaatgtattttactctataatatattacgaaaaggaggaagtagttcatatccaaaaggttaagccatactagtacgtgaatccatacactttctacagtacaccctgtgatctgaacttctgatctgatcaactctagttaatgactctgtcggcctgtccttgtacaggaggaccactctgccccaacagctttgacagtttgacgtttgaccctttgcaatcggatcaaacgacaaaccacaaacgattgacaccgaaacactatccagatccactttgaccgctggatgccaaacttcttcttcttcttcttcttcttcttcttcttatttttttccaaagccaaactcaaggatggtagaagtcctcctgtcttaagcacatgtactacattacaacacgtgtatgatctttcagtttctcatcaatttatcctgcttaaagttcaacatcacaccaaccgcaagttcttgaatctttgatgcataatcgtgccatgtcttgggagtttgatcaagcaattccctcttttgtgctgtgcgcattagcaagttagcattaagcaatggcgcactctcgccatgacatgccaccacatgtaatgtccatgtactgatgcagagttaacactctagtggcttagctagtgcttcacttgctcgcagttaagtgggagattaggtcctctttcagcttaagactttgctcgaaatgaaaggaaaagatacagaaagaaaaaatggaatgccgtactaagcacttgacctctcctgatctctgacggcgatgggtgaaagaaaatctctatctcttcaactcagcttagcatggtgcttagctagcagccgtagctttacacggaggatgccgttaatttcgccatggacctgccgcccatgcacatgcgggagactcaacgagacgacaactgaagacgacctgtgcagggcaaatctccaagcttctgacttgtggattacactcgctgcacttctccctttccgaaagattcgcttaaacagttttcggatcaccatttttgtccgaatcattgagttcttttttaagttaaaaaaagttaaatcactgggttgatgtaagtaaatgagaggcccctgttctaagcaggtttcagagagcacggcactcgtacatttggcgaccatggataagttccaggtcctgaagcaacgcaagtgttcctttcgctgcactgtctgtgaacaaagcatacctggcctatgtgtgcatgcaaacaaagttatttagagatcgtgtcacgcataagaatcgtttgtttctggaaatttgtcctctccgaaaacaaaagaacacattacttcgatgtttgaacagacgccatgtttagaacaaggcttgttgattatagtagctactactaatctgccgttctgctttaaagaagagaataaagattataataaaggagtaaagaaagagagatggcgaagcggaaggcttaagaaacgccaaaaaagcctttgaaaaacttggaggagaaaacttgaccgttgcagcgtgggctcctccgcgaaattaaaaagaaccggctaaaattaaaatgcaggcattacattacgcagactcaaggcaggacacgagaaaagctgcaagagtttatccgattattatccacaaggcagaagccaaaacaatctgttaattctcctcctcgttcttccttcaaaatttctttctcctactcagcattgcgtcgtcgatgaaacccttttttcctttctcagtttctttcctgagacttttctatacctgcaaagtgcaacaaagtggtcgaacccccacggtttgtcttagttttttctcaacgaaaaagcggcgactgcacgtgtcctccatggccgcggcgctgggttggttttaccgggttccgggctctgccgggtgcacgaagccatcggtatcagcatcaacctctcctctcctagcctcggatcctctcatcctcctcgcgcactagagaagctagagcttcacccactcgtgcttctctcctcgcctcgcctccctcatctcgatcttccaatggcgacgtgacgaggtggttgccctgcgctgcgcttctgaccaccacgtgcatttccatttcccgctgcatccgatccgtttgttgttgttgccgtggcgtgccttgtgaatttgctgctccgagcgagagcgagccggtggtttggttggttgcagaagctttggcttccgctgaggctgcgctggtgtggccggtggctcacgggtttcaggccgcgcgcgcgctcgcgcgggtttttttttttttttttttttttttttttttgcgctcacaaggaaagtgcagacgcgcagtgtaaaacgtcgtggcaaccccaaccgtcccaatggcgacgccgcccactgcttcccgcgcgtcgccataaaatctcgtacgcgtacgtgcgcgcgctcgtgtgcgtctctccttctcctctactctctcttcacgcgggctggctggctggctgttgatgagcatggggcactacaccaacctgacggatccgaggacggagctggaggtggtcagggactggaacggcgtcgaccaggtcgtgctccgctcgccgcggggcgcctacgcgcgggtgagcaggtttttgcgaatggattttgatcggcttggcattgagtcctttggtttggtttggtgcgattctgatggctttgttttcttcgtcgtggtgtgtgttttgcaggtgagctgcacggcgggcaggtcctctcctggaggaacgaccgcggcgaggagcttctcttcaccagcagcaaggtgacgttttttttttttcaattcattttcgattcttcagtgctctgcaaccgggttcacattactgcgattagcctagggaagtgtatttcgcaagttcaattgattgcagtagaattcaaactgtacgctcgcgggatatgttcttggattgattctgtttgagaagtgtgtactctgaacattaaactgtacttgtggaaggacagttcagacgggctctgaagacacaaaaacctgaactgtttcactgtttccatctgggaaactgaagaaatcttcagtattctcttccatggctctttcactggcttcaacacgcagtttcttgacgtgcaggcaatcttcaagccaccaaaggcgatgcgtggtggaatcccgatatgttttccacaggtatcatagtcttccattgcactgaagatttgtattatatactgttacaaataggatgccaattgataaggaagctagcttcccttctttttggtcttttctgatatccacaagactcactgcagtttggaaattctggaacattggagcaacatggatttgcaagaaacaggatatgggccctagatgaggagcatccaccattaaatcaaaatgataacaacagcaaagcttctgttgaccttatactaaagccatctgaagatgacctgaagtgctggccacatgggtatgcatttgtttttgtccaatatgtatttccttttctcttatagcacgcctttttgttagtaagggccatatgtcaaagttttgttatgtactgcatcatgggggtaattagttgaacagcctaatcctggcacttttgatgataatagtcaggagaatattttatttcagggaggttgttgaacatttgcacctcatctcgttgttaatgctgactgaatttgattttatgtatgatcctgcaatatttgatttcagttttgagttccgcctgagagtttctcttacaaaggatgggaacctgtcactagtatcacgcatcagaaatgttaatggcaagccattcagtttctcatttggttatcacacatatctgtctgtttctgacatcaggtcaggcatttcacccaacattctttttgtacttcaaccactttttgttggtgccatataatattttgaagatgacagattatatatcttgttaattccagtgaggtgaggatagaaggccttgagacacttgattatctcgataatcttagccagagagaacgttttacagaacaaggagatgccataacatttgaatcggaggtgaaaaatgtttgaataatcatatgcgctatatactttgatctactgattccgcaaatcttgttttgacattttgttgtaaaaatttacttgccacatcataaagtccaagatttacggtgttagcacctggtctatgtgcaaacatatgcaggttgaccgagtctatgttagctcaccaaatgtaatagctgttctggaccatgagaagaaacgcacatttgtcataagaaaggaaggactgcctgacgttggtaagacacaatattctctttgccacctaaccatggtaactttgcttgaaaaatttccatcatattcgctttattcctcccagttgtgtggaatccgtgggaaaagaaatcgaaaaacatcgtggacttcggcgatgaggagtacaaacagatgctgtgcgttgatgcggctgcagcggagagacaaatcactctgaaaccgggagaggagtggacagggnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60489 - DNA, 7320 bp, Oryza sativa
tagaatactcaagctttactatcaagtgactattggaagcacttctctttctagtgtcattggactggatctaaccacttcatataggaactgatgtaacttgaggaggcaaaggcgttttaaccatgttgctgacttgatgagactgacgctttggcgctgaacaaccttttgagagatgataggtcttccaacagttgggaacaatggtggactatctttcttggtctcgagagtagacaattactgaggtgatgtcccggctcaagacaattgagacacgtctcacttgatggatctttgatgtgcactcttcccgctgtgcatgctcccaactgaaactggagcaaagaggggttcataaccttggtgacaatgttattactatcaccgtgggttgccgctgcagatggagcttgtggaagagcggaagtattgctacttttgttactgactgccataagttgacgaactggttgcaaggttgtcctttggtctctcactgccttagctagcaccaaactaagttgattatccttgagtccatggtatattccctcacacaaaaatcgtgcatcctttctctgccaaagactggactgaggtgtaccatagtttttgtaagcaagctaacctggacctttcttctctcctgggcacggtgccctattgtcggtcgttttgacaaataagtccaacgggtgattgaacactttgcaagaaactggccttgaaacccataccttctgtaggtatcacttgttgctcctgggattagtggtggcttggctatgctggtctgctgaagacttggtggcatactgtctgaggttgcaggtgcttgctcttggaaaacaaactgactttcgctctgatcctgattccggcttgcatctgagcttgtacttgttgttggagagattgtcgttgcatctgctgctttggactctgcggttgcggtatcaacatctgacacatccatcattagatcttggctagccaggatctgactagagcgaggtgctccgactcagctggtagcttgttgtcttgaactgatccactgactctgactgcaacacactactgctggagttgcttccgctacacttgaccttgcatcgagctttgcatctcctgcatcaacaccaatcatctgatcttgaacgccaaaagttgatcaacgggggttcctctggcattggggcaccttgcagctttcaactgaaccattgattgtgaccataatacaccgtcgttgttgttgctcttctctctgacactgacccactgctgttgggatagaaaagagaggtggaagagaggggttgctaaagataagactttaaaccacttgcctaccgaactgttgtgagtagacttttatgattcaagttgcttaaacaaacaatctagtatggtcgcatccccaccaatgatgcaaaccaaattgcatgggctctgaattgcactcgaagtcgacttggattgggcctccaccttgacttggacatcctcgatgatcctccatgactctaagtccttctccaagtgtctccttgtcatctccattgttgctaatcacaatataatcattaggtagcaatctattatcaaattcgtacaaaaaagaacataggaacgagctcacctcgaaattcaattgtcgcgcgcgagctcttgttatcggtccatgaaggagtgatgtccgcatcattcaacccctcttgaattgaagtcgtcctcgactcaagctcatcttcttctcccaagtattgtttcaaatctgaaatattaaacgtgggactaaccccaaacccgggaggcaactcaagtttatatgcattatcattaatcttctcagcaattttgaaaggaccatcagcgtgaggcatcaacttagactttctcaattttggaaatctatcctttctcaagtgcgaccaaactaaatcactaggttaaatcttcacttcatgcctacctttactatcaacaattctatactttcatgaaaaaatttctttagtttccaagagcaatacgcattgcttgacaataaaatgccattagtatagagtaccggtgaattgaattccaatctttaattttcatgcagctgtccacctcacttgaattgttcgaaatttccattagagtcaggcttaattttattaaccctcttaaatggcctattttgactcatttagaaacttctactaaattctttattttgttcatcaatcttaattattcttatatggttcgaaaaccatttggatgaacgattattttaatatcttataaaatgaacaagctttatttagtgtttaccactataatccgatctcttaactttatttgattttagcattagtatcttaaatttcttaaaggaaatcggatgtcgcttatgggtaatcatagccataaatggctaatttcttaacttagtgaaattttctaataaagctaaacaacaccattaaaatctaagggaaagaatatctctatctcatgagatgttccaaactcccctagtaatgtggcataagcgacaatgacacaatttcaatgacgtcttacttccatcattatagaataattattcttctcattcttatttaagcttcgttcattaatgatgcagcggaatttaaaacatcatcaaggcttgattaagtccacaaatggatttcttaagtctgcacactatgtgtgacttgtctttccacaacaaaaccgtcaagctatgttatgtatatttaattgtgcaagtcacaaattaagagatgcaaaattttagcatccacataatggagctatgagtcataaatgaggtagagtaatctgatctctcttatttgagctcttgatgagctcgcaatgattttattatttatgtaatggaagcgtaatatcttatgaacttgaatcacttctaagggtgaagtgtctcgaccttaatgagacgtctattctcccctagaaatgtggccgaataataaggccataatttcgacaatgtctcataatgattcaacccaaaataatgccattgatcttcttatttaattactttattgaatcaagacattaagcatgtccctatttcttgcaaagaaacttacacaagaaaatttcaagagtagcatgcataggaaggcaattttatttctccttgcgaggaatatgagctttattattattattaaattttgaatttgaaaatgagcaatggcgcgcggtggtacaacctagtggagcgcgcagcactactcccgtccgtcggctctttccttattttattcttctccctcttcccctttccattttattcttctccccaatcccctttctctccggcgagcccaaatgaatgagcggcggtgatggtggcggcgacggcggttcgacgaggagaagcgcgcatggtggcactgctccatcctccgccggttggggggcgctgcaaaagcggcgccaagccgagccacttcctgtcctgctagttcgccatgtgggtcggtggggttcaagacggtgcacgcatgatgaagctagcgtggccgcgaggaggagttggcaagggtgcgccatggcatacacgggtgaaggagttgcccgtgcggcaacgacggtgatgccttcttcccgacgaagcccgcatgacggcgctaatgtcgtgcagcatctccggtgacttagggcttcaacgatccggtaaatctccaaaacccgaagcttaatttcttgatttttgtttggatttaatgcaggctttggggcttagggttcttccctcccctcccccgaaaaaaattagggttcttagatttggggattttaggccaatttgatccggcttattagggattttgggaaatttcaatcttgtttattcccttttgcttaatagtggggaatttcaatccaatttatcccctgttttttgtttgctgagtgctagccgaaaccttagctttggtctaggaattcttggtgtgagaattgggaatttcagtctcatttatcccgatcctcattcttctcttaaaaaatactgctaaggaacgaaaattaaatcttcaatactatgcttcttctactgttggccgagaccaccagtacaacagggctcaatggcttcacttagggatgatgggatcaagtggctaagataaggctctgacaccacaatgttggaatttaatccaattaattaattgagtcttagcttaaacatgatcaccttcttcttatgcggaaattaattgatctaactgaccagagatgaagccattgttcttcttctttcttcttctttgtttcttctgctgcgagatacctcacgaaccccttccaatgtctaatcgatcgggcaattgatttagggcttaggattagatagagttcgatcatcaatctgcctccctccttctctttctttatatagtaacactggtgggactcgggggtttatctccaattagtttggaattttgttttgcaccgatcacacaaaacaaaatctaatctcttatttttctttcttgattaggaaggaaattggtggttaatctctttcctgatccttatcgatagtgagtcgataaaatcaaccaatggccatttgcacgggagtgccactattgcaaaaatccttattggtgtcggttggaaacaaactataggagctggtttaccagccggaaccaacttgggggtgccaatgactaatagcatagatgtcgatttaataactgttacctatatataattaataatagctactggttttgtctcgtagcaagtacttataatttaaaaggtggctgatatgctatgaaccgacacctttaacctatttagggttctgtagtagtgcgccgacggcattcgtgtaccgttgcgtgtgccattttggttttgtattatactagcaagactttgaattattggagcactattttacgtattatgtattttgttcttttttagcgtgtacggtggcagaccaacgtacatacgacaattgatgggttgttcaatttcatttcttgctctcacttagtgccagacacattgcctagtaaatttcttcactacaagagaattaaagcagaataaattgctctaccaaacatccatccctcttctagttatatacttcgtcccagggctgaatcagctggagggcttcctgagaaacggcgacagaaatagcatgggaaggttcttcatcactcaaacaaataccccaaatttacttaggaagcggcagtgaaaaagaaagcgtacaataggaacgagagaacctaggaaaagaagaaaaagctactggaaatcgaaatgttaccgacaacattggtgctggagtgctcagttcaagtccgtcgctcgtctgactgcatccaggacaacttgctataacgctgctccatgggtggtgtgggatccgatggattcgagctttgcttgtactgctaggatcaatttgtgaaattccatttttgacatgcgtgcagcgatgtgtacttttgcaatttttggtgagtaggtagggcgtaaaatttttctttatttccttcatttttaattatttgatgaaggatatctttctgttaatgcgacctatatgtttctgttaaaggagagtatgttgtttctttgcaaacaaacatacgttagcaatcagcaaattttagtgttcaacaaaaagatcgattgaagcttaatttggattcatccgtctatgtatttcacgtttccaataattaggtgctaaatataaaaaagaattttctaaaaaataatcaataatgatttgtatacatagttcaacattcattaatagttccgtagcaaggtgtatatatcgtttgctccatgcacctaccgtgatggtgttatacatgaaacacattgatctaggaggataagtaaagtcactaaatttaaatgctatgcaaacttccaaatatagttctattaagtatgcactttatggccgagttatgcccaataatgatctgttacaactttagaacatataaaaataaaaacaagatatttttactaccaatagataacactataaaaatgaattttttttacggtggcgctaatacgcgcgctgcacgcgaaatattagttcgagcgccgcacaacgctctctccttccggttttctcttttttaccttcccacctttcctccgtcctttttttttgttttttaccaccccaccttccatgtttattttttctcttttccatctcatatgtgtttcatgacagggccggtaaaaaatgaagtatccatattttttcctttttcgttccttctctccatttttttatttcacgttttagtaaaatatttatcatctagtttttctttccggttttctgtttttctattttctatccacatttcaaaagcaacgaatttacttcatggagttttccatttgcacccagcctcccacacctgcttattcaaaagtaacaaatttactcgtatgaatgtcccttcaaaaataacaagtttattttacatgaatgccctgtgatgatacggcaccattcctagatggccctaaaagaattactaccataattgttttaccactgttatcaatattgtttagactttgtggtccgcaagaaaaacaattaccaccttcctctcattatagaccttgatctcgtagccaccgtatagtaatatgttactgatgtgttcaatacacagcataagagtaaaaactgaattaagagtattgtttatctgtatcacaaaatggtcgtaggaatgtaaagaattacagatcacacacgagtgataaaattactcacttaaaaagaaaaaaatgattcagccaaaaatccatcatgaagttgtgatcctagtggctttgctggatcttactataaggatggagcggctggtctgtgtcttgtgactggtattggagagggcaaccaggtggcgagcagtagtcgatgatggaatcatgaaaggatgtagcagtgtggtatatttatgagctcgaagttgcgcagtagcagccatccattatctagcaagcacgaaaaaaaatgcaaaaatattctcgttcatgtcattgagacaacgagcaaaagaaaaatagcaaacaacttccatcactggcgaactccacaatatcctctgcgagcaaccacatggagcacgatgtggaaatgtagatcatgtgcagcccatcaatttagatcaggtaatattggatattgcacgttaatttgatttgcaaaaagaaatcggggtttcgtgagtg

SEQ ID NO: 60490 - DNA, 2617 bp, Oryza sativa
aggtgctgcccggcgacccgaaacatcgccttcgcctcaactgctgtcgaccaccgttcgccacccatcgccatcaaccgccatggtgccgtcgtcttcctccatggtgtgtcaccaatctatgggctgggatggtggatccattcagattcagaaaaaaaaggaaaaaaatgaagtgggggtaagagtggttggctgggtacaagaaaaatagaatatatattggaagtagggaaattgtttttatcgaaggaaatcgtttacttcgataatggtgggagtggatgacggggcatggggtgggatcggaatcatggaagttcttttatcgaagtaaatcgtttactctgataacagcgagagcgggatgatgggacgtgaggtgaggtgggcctaagctgacagatgtttggcgttcaaaatacttggagtgagtgcgctcctagtagtatctataccctcaaaagagtatgtgatgtcaattcaccgaacagttaatgggggtgttattggaaaaaaaatgcattgcattagagcaaatttcaaggaaaagagtgattacactaacatgtcgccattacgagatcaaaggcacaaacatgatataaaacaccctgtgcatgcatggacaagaataaatcaacggacaaggaagactatgattagcattcacatccagttccacacttttagaaagtaacataagcaagtaacactcagctagtttgaggaaatccacacaaaagctagtaatgccaacattctgctccttgttgacacattgtcaatagttagaagaatttactcctattacaaaaatcaatggttttctagtgcttcattcacgttttagaggcgttgctttcagaggtcctttaattatcacaatcaaagtattgttaagctggagtatgatatagatcgtttgtagttgtaacttgctagggcaatgacagtttttttttccatgttattctcctttatttttacttttttaaatataattctagattgtgtgcatcataactatgtactaattgcttgactaataacgctagctttataaaaagggcgatactccgctctccactagtagtattatatgtattataagtagaaaacatttgtttcgttattaattaagtataaattagtaatttattaatatactcatggatgagcaggtcgatgacatcaggcccatgcatcgtgacttggctagttggatgtgggcctgtggcgctcggcgcatcgtccagagcgattccatcgagaaatcaaattggatcgcaagttatggcggctacgagtggcaagtcctccgcctggcggcatgtgttgatcccgccggcgaacgacacactccggtgtgtccctttcttctcctccaaccatccccggcagcccatgtgtgccgattttgcacgcatgagcatcgatagcgacctccgatccgttccaggcggcggcggcaacgcgtgggctactagcgattgtggatgtaaatgacaactatacccttccacacatattttttcctgaacaataataccctctacgattatactaccgttaagtgcggtatattttttcctaaacaataataccctccacgattatactaccgttaagtggggtggtagtagaccgttaggtatatagttcgctcttgggttggcgatgtggtttttcctttccctagacaaagttgcctgataactggagtattttataagtgacatgtatgtctttcctaattgatctctccagaatggaagtctgcggactcttcttctaatctctatcaattcaatcaatccaaccgttcctcctgaatccatagtctcatgctaaaggtgtatacgtggctcactgcggaaaggagtaaacattcttcgttcattacatgagataaggttgcacattcagtatgctctgttttttggtctcctctgtttttgccgcccgttgtcccctgttttgggctttagttctgttttcgtcaggcacacggctacaatttctggtcgtgtggcattttgttcacacgggagcgcgacgtgcggccaattatctggagcctaggatggcattcgcagctaaggatccatgactaaacatgcagccatcattcccaggtttatttgttttgcgacaataaaaggaagaatgaagaacaaaacgctgccggcgttacacggcaccaaaatttgtgatcgtgttcaatatttttcctctctcgcgttcatcaatcaagctttcgttcctgacagagaatgggttggattggcaaatatgcaaaggcaacagcagtctttcacatatgctgtgacgtgattcaacgaccagcatggaccctatgttgtgaacctgctgtcgagctagttcccataatcgaatatagcagtggtacacaagactaaaatattatctttatgccaggataaaactgcactcgactaatactatctctgttttgagatagaacgatttttcggttgtttaaccaagattaaggttgagaacaaaaactttactgccactcaataaatgaggagtgaatcagtgtgagagggtaggtggcgataagatgagaaaacttttgaatacaaactgt

SEQ ID NO: 60491 - DNA, 17297 bp, Oryza sativa
atagcacatagaggttattgttcgctcaaagaaaaaatgccataggaatgagaggtcccgggaaaagaagatgatatccaagagaaggaattagtcaccgagagcattagtgctggagcattcagttcatctccattgaggacttgacatcttacttctcttgctttagtagaaattctgagtgtcatgcttgcgggtggcaatctggcaagctttgtctgacagtcgtagtgcatcagagttccaactgctgtaagcctgtaagctgcttaggtcacatcgttatttgaggttatgcacttgttgagttctctcgggtataggcgcgtagttagttgttgaggccaggaataaagggaaaaggatgtgtttcgttacagttttcttttgtatcagtgactcgtgaatgttttgccaacctgtgcatttcacctaggtcccaataaacaacatgattatataatgagcgactaaagccttttatgaatttcatatgttttggattagatggatgagcattagtgttattttggaagtatcaagcgacagcacaatacttgtcggttcgcaccaattaaaagactaaaaacctagtaaaaccagtaagatagtgattttttaataagttggtgatacatctctattaaattgtttgcctctataaccaccattttaatagccaaataaacgataaacatgctcatgtcatatgttaacatcttgctttcttccatcggatatggttcctgatcaaatactaatcagagagcagttatagtcgactaaaccattacaagctttttggcgtgctctagggtggacagagatgcaaacctgctatgcgtgttgctatcttgccatatggtgatgtgctgttgatatcagactagtgataattttcttcaatggccacgtcactactgtagttttttcacgtactcccctacgacgccgttgacttttcgaccaacgtttgactattcgttttatttaaaattattgtgcaaatataaaaatatttatgtcatacttaaagaacatttgataacgaatcaagtcataataaaataaataataattacataaattttgtgaataagacgaatagtcaaacgttgaataaaaaatcaatggcgtcatatattagaatatggaggtagtatttccttgagctgtaagcctgtaggctagcttgactctcatccctctttcaggctgtgcactttgttgagtttctgcagttgtagacgcgtaactagttgtcaggcccaagaaaacgaaaaaaaatgtgattgatttatttacatttttgttttgtttgttagatataccagtgactagtcaatgtttttcgccaacccatgcaatctagctatgtaccaataaccgtaacgctattatataataagcgactaaatgattgctatgaaaattcaattagtaagttttggattagatccatttgaatttatgaagaactacagcacgctatttttcggtggctccaaattaaatgattctaaaacaagttaaacacaggaatcctctgagcaagttgtccatacatctctactaagccgtttgcctgcatatccaccaattaatacgcaccgaaaaccctacatatgctcatatgttactccctccgtttcacagtacaagtcattttagcattttccacattcatactgatgttaatgaatctaaatagatatatatgtctagatttattaacatcaatatgaatgtgaaaaatgctagaatgacttacattgtaaaacggaggaagtatatattatagtaacatcttgctttcttccctcggttagtctaaatcaaatactataactaatgagaggctttcttgtaacaccctgaaaattcgaccgacaaaatcaaaactctaaaaatacggattttcaaaaactttttaaattattgcatcataccgatcttattcgtctattttatctggatttgatctcgaagattattaatcgtgagtaaagaatagttaattaggaataaaccgtaaaaacaaaattggtaaaatacatacaaattaaaataaagattaggtggggatagaaataaataaaatattatcgcgaccatatttggatcaattaaatttaaatacgatggaataagaattaaccctaattaaaactcaaataaattatataaaaataaaatatgagtaatattaatctagagtgaattcattagttaagataacacaaatattgagtaaaatgcatatatgcaaaattaggaattgtggaatcaaatttatatggaaaatacactaaaatcgggttaattagaaaacggcattgatcattgcacctaaggtgttcgacgcggtcccctaacccagctcctcctctttccccctctctccgtcgccggccgccgcacgccgtcgccttcgtcgcctgccgccgcgccaccgtcgccatcgccatctcatcgccgcggccacgccgtcgccgtcgcgtcccgccccgcgccgcgcgtgcatcccatcgccgcctcgcgccgcgcgccaccactgccgcgccgtcgccgtcgccatcccgtcgccgcgtgcgcgttccatcgctgcctcgagccgtgccgctgccgctgccactccgcgagcccgcgccgcgccgtcccatcgttgcggtcacgccgtgccatcgtgtcgccgcccatcgcatcccgccccgagccgcgcgccaccgctgtcgccgtcgccatcgacgtcccgtcgccgcgcgcgtcccatcgccgctaccgcgccgcgcgccgcctcgtcgcctcgcgccccgtgccgcgctgctccccgagccccgtgccgccgctgctaccgcgccgcgccgcccgttccatcacctcgccgcctgtcgccgtcgccatgcgccgcgcgccgccgctgccgctcgcccgtcgcgtcgctcgcgccacgcagccgtcgcgtcgcctcgctccgcgcgcccccacctcgcgccccgcgccgccgtcgcctctcccctcttcccctctcctatataaacccctattcccactctttccctccatcctcacctcctctcctctacccactccaccacgccgccgcctccacgccgccgcgtcgtcgcatagagccgccgcgccgccgttgtcgtgccgccgcgccgccaccttcgaagccgccgcgccgtcgccccggagccgccgcgccgtgcgtcgccgccttgcgctgccgtcgccgtcgtcgccgccaccgccgccgccggtgagccgtctcccccccttcacctcgcgcccaccgccgtcgccgcccggggaggcaaagagccgggagagaaaagagagaaaaagaaaaagaggagaggaaaagagggaaaatagaaacaaaggaaaggagaaaatagaagggaaattgggggagaaattaggaggatttaggaaataaaaatggtcggggttaatcatagattatttttggaaattcctcgaacgtaatagtatttcggtcgaaattccgagttaactataaaaatatgtttcttgatcagattagattaaaattggtagtaatttagatataattaataactaaacaattagatgaattcttatagattattatagattatttttggtaatctctatgagccatcggttcacggtagaaattcggatttaattactaggaattttagccgtgtattatatttaatcatttagtcatagactaaattaaattgtataataattctaggatttcgtccgatatttagctcgtaatagaaatttctaacctattatatggatataatgctcgggaagagtaaattaaaaacttatgacaacaaaataattatacccgcaaaatagtttaaatcgaaattgggtttgccgtagtttgcagatggtaaagttaataaaaagtaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttggccatgttgatcctaattgcgaaattgttttgtttacgaataaagttgcatgcaatgatgaacatcatacttgtgattatgccatgccttgattattatttacccttaaatctttgtaaccatgtttagtatgagtccctagtcaactatgacaattgcttagaaatgctattctagaatcatgcacactcatatttatcaaatgctatatgcttgggcaattacctttgggaaggtaattgagatgcggcatgtggagacatgagcgccacattgccatgttgttgatgacatgatttgtgaaaggagaaataaaattaaacaactgttttcgactggggcggacggaggatttgggtggtatctggaaaaggctagtaccgtccccagtcaattaaggaccgagccatgaagttaagcatgaaacgacccccgtacaaccgtacttctcgaatgggtatagacttagcggattagatagccgagcggaggcagtatccctgcatagatggttcacccctgagtgaggcaggtgcgctacgatgggacagccgttgaggtagggccgagaagcgtgccctacatcggtgtcgccattagtaggactgccatgaatgtgtgagagagagaacttaacttgaaccataacttaatatgcgtgtaagacttctctttccccgggagcgccagaactcctctcactgctagaaacatggacgcctagagtgcatgaggatttaagttcatggagcgggtactgccaatgcaaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcacggttattgagcaccgggacatgtattacacttggctagactctaaattctttaacttgtgtgggatgggatattgcatgatgatttttatgctgatggagccacttcctgagaggcaggaatgtggacgtcctcagaaaaccataacgactcaatgacgggaaactatccttgggatcacaatggatggtggacagaaccgtcattgtttaatatgaacactggtattaaaaacttgatcagtctatactaggtcttaggcttgtgaaaagaattacaaaacttgctttgtgcaaaagaaccatagccatcctttgaattcctctgtcatgtgcatcattgctatgatggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttgggatgtattccggaccgctcggtccgatgatttaagactatgcctgcgggcttatgatgtaataattcgtattagacactcgtgtatgtgcacttgttatttcagctatgaattcgtgtgtaccagactacttgatccagggaaatggtactgtttacacgattgattcctgttataaaaacgggggtccacatttctattgtgccccttagggtggacagagttgcaaacttgcaattcatgttactgtctcatttgagtaggaaaatactcagaaacgtcatgagatgaatatgagcaaatgctccatccatttaacctgttacctcttcaccctggatattattgcagggcaaatctattctttattttcgttccccatcacttttgcaaaaaaaacaaacaatggaagaactgaaatatactatagagcatcatggtcatagttatgtagcccaactgaacacaaaagaatgaaggaatctatctatctatctactatgtatactaaaagttcactaaactttaaacgctttcaatccgtcacgtgagactcctaaaaacactcctaaatcgctatgtgacatctaactatcaattttcgttaaataaggtggacccactaaatttataaaaaagaaaagtttccctcttgtacgtgatactggtgcacgtcgtacgtacgtttgtcctcagcctcacgctcaacctcccctcctatttatctctctcacatatttatgtcgtattagaaagaaatcaaaaacatattttatgataataaacaaaacaactaaaagatctaaatcatatgactaatttgttttccacatacattattagattctttacaacagatttacgatttacgatcaaaattaactatatttaccaagtaaaagaaatgcattactttcgacaatctatttgacactcacaacacatttttatggaaaaatcatatacattttgaaaccacctgattaaaaacacatatcataaataaaaataataggaaacccataaaattaattaataaaattaatataataagtaccttaattagaaaatatttagcaagtaaaagaaatacattattttagatttctaatattatatcaaaatatagataactcaagctggtaaacatatttgaaagtcagtacatgcgcacatctccctgggaaacttctctcaccaccccactaactcaattttcctcctctcctaagtccattaaacttccaataaacatgctctcaagttgctaagtggaaccataataaataagagaaatccaaccatctatttttatttaaatcgatggacccattgtttaggatagttagatcaattttgaaaaaaaaaacatccggaaccaacatccggatccaatgtatacaaacaaacaaaattaatagttcgcatcataggaacgtacttactgtatgtccttctcctctattccttcctatgttattttctatttcatgagaaattaaaatcaaaattattttttagaggcaaaaaaaaatcacagatagaccaactactaggtctagcggctctccctccaacactttaaacatcctataaacgcttataagtcactacgtggtgctattaaattagagaaaatactagaaaatcttttaaaaaatacaaagcaaccgaccattgatacattgttttggattgttagatcttttttaataaaaaaaattccaaaacctctctccctccctccccacccccatgcggtgttaaaattcattaaatatattataaacatgtcacagcctgaatttcgtttcaggatttataaattatttaataaattattaatagaatttatattaaatgttgattaatttacaagtgaagttaaatgtgggaaataaaattttctaaatataaagcatggatggatttaatttttattaaattctccatgattaattatactctctggaattttctcggatttttcagagctcaattcctaattttaataatacaaagaatatttcagtaattatttaattaataaattaatcattaaatggtctggttttaatattcttaaatactttgagtgtccaagtatgttcaagatttttcttcgaattatttgagcgttgaaagtatttttaacaattgaaagatcatctcattggttaatttatgtggaaaagtaataaaaatcctcctcctcagcttgggccgaattcagcccattctctcccttcctctcagcccagccaaagtctgatttacctcccttccgctacagtactccatcttcttcctccagacagagccgagccagccgtgctcgtgcacagtgccgtcgcctcctcccaccaatccgacctccccgttgctcctctttccgaattagttgtgggaatggaatcctctcaatctcctcttccttttccccaataaatccccaaaatcttatatggaaattctttccaatttcgcggatcaaatccttcctttttccggcgagaaccctagactttcccgatttttttctcgtcgatttgggcctggacctgagcttccgtgccgatataaaggaccccctaatcgtcctctacccatcccctcaagtcccgtccgccgccgtcgccggaaacgctctccccgcgctcaccttctctctccaccgccgccaccaattccagccgccgtttgtcgtcgcctcggccgtcgctctcctgcgccgccacctctctcggctccgcaaggtcaagctccaccctggccgccgttccccttgcgccgaaacctcgccggaagccgtcctcgctatgaaccagtgggttgccgtcatgttccgatctacagccgcgccgttcgtcgtcgtctatggtcgccttcggtcgtcgctgccaccgttgtgttcgcgaggaggagaagaagatcgtcctccacttccccgaagctgaaatccaccggagctccatcgtcgccgtcaacccgaagttcgccgtcgcgttttgatctccggcgaggccctgctgctcctcccgtcatcgccaagcttcgccgcagcctccctcggcatcgcagctgcgaggagaaccccatccacccctcggttgtcgtctcccgtcactgaaaagccgtcaccaccgtggacagtacctcgtcgccgtcccgatctcgtcgccggccatcttccgtcgccatctgtcatcgcgtaagtgttggtaaggaccggcgcctcgcgctctttctcccggtgccctccgtttgcatatttgtgccgtggttcgccggcaaccgccgctcccatgccgtttaccggcgaaggtttttccctggggccttaatccaatctaacctaacccgttgtctatctagcgtcgttgtcgtctcatgtcacgccccgaactagtcccgaccggaactagtttggggcgtgacaagaaatggtatcagagccgactctcgcggtttcacaggcgcgtgtgtcgcagttgcgcaggcatggtgcgcatggctggtgtagaccgggagtggttacatagcatggcacatgcgttggcactggacacatggacgtggccaagagaggacgttcctggcctggggttgatcgacgggggcgtcgatctctcttaagggggtgagggtgtaacatcccggcctagggcttaataagattaatagaatactcatatcaacaagttgcaacttcttttccggaagccaatctccaaagaactccagggttaagcgtgcttggcctggagcaatttgggatgggtgaccgaccggaaaattcttcccgggtgcacacgagtgaggacaaagtgttgcagaaaagacatgtgttagtttgtgagggcagtctatgacctatgaaagctgccagatgtaagtgggcccggtctgggagaggcgggtcgttacaaaatggtatcagagccttgtccactgcgacacacgcgcccgtgaactccttgtcagcgggatccgcttcatcttcttcagcaactgggtggggaaatatttatatagagcaagggtgagtaaaggagtactcagcaagccatgggaaataagtgtttaatgccggcttcaaggaaaggctgttgtttttgcaattgattttatttgaactcttttgtgaaacaactaagtgagtgcttctcaaacgacacggatgagacagtgcgtctcgtccggttggagtatgtgcaatgtatcagtcttttaaattgatcaagattggcacccggccaacagctttcaaacggccacccgggcctggctgatcccatcagccgcagattttccaaacatcaaacccattccacaacagcaatttcacaaggcagaaaacaaaactacgctaggaatcaccgtgggcacggctgttcgaatagttttaataacctctacagagggggtacactttacccacacgacattactaacccggatcatccagcccttgcagaatggccacgactagagaccttagggctttcatgacaaggcatttcgagagccgacacaggttcaccatatgccaacgagaggggtcccagaccaacaccagactaggtcctagaccatactgtgccaggatgccaaggggtcctccccgacaccaccctggcgaatccacatgtctcttagcatcatggctcccccgataagctagttactcagccaggggtgtcccattccacccatgtggtcgtacttgtcttatgatcggatgaaattccaaggaaacggtccttaagtgcaagagcgggaaaccgtacacccggtacgttccccggtccgcagttttggaaattcatttagttcgcaagcaccgactcaagtgtcgggttttccaagtcttttgtaaaacccaagtttcacccaagatgtttctcagattttaagtttgaaggcgaccgtcgatacccgtgcagagtgcacgattaccgaggcgcaactaggtgggtacaagggaacatggtatagcaattaacaaaggaaggatcaaatgcaacaaattaggtatgctcaccgatctgcctcgtagatggggcaaacatattaagtgcaatcctagcaatccataatattttgcaagaaatataacttagttaaaatataggctcaagatgttcaaaggtggcttgccttgctcgagatcttgagctttatcctcgaaatcctcgcactgcgggtcttcgggctccgaaactacacgcggctaaaataaagccttattattgacctctaagcgagccattaaatagatctcgagatttgaggaattttggaagttgaacggagtcaaacggacttacggttgggaagatattgaatttctaagattattggaattttttggtctaaaggaaaatgatttatttaaatcctttttgaaaaagaaaagaaaagaaaagaaggagggagggaaattagacttccctcgggcggctagggcgcggcccgagagaaaggggcggctcggccgagcttaatgggccggccggcccaagaaggcggcccagggcgcgcgcgcgggccgggaggagggagagagtcggtgggccgggtccatcccgcgtggtcccgggtgggacccgcttgtcggtgactcggctcaccgtgagcgaggtgcacgcgggttgtcatgcccagaaattcacgaaccagaatttctaagctgaatgtgtattaaacccctgtccaggaccagccagggtacaaaaacgacaattgttgacatacggatccacgtcttacaaaaatataaaagattacgaatgcagcgaaaaaggtaaaagcgagctaagcctgaagacttgactcctgcagcgggcgattccattccacaggcaacccttgacggcagcgacgaaaccaacctcttcaagacatctccaactgagaagaacttcaactctggtgtgggggaaaagagcaagactgagtactacccactgtactcagcaagtcataccggaagaggaggtatgatgcaggatataaccaaaggaggctacggggttcatttgcataaagcaggcatttaaaaccagtagttgaaaacagtaaaaatagttatagtaattaagcaatattaaccagtcactgtccaacgctacgccacgttgcaacaggcctaaccaaccacctgaactacaccagttcattaagctaaactaggggtgagactaatcacggtgaatctggtcgaccgcccataaccgcgggcacggctattcgaatagttttactctgatcagaggagtacaactgtacccacaagacacagccccacgacacgttcccgtgcgccgacatgccaccacgacataccggaaagaggccgtgacaggacccttcgcataaccctctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcaccatgggcacgactagcaaaaccatgcacccacagcccaccatgtagtgtactttaattaaccaacaccattgcggtggcactaatccaaagctattaccaataatcaaagtctatgctttagtgtgatccccttttgtgcattagttgaactaagcatggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattgggtacaatatgatcaattgcaatgtatgacttgccttgctctcgcactgatggaaccacagcaacgtcttcgaaaaaccacgaatcgacgaaacgggcgaaatctacgcgacaaacaaagcacacaagcaaaacatgctataagactactgaaacaggaaacaaaaccatttttagtggattctatacatttttatgaatttactgagacttgaatggacttaatcggagctcggatgaattagttatgatttttagaagattatctatgtttttactaataaagaaaaagccttaatcaatttattgcgcaataattcatcccagggctgacgtcagcacaaggaggggtggcgccgacacgcgggacccgcgggttagtgactcaaggagagagaggggcggctggcaagcgggctccaccgagcggcggctcatggggaggaggagacgcccggtcggctcggctcggcctcaaaccggccgaccggttatggcgagggcggtggcgcgcatgcacggtcgccggcgacggcaaccggaggcgcgggaagcggcggcggatgacggcggcgcaaaggcggcggcacacagccgaagcggcggctcggcccggcacggcgctaggagggagaggaaggggaaaagagggggaggggcgcctcaccgcgagttggccggcgtggggggaagacgacggcgaacggcgacggcgagcgaccggggaacagcgacgataggcggacgagctccgagacctcctagggaacaagatgggagggattagagggagaggggtagttaacggcgagcggattcgccggtcgaaggcggcagccatgggggtactcatcggcgcgcgaggagaagcaagctccggcgacgggattgaccggggaaacggccggacgggtgggcacacaggcttaggagctcggcggtgtcgacggtctggtacggccacggctctagcggtggcggagtgcggccggagcttggcggcaagcggcggatggcgggatgagaggcgcgggagcgatggagagctcgggagggctcggccgagaaaggaaaaagagagaggaaggtgtgggcgtgcttaaataggaggggggggcggcgagtcgtggccgggaacgacgcaatttcgccggagtagtggaggaggtggaggaggagagagagagagaggcgggattcaaatttgaatcccggccatctcgcaggcgcgggggtgagcgggagtggggcgtgggcgcggggagggcggggcatgcgggagagtgggcgacgtggcccggggcggcagggagtgcggggcggttgggaggagggaggccgcccctccggctagaggttggggaaggtgctgacaggtgggccccacctgtcagcgcccgagggagaatgggggaggcgacctggacttcgggagggggcgggagagatgggccggcggcccaaaggaggaaaagaggggaaaaaggaaagataaaaaggaaaaaggattttcccagggatttaatattgcactttgcttattttaattggttaaaattatttccaaggctctgaaaattccactaaaaatcctgttagcatattttgacatgtagaatccaagaaaaattccacatgccgattccgattattatttgcattgatttaaaagggtttactcttgctttgcaccggtattttcttagggtcatttataaattaaatttaggcttgggaggagaacttcggggtgtgacacgggtcgtgctatggtttggggagggaggcgcggcgcatgcgcgcagttcgcggaggacgcggtgcggcgagcccacgcgcagcctcacggctcaccgcggaccatgcgcacggggggggggggggaacggagggagcggctggccgggtcagccgatccggtcgcggccgaggtggcgctgacgtggcgcttacgtggctgccacgtgggccggcgggaggtagacgacgacgtcggccggaacggacggcggacgacggcggcgagcggcggagcgaaccatggcgatacaggcgaaggcgagcacaccgggatgttgcacaggacgaggggagacgagccaacggctcggattcgccggagggagctcgacggcgccggattgcggcggcggcaaccggcgacgaggtcacgaggggccgattcccggcggcgagagcatctacgcagctacgggaacccattgctagcgtcggattgggcggagctacgccgagcgaggccggcgacgagcgggcgctacggagcatgggcggcgacagcggcgagcacacggtgagcgacggcagcagtcggggcggcgccggctagctacggggaggctacacatgctactacccgagtctaaggggaggagatggaacgaggagggagaacggagggatgcactaccgtgtgggacggggcgcagtgacaagaggccgacagcacgggagtgatctctccggccttgggccggggaagaggaagaaggcgagcgcccggagtccccttccgcgtccacgaacgcatcggctctcccggtgtttggcgatgaacgtcggaggcaagacagaggggcggcaatggcgcggtggcggcgagcgaaacgggaggaggaatcgatgggagggcgccttggtttataggacgacgatgtcggtttggaaaccgaccttgggcggtcaaggcgcgagctggcgctcggcgctcgcggccaaaacggcgacagaggcggatgacgccggcgggaaggggaaaaggaaaaaggaagggagaaagggagcttgctccttgccactttgggaaaaagaggagggagcgggggcgacgcggcagagggaggaggagctctgcctccgtcccttggaggctagcgcgtggagtggcgggggccgggtcgtgacgacgtctatgacggcgggggtggtgtggagcggagtggcgacacgggcggcaggcgcgggcagacgcggtagataatgacggcggcagcgaccaggcggttggccaccaaggcgcgcgcgcgcgggaagcaacgggaggcgcggcgattttggcggcgtcggcgggaagcggcagcgagggcggagggcgcttggctcagcgcggctcacttgcacgcgtgagcagcgcacgggcagagcgggggagagggagagagagagagagagatgggagggagggggagatgggccgagagggattcggcccatcgagggaggccaaatagacttttgcggagggatttgatttgggaagaatttggattcgggattgaactcgacaatagatcggggatttgagatctgagatggcacggacactagacaacaagcaaagaaacggatttcgcaaatagggttttcaagagatagttttcccgctaggcgccacgacggaacgggcgctacatctcagtgtgttgccgctggatcatcgtcgtcgtctctccctctccgatcgttttggtccagtgagacgtctatccgtgtctctttggtttagatttcaacccatcggccacgcttgccaagccgctttgtcgcagccgcagccgtgcctgttgcgttgttcctcgccgcgctgctgctctagcccgtgcaccgtcgctaccggttgtgtcgtcgtttctgtgccgtcgccctaaccctagccgcgtgtctctgtcgagccgccgccgccgcctagccgagccaagtcaccctagtgccgccgtgtcgcagcagtgtgccgctttaacctagccgccgctttagccgttgctcggtagccaagttgtctagccgtaggtgcatccctaggtttctaccggcctatcgtttgcagtaccggggctttaccgtgaatcgtttgagcatgttgatcctatatttaaattctctatttatttcaactatgcatttatttttggaatgtcaccgggtggtgtgaaccaattccttttgttatgaccactttgcattgcttactctattctttgataccttaggtaacaatttgactagtgggacttatatattggttcagctagatattagatataattgcttagccatgcttacaaacattagcacatgattgggataactaatgtttcactatcacttaatgatggatatttaatgatagctcacgatggtttatcgtgattggttaattaattaatgtgccaactaaaacttgataatggtgggttgtgagcacatggttttgatggtagtgctcatgacaattaaggaccggttcacgattttcggttgtgaaacattaaccgtgccaaccacaagccagcatgggcaacagctttaccttttgcatagcatgattcattgcggggcaccagactgagaagtggcggagataagcccacaggggtcgttggggagtccatgccttgttttataagggggtgattatgatccaggaatggtgcgctatggtggattgtgttgtgcgaggggtactgtcacagctcctttccgaggtaccatggtggtatcgaggcgcatggtgacatgttgtggcactgtgtcttgtgggtacagtggtacacctctggccagagtaaaactattcgaatagccgtgcccacggttatgggcgggtctaacaatgtctttcgtgattagtctcacacttctcaccataataaatgatgctataactggtaataacctgcttagctcctggtttggaatgctaaattcctggtttggagatagatctgtacagccgggtatggttgttcaggatggttgggcctgtgcagcatg

SEQ ID NO: 60492 - DNA, 21835 bp, Oryza sativa
  unsure (1)..(21835): unsure at all n locations
gtggtgattcgctaaaaatactatgaccattagttcaatatttcatgagagaaaatttagaatgtgtgcctttaccccaaaccacgttacatgcacttatattttcatcccaaattgcaaagatgaaatcatttcaaggatgattcatagaatgaaaatatcaaaaaaagaataaataaaatggacatgaaacaaattgaatattaatagatgttgctggatttaaaacccattcaaaatagaaaaattcaaacattttacgaagactgttagaatgaaaaaaatataaaaaaataaatacaataaaaatgatattattggatttctttgttggttgtaagatactccctccatttcgaaatataggacacaatacttttcaaagttgtttcataatataagacgtgcatgcatgcatgcaattaattagcatctcatctcccctaaattattactttttaaaaacttacacttacaagatctttaattatgccggttgcatgtattttattagttggggtgattaacaagaaagatgataataattaattgtttcttggtcattgggttaaggatgattatgcgttatattttgcaatggtgggagtatccttctggggagttaaaattcctaaattttctcataggaaccacctccattgttttgatccattttttctcgtcaattcaaaaccgcatgatctcaactaaattttattttagaacttatatgttcaatgttcaaagcacacaaataagtttaattttttattagaatataacaaaagttattttactaaaaagtcacccgcacataaatattcataataaaattttactcacatttatataagaaggtgcccgcatatctgcgcgggctacattactagttggcaaaaatgatagttcagaggtactccaaaacataggagtattgtgcttcacttaagtaagaagaagagaaactgttcatcaaccaaagtgatccaaattaaaggacccctccgaaaacaaaaaaaaacaaaaagaatcatgaaacgtgacacgcgaccgaaacaccccttaggattaacaggctgtccaaggggagcagcccagaccgaaattcacgaagtgtcttagctacagcaatacaccaaagagaactctttctagccaccgtatgcaaaacagcctgcttaggcaggcacaattgaagaaatgatcattgtggtactttcatatttcccgagccactaaaataattgtttcaatccagataggggtgatgtcctgaacttcacgacatacgatcacaaatcgataactagcctcaatgagatcaagataagcttcaagcaatcaaaggtaacaatgcaacctgacaaccgtagttgccacttcttcaatctcatggggaaatcagaaaagcaaggcggtagagatctctctttgaatttgttagcacacagctaaacataagagttcatattctcattgtcaaaattcttctaatttttatagcatgaggggtattgtaacacccaggtaaccacgtacctagagtgccacaccaaaaaacactcaaaccactaacttccaaaattattagaaatttcggcaaagtctcccctataaatacggacatccacgacagacaattataagttaaactaataacaatattattcccagaattcgatccattcttataattcatggggaagaaactattataaatctaaaagattattacaagaccaaactaggatataatttaagtgtcattatagacctaagctatatagtttgatagtgtgcaagtagatgtgtatataagggtgctacttcccgcccatgcatgtcggtctcaatgcatacgtaaaactaaataaaatacaagagtgagtataaaaatactcagcaagtacaatgtggaactagaaaacacatatacacatcattgacaataaagtatgaacagaaggctttctttgtttgataggaaacacatttccaaacaccaagtcaaagaagatagtagttcccatctcgggcaggcatgaattgaaatagtaatttccatcccagacaatagtgaatacatcctagcatttaccggcatagccgagtaagcgtgatcagcgcttacccataggaacttgaataaagaaccaaattgcactcccatgactacgcatggtacttgaataattgaaaccggaatcaaagaaccaaattgaaacacatccatggcaagcaaggaacttaaattatttaagcagaaccagaatccagaatattaaaacaagaataacatcgtacacataagatcaacttgaaatctaaatggcgtgaacaataatatgaacataagcagttacttatcacgttgaaatatatcagaaataaatagatagagtaaacaatccatgaatcacacaattagttcgtcatgcacttgcctccaacgaaggattggtatcatgcatgatctgatggaccaccacctaatcacaaacaaaaccttagcaaacacattcaaacatgcatataaaacaatgaaaaaggtgaacctactgccccatcccatcaaaactcaataacaaggaacgccgcttggactatacacaagactgttgcttcaaacctttatatcttggaatgtgaaaaggctatgactgaaaatgtgtacattttgaaaatctacagaacaatacctacaacttttatgtagaaagcatatttttattctgccatttaaatagtctaatttgtgcttgaaagcaggctttagaatctgtccagaatttcagactgtccacactaaaacaatcataactggagttctactcgcccaatcagggtgtactttacaatatggaaagctaagaaaacctctacaactttgtctataggcggcctagctgattccactgtgtaacccctccaaaaacagttcaatctactactatccagattatgacacaaaaacaatagtcatactaaaaaaattatatctcctaaaccacttgagataaaatcgcgccctttggtcagaagatatatccaaacattatctacaacttcctagttatatacttagaaaataacatttagagccccgaaacatcaaaacactgaagcactgcaaatctgcccgcatgcataactgcaacgaaccgaaccgcaactactcaaactccttctctagccttccctaaccacgaattaatgcactaaagtcatgctagaacaactgatacaacaaggggataagcctcacctagggtttctttagagaacttctgaggagacaataggggagactccggtctaactcctccttgtactcctctcctcctcctcgttccatttttctacttcgcttcttaatccaagctatgaagatggagatctagagagagcaatttgctgtagatgggagagatgcgaacacaggaggaggggaggaaggaggcaccagccagggagagggatggcggcactatgaggggaggtgggattcggttcccctctctttaggtttttggggagaactagtgggctgggtttatggaccttctcatgttggcccacttctaaagatatttttcttttatttatttctgttaacatctttattttaacaagtcaacccaaactaaaaaaacctaaatatcttttaatatacggggtattacaggtatttatactaggaacatccgtccaaattagatgtgaaatggctgttgagctttggagtaaattggcaagatgaaaggtctccaaaaatcattcgtgagctagtccgctatgccttttcagcttccgtgcaatctccgctgcaataaacattactctgtctttcgaagttgaaacgacgagatgtttaataagtttgaaactagacttgataagatttccaaccatgtttatcatgcatggtaaaacgagactggcttgatcgcacatctcttggaagttgaaccaattgtgtgtaattggtctattcgttagtgtgaaccatctcgacttgagcaatgaccgcttcattttctatgcaattcatgccatactttatatagtcattcgttgttgtagcagtgaaatgatcgtcggacataaaccttaaaagtagaaatgtacactaaagttaatttcagcaagaaacgagttaaccttttgtcttattttattgaatgatgttcggcactcaatccttggctggcacaatctcatggagatgaagtcacaacatggcttagcgtagttggtgcttgatatgctggcactagtccaattgatggtttcacgtttagatgatagcaagtgtaatgcattgttactttgccttggtgtagtggtggtattggtagagtaaacaatgtcatgacccaaggtcatggacaagattggggatagacggggaaaacacccttttcccgcctatcctgagaaatgagcctgaatacaaaatgaacacacactttgactgacaagatttttgtattccaatatgtcatgtctgctacaggctttttgtctgctttatatagttcatagctatacatataagattacaattgtgcccctcattgggcccatgtaagattacaattatgcccctgccatacgagcaatcctgagggcattttagtacatttcaggggtcattatagtcttttggtgccagttagaaggagtggttgagtggccccccgggaatattctcttggcatctttattgctcaaattgccttcttcatgaccaagagctttttccaccaccaagggtcttttccacgaccaagagtcttttccacggaaagtagtcttttccatctcgaccatcctttccggcttacctggtggctgacctgtcattaactcaagaaatactcaaaaatggatgatttagcttaatggaaggaacttgctcaaatagtattttccgactcgaatggtgttttccaactcgaacgacattttaccgtttccctgtttgaataaccctttaccactcggatacttagaataaaatctcaatcttacccagtcttttcctctacaatgttttgggccgaatatggaggggcggtggtgaccccctgctacaacaagcccctcacgggtaagggcaatgtgtgttttcggccgaaaccgtgttcgaatcaaaagctgggggagaaccgccgtcctcctattcggtcgaaaaacactaggatagaaaattttgaagttcgaaggtggttactcttgtcagtcattatgcatttatttgtttattattatatatttttatttattatatgtatatatcttttgtatataagtatgcacatttattatgatgcttgtatgtgtgccacatgtcaactttgtactggatgattggaaagagaagtgccgcttcggggttcgcgcccactcatggccacgaccccccaccccctagacctatataaggtctgtgagggtcgctttctaccggctactgttctgtcctccaccaactcgaatccttgtctttgctcgaaaacacccttttcgctcgaagacacccttttctctcgactactttcttttctccgtgatggggaaagataagcagaaaacaaccaagaagggaaagtcaaaaaaggtcgaaaaatccgagaaaagtggtattgtcttgggtggccatcaaagacaagcatttaaatcaacttgttcaaaatggagttatttcgaactggaaatctctggttcgacctgtcggcgaatcggatccttctcctaaacctttagatttccatgcagctcctttttgatcgatgttttgaagattttcaaacacgagttcccacaactcacccctaacgcgcttgtgcacgtgggtatattcgaatggatgattcgcagctgtggcgggaaccctcatgccgaggattttgcatatttccacagcatccgctgttataacaagcaaaactccaagtttggttgcctcaacttctcctctcattcgaagcatggatgtccttggccaaccatgcccggtattcgaactaaatgggggaacaaatggtagtctacgtggttttatcatcagatccctgccgacctgcttactgacaaagagtgtccccttcactttctcttgcaaaaccactaaggttgtagccgaaccatcagcaggcctaacggcagattttcttgctattcattctcgaggtgaagaacttgtttcgaaatttagtgctcgaggcttggttgaagaatttgtttgtcttggtatccaaccgctcacggccggatggaatatttctctagggcagatgctgagcgaagctacttcgactttgcctccctttgaggttgatttgaacagtaagttttcttcttctttctttttttttgttaacacatttatgtcatttattaagttcgaacaattttgttcgagtactttgtacttatgtatgccttttgttttctatagttgttatccctgcaaacattgtccgcccctgccaaacatatcttggtccttataccaaagatgagcacgcgaagtaccaaaccttgcaaaatggttcaaggatgaacagagtgatgtctgcccttggactcgagatccctgctcgagttcatcctgagattgttcttgactcgggcaagaaaaagaagaaaaagaagaaggctacgaggaaatcgtcctctgatgaagacgatgttgaagttgaagaaaacaaagaaaatacagataatgaaggtaatgatgggaacgaagagctcgggagaatgaagaaaatgaggggaatgaatctggcgaagacagctcgagcagtgatggtgactcaagtgacagctcgagcagtttttgatccatgttttgaagattttcaaactcgagtgacagtctgtcggatgttccaattggtgttggtcaacatggtttaggcattggagctggtgtcccccaagatggtgtcgctcaagattttgcttcattgaatgaatggatcacgctatctgccttaagcaccaagggactaccgtaaaaatttttttcactttttcactgaccctctcttttatctacaattttgccctttttttttctttttatttgtatctaacttgaaatctaacttgttcctctctttgtttcattntgtctcagtttccaacaagcttaaaatatattattgagaagcacagtaccatgtggcaggatgagtttgtttcagcatatgacaacttcaagagggacatgattgatttgcatgcaaaaagaacatgtgatatgatttctgacataagcaaggtgctagctgatagcaacactgcagtgtgcatttccgaggctgtttcaaacccaccaagcactgaggggggcagctgaggccgtttcaaaaccatcaaacactgagggggcagctgaggctacagatgttgatggaccaagcaaggaagcttcaggtggttatgtgccaagcagcccagctgttgatgattatattttggcttaccgctctgatatctcaaatctagattatgcatgtgatgcaccgtcattcagcctcttcaatgaatctgatcctgaattcattagaactcaggacttggctgctgagatgctctccttgcgtgttttaaatgttcctcagtcggcaatggatgcaaggacaccttctccatcacctcagtcacctgtttctgcaaggatacccactgcaaagacaccttctccagcccccccttcacccactgcaacaaaaacatgaacttcagtagtactctctctagcagcagtaagggaaacatccccagctacatcttcaccgccacgtgctaagggctcgccacctctaggtaaaatcaccacttttttgttccttctctccctctcacatttttttcggtgtggttaaagtaactatgaacaacactcctccccctccctaatgttttttcctctatagtaggtactggtagtagtggtccaagcatgcatgagaagaaaaataggaagaaaatggcgcggaaaggtgattgtgatgtagagacgaagaagttgaagatttgtcattgattatgtgccaaacaggtcaaggaaggtagatgccaaagagttgtaagtgttttcacacttttctttttgcgcaaaatatgtttcaacctttttattattaatatgtttcagtgtagtttcccctgttgtttcatcagtcactatgacatatctcactaaacgcaacacatttgtttcagaacagctttatctgaattttttcccaaccttttttttttggaaaaacaggccaactccattcttaaggattggaggattccatgtctcacttgagtatttccgtgaagcaatgaaacctagaggagagttgaacaacgaagttacgtcgtgttggattgagatgttcaatgcaaactgcagggaagattctaagatgaaatcaagcataaaaaattttgttttcccccctggcttgacggtaacatgttttaaccaccccctcccttttattacatctgttttgtttttgttttttttgcttttaattcacttgttccctttttttcctaggataaattgatttgcaattccgagaagtttgtgtctgaaagctgtgtaaaatgggtgaaatcaatcaacaaggagcaaaaacttcctaaactagatctggtactagttctcccatccctctgatttttttcatgttttggttagtctgctgatatatttcacaacataccaatacagtgtttcagctatttttaactctatgttccaatgatcatttatttgtttcaatagttagtttcaccatattctaacatattgtttcatccataactgttccttgttccagttctcatttaacataagttactttttttttgcctcccaccccatcaagttgttcttcccaattgtacgtgacaagcattgggtgctgacttgcatcaaccttttgtgggaacaaataaattactttgattcaatcaagaggggtgatatttctcagtggttcatactgtctcagaacctggtaagatgttcacgggaacaccatgtgttccattataatttttttattgtttcattgagttttaagttcttttttttcccaatgccgatgtgccgtgcaggtcacaaatttcaccaaggttgcagtggatgctaaaattccaatcaaagatatatcaaagtttcaaacttgctctcctccacagtatccagtacaaagcaatttgtatgttttatttacaaatttttgtttcttttttctttttttttgtgcacaagtgtgtcattttaatttatcacttgcttttccatgcactaggtttgattgcggtttcttcagcttgagatacattgagaattgggatgggaaaaacctgcaatcattcaatgaaggggacatgcctaactaccaaaaattcatgacacacatgatggtttcttcgcatctggctaaagttgaccatgatcaacttcaagcaaattagtgttgggggcagttgtgtcactgaagttgtgctttttctgttcttttgttaggattgaatttgtgcactgaagtatgctgtgtttttctgttttttgtttgtgcactgatgttacgctatcaagttgaactactactctttatataatgttgcatctactgtgagatatttgtttcagcctgttctgaatgattgttcatattcaaatgttctttttcagagtaaaacaatgtttcaccttctagtacttatatgttcagcttgttatcaatgattgtttcatagttctagatgttctgtttcataagaagcaatgtttcacttactgttacataattgttatagcctgttcttaatgttgtttgacagctccacatgttttgttccataaaagcaaatgtttcacctactgttatacagttgtctcaccctacacttcatgaatgtttcacaagctctacatattctttttccactgtaatcagtagtgcagagatgtaattttcttttttggcattcccttcgttccactaaacaatcattcacataaatcataagaaagactcatttcacataatcatccaacattctacccatatgtgaattaaaagaaaatatgtctattgcatctcacaacataatgtgtttcacctaacacaagatagtttcatattgtaatatggcaattaccactatattttctaaaagtatagtgcatcgcatctaaatctacagctcctggaactcttttctcagattgtcaactccgtctcttgcaccattttttggtttagtagagcgtctcgcatgttcgctatcttgagatactggcatattgaaacattgtgtgtctcatcaaagcaatatgagcatgagctcttcttttttgtcctcctcttcttgctgctttcagttatttgttcccctattggcttcatcctgtgagttttttctgctggcctccctgttcttttctttgttggtggattcttagctgaacttgatggggcttgttgactaggcaaaataccttgctgatgttgtgtctcaacagtgtgtggtgttgcaaccattgtttgtaggttctgaatcccagccgaaacaatcaagtatttttcctcattaatacatgcatctgaagcaaggcttgtcgtcgccctgcataacgcgttgaaccttagcttgcttgttgccaggactccaattgatggtgctggaccattgtactcatcacatttttgcaatgtcgcttgctctgaccaccgtttcagcaagtacttactcggtatctcatggatgttaaggacagccatcaccctcaagatgtgtgagcaaagaagtccatctctttcaaatttgtggcacgagcaggagtatgttgagtgtgttgcatcaaatgtgaccatatattttttacctgttctttctctgtcacttggcataacattatacatgatgttgggtacttcttgtgttttttctgcatccagccctgttgcttcatatatttcatactggaatttgtctgcaaacatacttgtagtgtaaaactgcgatgcttgtttctcaatcagtgacctgcataattcaatgtttcaacccattaatgtcaattgttccacacttgcacagtttatgttgcacagtatagatattatttgtttcatcaatttttcgaattacaaacagaaagcacatctttttcaaattgtttcaagacagcagatcacattaccttgaatacattctaggttctgttgtctctgctctgtagccctccctgtcctctctgtcaagccttgtctcaattatgtgctcatattttttgacaaagatccacaccgaatcttgcgggtgtacaaataatttgaatagctgtaacagccctaaaatttgacaactttttaaaaccgatttagtttgctttgattctctaaaaatataaccgtcgagttagacatttatttaaaattttattttccaagtttgtttccggtgtttcttttctcgtttaattttttgtcacaaagtgcatatcatccctcaaacaattcctttgaatccgatttaattctatcccgaatgtcggactgtctaaattccacaccaattcaaatcctatctattttaatcttccccacatttttcttttctctatttccaccctaattttccttttctatatttttttcctttctctgtttttcttccccctccttccctttctctgttttttctctttcttcttcctctctctgtttttccttttctttctttctctacttggctagaccaacccaggccgagccagcgcccgtgttgccttgcgccgatccctcaccatgctcgcgccaagctcgtgccgacccgcgcacgccacacgcccgcacgtgcgcacacgaggacgaacgacgaacgaatgcctggacgacacctccagcttcccgcttccgtaactccttcgttcctcaactagaaggctgaagaatggaggcgaaagaaccgcaatttcgacctctttcaccttctcaagtctgcccctactccaactaactcaatcgtcgtcagcggaggaaaattcccagaaaccctaataccggcaccattgattgaacttcaaaattcgtcgcatacatcgtcaatcctctgaaatcgaaggtaaaatcggattctccatgccgagtactcccattcccctctctttacccatccaatccatcgctggaacgttgccggcaccgcctcccggcgtcgctgctctgttcggccgccgccagccgcatggcgcgccgccgctccagggcgccctagctttggccgtcgccaccctgggactcctctcgcctcagtgaacctcatcaagccaccgccctccccggagttcgccggagtcgccgccgccatggccgcctccacctcctattactgcctgccgccgccagcctcgccaccggtgcttctctcgctgccgaccacaaaaacggaatcgcctcgacctctagatcacaaaaccggtgcccccttaccgaaaaccggcctcctcggctgccagcaatgtgggattccggccagttcctgtgcagagaacgagaagaacagaaaatctgattttcctgttgaaaaataaatcagaaaataccctttttcttttcctatcaagttgaccatccgtttgacctcaaaatcgaaattcaagacctattccaaactcctagaattattccgaatccatccgtgtcagttttgttgcaatccgagcacccgttgtagcaaccctaattttagccatagggttcgccgttcaccgaaattccaaaaatccctaaaattatttccttaaatcctttccacccattgttgcactttgtgatactatttgttttggttatctttgtttttctattatttattgtagtgatgattgttgcgtaaatagaaaacgctgacgttggttcggtagtcgaagcgagtgaaatctccgcgccaggaggagacggtttgtacgactacatcgaacccgaggttgcaagacatgcaccctcctttgaacaatttaatcctagtagatagggagctattttagtagtgtacttgtcctttggagtacgatagattgagcgaattcttttaaattaattatattgctattattgcattatattttatgttgttatggacgccttaatgagccttagagtctaaccaacttaggataaaatttgagaaacatttaaacaaactgttaattatttaacatgctatctatttaatatggatattattactgcatatgaaaacatgcttatggaactatttatggctatatgctaagaactgttgacaccgcttgtgagcgggtggtacacatgatagagttcatgtgtttggtttcatggacctgtttatggtcgtgatggatatgtggatatatttatggttatttcttatttaaaattgatataataatcaacccccttgtgtcaataagaatgacatagtttcgcccatccacacgatcgatttgtcaaacctagccgtatattgctccaattgattgaacttctacaggcctttcggtgtactggccattagctttcaagtgtgtgaagcaaagtgacatggttcatgtttatatgatttatatatgtgggctcgatgggccccgagagttcaaaactaccctatgggtccacgaagttctgggctgcccatcgagtaacgaacaatggtaagtggatgcggaggtaggttggcacacacctcggaccggatcactccgagcaacatcccgagcatcctttaacttactaggcagaagggagagatatatgtagcaatattacaccttgttacttttcagcccggccagctgtgggtatcatgtgggtcaagctgcgcagacgctacagagtcgttgagtattcaaatatgccgtgctcccggttaatggagatgtgtctatgggtgattccagattatgggcacaagttaaactaaatggctattaattaatatagttaacttatttatattactttatgttctattcaagttatttataagtaacatttatacttttatgctcattattattgtttaaattaaatgttcaatagtgttgtttatatcaaatgtttattaagttaggctctatgaaataactgttaaggttagggtttaaaccttccagctctcgatactgcaagttttatattgcaattattgtatttattatcataagcatgtcttgctgagtaccttttgtactcataaatgggatcagatcatgaggaggaagatgcttgtggagaacctgttgatctgttagagtgggacagctatggtttctaggtcatcatatgcttaggcagttcctgtggtgaagtctagcagtttatttgtttgtagaaataaagctttataggccatatatgtaatggtttgtatttatgtgtgttgtgaactaagtgacttaagtattgtataatcgaaggttatgcttttatatcatttcatgcgtaactgaacatcctgggcagttacttattcgtggggcaccatgactttatcgggtgtccccacaatagcccttttagaccttccgatctccctgtcatccaagtaaaagggaaaaaacttgtgttaaagtataccggagcccacatttcttttgcttcccacaagttattcaaagtttggtttccatggaggtcatattcatctagcatttttttcaaatatgatagaagctgatctattgtttcaatcatatatgcatctacacagagcttcaaggaagcctttctttgaagtatacacgggtaggagttgctgatctgcttttgttgtcacgtgccaaaagcaacatctatgaattgtaccggggaacacctttttaatcattgctctcattgctttatctcggtctatcatcactgaacctgacatctgtccattcattgctcgcatccatgtttcaaagacccatatgaatgtttcagttgtttcatcacaaatcaaagcatatccaagcaatattgtttgcaggtggttattaattccaacaatgggtgcaaatggcatgttgtaacggttagtcataaaggttgtgtcaaagaagacacagtctttatagctttgatacagttttcgtgttctgccatccacctgttaacaaccaaatttggtaacatctgtgtcaggaaagaaggttggatcaaagcaaagttagaggcagagatcaagttcggaaatagagcaggaatcggctggagtccagatcggctatgattagaatcggctaggtctgagtcgggctgagtaagccgatacagctgattccgacaatacgacttgtacgcgacatcgggttcaagttaatgtacttcaagatgattgccacgcacggatagagtcctgggaaggcaattgtatctattaattaggatatttttatgtaaattccttatagataaatgtgggcaaaagtctgtcgcaaagacttatggtatcttagagtttgttagagataatagtcgtgtccggtgtgggcatatcttgtaattctcgggtataaatagaccccgagccctatgtaattaacaacacacacgttcaatacaacttcagcgcatcgccactcttttgctttagttttgtttcgacaagttcttgctttcgggttgagctgcatcggtttcgatattcaacaagaggtaaaacttgttatgacggattgtgttctcaagattagtgtttccatctttatgatactctaatctcgtttatgtaattcgtcgagttatcatatatcttacataatcttgggcaatattgatatctaacctactatcggctaacatctgttagcagagggcaaccgattaggttagattttgacgttgatctagattatataagatatctaccaccctatgaaatttctagcggcttgattgtctagatatcgtttttcttttcatacttaatgttgtatcatttaagtttgatctatcaagtcgtgcttagaatatcgatctctagcctgccttctagttgccgattagaatagcatcggagtttcagccgatcttatctgatttaactacatttgttctatatgcttcattgacatgttaaactgtcctttatatcaagatattgctatatctaagcatgttaggcctttgtttgacatattatacttaccttaatatcctgatatagagtagtatcggagtattagccgatacacgctagatctatctgatcggctatgctataaacatatatagtcctgttattgatatatatttcaatctaagtgatttatactgtctcggcatggtgaccgatctatcccaatcacttggtttaagtatatatccatataaggagtatatatcgttaatgtccacagccgatcgagtagatttagttcttctttacttattcatgaccgccgatcgatacacaggtaacatcggctcaaagataaatgatatgtcatcggcatctagccaatcggctatcatttatagatttaaccacggtttctttgcttgtatttcttaatgattacaggatcaaatcaactggcacgctaacatacctgaaggcaagctttggacctgcactggagttaagcagatctcccaggccacgtgttttctgtcaacacgcttttggcacgcccggtgggacctgtaagaagtcagacgtcagttcttcctcatggccgagaaacaaccaccaccatctagcccaggttccgttaatggcaaggtgttgggattgactgacatcattgaagaaaacgtcatgccgattgatccagagaagttcacgcctgagcagaaggaagagtttgaagcaacgttgcagcatgcatgggatcagttcctgaactcattcatgcagacccgcaaggggacacttgtttagaagtataaaataaaagtggttcctgatagtcctgggaccggttcttctaaagatggagaagtgaaacaagctcctggcggctcagctcagccgagttctaaaggtgttaccgacggctctccgagcgatcaaggcgacaattctcaaggagttcatggcgttcaaggtgatggtgctcaggagccacaaggaggaaatcttaatcagaatagtgaagtagcacaagattttttcaataacttccaagatcgggttgattatgctgtgcatcatgctttgatcatcaggcaatagccgggttgatcatcagtccagggtattagtcaataccttgtcaaacatgatgaagacaatagccgatggttcgatagctgagcatcaggctgctggcccagttggtgtcttcccaaattatcgatctttgatcaccgatgtttagccatctgttcaagcagttccctctattgcacccacaactcagccgacggcgccagcgtcgagtcctttacctgctacactagctatgacgccgggacagccggtgaaccctcggttgttaacaagggaatagccacagcatggcgggcaggctgcgaatcggctaactcaagatcaagttgctgccatgtttctgccacctccacctgttgtcgatccagtacagcaacagccgattcagcaggcacccccaatccagccggttgtacaaccaatccaacaacaggtcgtacaaccagctcagcaaacaccaccaaggcagcagcctctgcaaccgattcagcatacaccaccaaggcagcagcccctgcagccgatccaacagactccgttgaggcagcagatcgttcagccgatttagcacccggggtcagtaaatgcatcggccgggttagcagtacctggtggtcagcctgtacagcagtttgtaaatcaggtcatcccagagcatttggttcaccatgcacagccggatggcacagtgatgcctcagatgattcctgagcacttggtgcgcaatatccagccaaatcttcataattaccaagggggtaacttgagttatcaatatcagcctccttccccgcaagcccaatatcagccagggggatcggctcagccccagttcgcatctcagtatggtcagtttgagcccatgcaacaacagccacaaggagcagctcagcaacgaccgtgggccgatgtgattgccgatgtaatgagagaacagtttgggcttaatccaaaagagactggaagcttgtatcgacagccttatcctgagtggtttgaaagagtccctcttcccaatcggtttaaagttccagatttctccaagttttcgggacaagacggcgtgtcgacttatgagcacatcagccgattccttgctcagtgtggtgaagcatcggctatagacgctctaaaagttaggttattccggttatctctgtctggatcagcttttacttggttttcctccttgccatatgggtcgatcaatagttgggccgatttggagaagcaattccacagctatttctacagtgaggtttatgagatgaagttgtccgacttgacggcgattaagtagtggcatgatgaacccgtgcacgagtatattcagaggttcagggagatgaggaacaaatgctttagcttgagtttgactgatgctcagttagccgatttggccttccagggtatgattcctcctatcagggagaaattctcgtccgaagactttgatagcttatcgcatctgatacagaaggtaaccttgcatgagcataggtcggggaagtcaggaaaagctttaagaaagttaatcatgtttgtccatacatgtatgggtcggatgacgaagaagatgattctgaaatagctgcagccgaatgggtgaggagcaagaaggtcataccatgccaatgggtaaaaagtcctggaaaagaggaaaagtatgactttgacattaccaaagctgacaagatctttgatttactactccaagaaaagcaaattcagcttcctgctggtcatacaatcccatcgcctgaggaattaggcaagaagggatattgcaaatggcattattctggatctcattctactaacgattgcaaggtttttagacagcaaattcaggttgccattgaggggggcaagattaggtttgatgattccaaaaagctgacgaaggtcgatagtaagctggtcaagcagccgatggggtccgtgcaaagggttttcaagtaaattcggctaagattatcaacaaatatcagagaaagtatgacaagcagcaggagaagcattacaaaaaatacgatgatggtttcgatcctcattggggttgcgagttctttagattctgctggaatgaagggatgaggttgctatctatcgaaaattgccctaggtgcagtgaaatcatcgagagctcgagccggccatatagtaggggcaatcggccgaggcaggcgagactttctgttcatcaaagactgggttcggtgaatcaggatcgtggccaagaagatgaggcaatcaggaagaatcaatggtgtccttctggtattttcacaaaaaatcagaagagaagggtccaaagattgaggaacagggagcgcctttaggaggttgaacaagaaatcaatcatcggctgcggaaacaaaaacaagacaggagtggcatgttaagaatctggttcctgtagctgatgatgctgcagccgatgaggcgaagaggttggcaaaaggaaagagtgttgtagcggcaccaattaacatggtctttacattgccagctgaattcgggatagatcaggccgatgtcgatgaagtggaagaggaatcggctaagttgnnnnnnnnnnnnnnnnnnnnnnnnnnngataaacacgaggggacagagaatcggcatcttaaaccattgtatataaacggctatgtcaatgggaagccgatgtctaagatgatggtcgatggtggggtcgcggtaaatttgatgccttatgctacgttcaggaagttgggtaggaacgccgaggatctcatcaagacaaatatggtgctcaaagactttggtggtaatccatcggaaaccaaaggtgttctgaatgtggagctaacagtcggcagtaagactattcctaccacgttttttgtcatcgatgggaagggttcgtacagcttgttgcttggaagggattgaattcacgccaattgttgcattccttcgactatgaatcaatgcttgattcaatggcaaggcgacaagatagagattgtgccagccgatagatcagttaatgttgccagtgccgatttagccctttgggagatggatggccttgattgtttatctggaaaagtctgggatggagattttttaaaagtgtccgattctgatatacagccaattgaagatggagaacccaagctattactttaagggcgtcgtggagggttcaaatgtctacgccaaagatacggtagatgatctcgatgacaagcaaggtcaaggtttcatgtcggccgatgagttggaagaaatagacataggtccaggtgatcggccaaggccgacatttattagcaagaatttgtctccagagtttagaaccaagctgatagagttcttaaaagagtttagagattgcttcgcttgggagtattatgagatgcctggactcagccgatcgattgtcgaacatcggctacctatcaagccaggggttagaccacgccagcaacctccgagaagatgtaaagccaatatgctcgaacctgttaaagctgagatcaaacgattgtatgatgctggttttattcgtccctgccgatatgctgaatgggtttctaggatagttccagttattaaaaagaatggcaaggtcagggtgtgcattgattttcgagatctgaataaagctacaccaaaggacgaatatccaatgccagtagccgatcaattggtcgatgctgcgtcggggaacaaaattttgagttttatggatgggaacgcaggatataatcagatctttatggctggggaggatatccataagacagcttttggatgccctggtgcaaccggcatgtttgaatgggtcgtcatgactttcggcttgaagagtgctggagcaacgtatcaaatggccatgaattatatatatcatgatttaatcggctggttggttgaagtttatattgacgatgtggttgtcaaatctaaagaagtggaggaccacatagccgatttaaggaaagttttcgagagaaccagaaaatatggcttgaatatgaatccgacaaaatctacttttggtgtgtcggctggccagtttttggaatatcttgttcatgaaagggggatctaggtaattcaaaggagcgttaatgcgaacaagaagattcagcccccggaaaataagacagagctaaaagagatgatcggcaagataaattttgttaaaaggtttatttctcatttgtttggaaggttggaaccttttacacctttattgaagttgaaagccgatcagcaatttacttggggggcagagcagcaaaaggctttggataatattaaggagtatctcagctctcctcctgttttgattcctccacagaaaggaataccgtttaggttatatttatcggctggtgagaagtcaatcggctcggttttgattcaagagttggaagggaaggaacaagttgtattttatcttagtcgacggctcttggatgctgagactcggtattcccctgtggaaaagttatgcttgtgcctgtatttttcgtgtataaggttgaggcattatctattatctaatgagtgcactcttatatgcaaagccgacgtagtcaggtatatgctatcggctccaat

SEQ ID NO: 60493 - DNA, 9734 bp, Oryza sativa
taaaactagggggacacatatatatcaaaatgcaatgaaaaattgttgatcaaaatgcaatgcaaaatttttgagcaaatttcaaagtcatattaatcggcacaaaggattgttaagacagtacagtattagaatgtcttagctgattacaaaagtttctaagtcctattacataaagattattgagataagtatcgctggatagccgatatggccttctgcctaatctgttctacttcctctatggcttgggcatcttgagcgtcggttctagggataactttcagagacttggtcagatcagcaacatgcttgatagccgatttgagtcttgctttctgttcttcaatagactttgggagatcagctaactttgtgtgctccatatccagctcagcattgcattcttcgagttgtgctaacaggtcaatcttgcgagcctcgagccgatcaatgttagacttgattgggccttcagatagttgatcaagcttggacttctcttcatgtacgagttgtcagttagcttggatagtggcctcaatgtccttgcgttctcgccgttcggccaatcttaacctggctttctccagtttgaattgatgttgctcaagataaacggctagagtaaggatgtcggctaactcatctgggattagagcctgaatctcatgtagccgagctctgattgagccacaatcaaccaccaagctatctagtgatgatgcttctagccaatccaagatacttcctagagttttcttcacatcatcagataaaggggctaaggctttgcttgtggtgtcttcttctccttcatcaaggtagtctccgatgtcgaaagagaaaagatcagctaagacctgcaacaatgatttagaagcagttagaggttaaacgggcatagccgatctgcgtgtctgttgtcaagggagaacttactgggatagcaggaacagctggttgaatttcttcctctatatggtgactccctacagctgatggagtctggtcactagatgattgatgttcagagggaggaggaggctaaaaagaaacaagtgttagaccgaatcgactggaaattaactaatgaaggttaaaactatcttactggtggagctggtttagatattgtcgcagtcgatttcttcttcaccgcagtcttctttttatgcaattataaaacttgggagtgatcggctataagacaaaataattatgaaagggattaaagaaagttgcctactcttgaaaagtggtccggagcagaaggtgttggaggggtttgcttgggcgaagtagatggtgttctttcagtatctcttacttcggctgcagcctgatcaacttcgtcttatattatctcttcatccagagcttgttcaatggaaggatctagggtaggcaggtcatcggctggcttggttttctttgtcttcttcttcttggttggggctgcgatgtttatagccgatgatctggtttttctctttttgccggcatcggctggttctctgatgagcccttgaagaagagctgaggtcttgggggcatcatagccaataaccggaggagatagcccacctctgttaggaattaaacctggggcatattggatatccctgccactgttgctttgatgaggaggagaagattctgttgtctgcaaattaaaaggaggattagttgaggttaatcggctaaacagctatttaaacgaaatcaagtagagttaaagacttacttgagggacaacatctggaaaaaggtctgtcatatacattgaagctggttggtgaaataaatgcagcttccattcgccccaccacctgtcaaagtttttgcttctgaacgttgccagttctatgttgtcaatactacccatagggggtccttggaggttgagcagccgatccatcatcaaggttgatgaaatttctcctcggcattggatcttgttggcaaagaataagtcgattgggagttggcccattccaagttgtctagctgagcttattggatgatagaattcataagaagattggatgtttcttccttgatgaatgccaacaggaaggatgcatgggctgattgcagctgagaaaatctccctagacaattggtatatttcgtggttgatgtcttcaaatctgaagtccaatgggtgctcaagttctgcagaatcttcataaagaaaccaaactcgagtatctttttgaaagctttcatagaagctatagaaccaatctttgagcagttcagccgatagttttaccccagcatcggttggtgtagaggcgtactctccatatgatgtgcatctccgatgagtgagttcctctccgtcgtcattaacgattggctctagtcttgggaactcagcctctgatacggatggccgattgacaaccttcataactattaggtttaaccaagtttgtagcagccaccagggtctacctgctccaactactgagccgacagctatcttggccgatgcattgttcaacatctggtatagatagccgaggaggattttacccaaggggaattgtatctttgtttctagggcttcagctagaaattgccagttggttgtgggaccgcaacttgatccatagaaaagaaattgttctagccacattaacaagaaagccacatgttcccgaggggtgaccgagccctggcccatatatgctgctacgtagcttgaccagcctcctatgcttttggtcttgaaatcatattggttttttgtgttcaaactcataggattggccgatgaggtgacatccaggcccatgatcatactgatatctatgagagttggagtcatcggccttgattaaacaaaaaggcattaatggtgtttgaccagaagtaagaagcagctaccatcaggggttcatctttggccgaatttgctatagtaaggtcaagtgcttggccgattccaatttcatcccaatgaaccctcttgctggctgatacacgtttgaaccatgtagtgcaactcttttttggtggaactttctctagagacggccaggacttgaaagtattcttccagtgacctagatctgggttggttaatctgaaggggatcctattgatttcaccaatgatgaactcggtggggtcaggattgccgactgggccgagaaagtagtggttttcatgcgactggctgggaatcgcaactaggttggagaggtgctacaaatccaaagcgatccagaggaagagagcaatatgagatatgagaaaaacgatccgctgctaaagaaggggagttagccgatgagaacttacatcggcatattctgctgatggcgcaccagatgggctggcggaagacgacattgctgcgggcggaaatctcatcgaaggagaggtcgcctggaaatcgcctttgtgccggaggagtcgccagaggagagagagaagaggtttcgcttgagcggtgaaaacggaagtcacggcgtgagatttctcgggggtaacggttagtatttaaagcgctggaataacggtcaaaagcgtcggagtgcgaaacttgctcggagtcggtatacggcaaatccggaacattatcaaatatcccggacttggggggcatgtattaacaaccaaatttggtaacatctgtgtcaggaaagaaggttggatcaaagtaaagttggaggcggagatcgagttcggaaacagagcagtaatcagctggagtccagatcggctacgattaggatcggctgggtctgagtcgggctgagtaagccgatacagccgattccgacaatacgacttgtacgcgacatcgggttcaagttaatgtacttcaagatgattgccacgcacggatagagtcctgggaaggcaattgtatctattaatttggatattttatgtaaattccttatagataaatgtgggcaaaagtctgccgcaaagacttatggtatcttagagtttgttagagataatagtcgtgtctggtgtgggcatgtcttgtaattccagggtataaatagaccccgagccctatgtaattaacaacacacacgttcaatgcaactttggtgcatcgctactcttttgctttagttttgtttcgacaagttcttgctttcgggttgagctgcatcggtttcgatcttcaacaagaggtaaaacttgttatgacggattgtgttctcaggattagtgcttccatctttatgatactctaatctcatttatgtaattcgtcgagttatcatatatcttacataatcttgggcaatattgatatctaacctactattggctaacatctgttagcagagggcaaccgattaggttagattttgacgttgatctagattaataagatatctaccactctatgaaacttctagcgggttgattgtctagatatcgttcttcttttcatacttaatgccgtatcagttgagtttgatctattaagtcgtgcttagaatatcgatctctagcctgccttctagttgccgattagaatagtatcggagtttcagccgatgttatctgatttaactatatttgttctatatgcttcattgacatgttaaatctgccctttatatcaagatattgctatatctaagcatgttaggcctttgtttgacatattatacttaccttaatatcctgatatagagtagtatcgaagtattagccgatacacactagatctatctgatcggctatgctataaacatatatagtcctgttattgatatatatttcgatctaagtgatttatactgtctcggcatggtgaccgatctatcccaatcacttggtttaagtatatatcaatataaggagtatatatcattaatgtccccagccgatcgagtagatttagttcttctttacttattcatgaccgttgatcgacacacaggtaacatcggctcaaagataaatgatatgtcatcggcatctagccgatcggctatcatttatagatttaaccacggtttctttgcttgtatttcttgttgattacatgatcaaatcaactggcacgctaacatacccgaaggcgagctttggacctgcactagagttaagcagatctcccaggccacgtgttttctgtcaacaccacccaaaacagtgccttcaacacgttgtcctcatcatatcttgcagcatagaagagggaggggttatctgcttgagttttttgaaaataatcaatagtcattgcaacatctttgagtgaaacttgttgtctcagttttgtcctcaaatttgagacatctttaacagtgaaagttagattcctcacaccaccgtgcaaatctcctaacaacgccaaaatctgcgatgttgcaatgtttcgatcatgcaaagtctttagaaattcatagtattcatttgagatgtgcctgtgagatctataatatctccttcttctaaggcgcttcaccatcggatgcgtgtgttctggttggaaagcaataactctccactttttgtccctaagccctacagccatatgagctttgcaatcatactttgcaacctttggttgtttcctcttcccttccaccaacaagggagccttctttttgtgaccttcaagcaggggttgattttccttattcccttcagaaatgaagctactgccaccagcactatcttttgtggtatttttttggcttacatgcataaacacactcaaattctctccttatcaacttcggttcatcattatgattgtctccattttcatatactttacatttcttcgatgccttttttcccctgatgatgccaggctgtttctagatgatgcaattcttgttccaaatcctaactttcatgcccaatgaattcggataatagcacatcaaggaagccaccagatgagcttggtgcttggacatcaatctgtaacattttgttttgtttcattaacttgtacagttatgtttcagcaagttaatgattattggtcaagtcaaattccagtccaaatttatacaaaagttaaaattaaaaataagacatgaatataaatgttgcatgagagaagacattgtttcacagatctgtgcttcaattttttattgaaactttctcaaaaaaaaagtgaaacaagctaaaccctagaaattcgttgcattatgaattggggttgttcccccatttgcactagatgaactcggcggaaaatccctctcaacttggtgtatcaaatgtgccatggcggcggtggcggcgtgtggtgtggaggcacgtcggcgtttttgccggcttcgccggcgtcgcgaggaggataggggcgtgggggatagggtcgccggcgccggagagaatcgccggtggcagcgcagcgccatgccgcgcagcgccagtcgcgccaccgaaatctcccctcgagctatcggtcaacgggcggacacattgaatgaaacagttaacgtgtacgggtgttgcaacggcgggagcgtcgggcgcgagttgtttctccaatcggacggctggcgcgcgcgtgctgtatcggacggtcgcgcgaggcgtccgatttttttgtctcgcgccgtacgtccaacgcgtagagctctcgagtgaactgcatgtcccacgaggctaccgtatgtccattatcgatcttgccagtttgctcgtttattaattgcctgccgacagctcaacagctatacatatgagaaaaatggagatgataataaattttatgtccgctcaagaaaacaaacggaacgtatctagctaattcaaggcccataatctcatgacaaatataaaaatgcagataatgatttccagaacaggagttaattaagcactatatatcggtatattttaccgacgagccagatctccttccgttcagtttcattagcatttgtgattgtgtggaaaaaaaaagtatacagtgattatattttctacatgtgactgtatttccctaaggatgttaggatattaagtgttatatgtaggtctcaagtagatgggatattatagtagggcaaaatgacaaattaggctttgggtttttgtagcaaagtaattaaaaaaatttaggtcatatacttattaattaactaggaacagaaggagaaataattagaccagatgagctagtttccctttgtgtgttatcatttgtgtttgtgtgtgtggttcgggttgtctcgttttaacaaatatcttttttattcgtgttctaacatgttcgattattatttgtatttcaaataagattttcttttgctacagatgtgaaaacaaacatgacatgcacattattcgtctgtatatatccgcgctgtttggtttcaccccggcccgtgctacagccactaaacaagaactctaattgtttagtttttcgagcatttgtcttgggttattttttacaggccagtacgttgttccctgtcagtttacacaccctttgtctttctctgatatatctaatactccatcaggtaaaaactattggtttctatctcgtgttcaaattttaatgttttatttgtaacataatgtattggccaaatctaaagaattatattattatcaaaatgttctattagtaatagaaatattctacgctattattttttgctgaaatatttgatgctcaaagcttcaaatgtttggtggttgggtaaaataatgatgcgttttaataatttcacatgactatatatatatcaggtcacattcatgggccaacttctcgctatgcttgtctttctatgcatatcgtcacgctagttgttgtaaacgaatgatgatatgtctgcaactgtccatgaatgttttcgattggtttgagcagattgtgtccacacatccaccaatcagtcatacacgcatatcttagcttgtatattactcactccgtttcacaatataatgtaagtcattctaacatttcccacatttatattgatgttaatgaatctagatatacattcatattgatgttaatgaatctagatatttagattcattaacatcaatatgaatgtggaaaatgctagaatgacttacattgcgaaacggaggaagtatatcatatttttgtaacctattagctttatattatatcatatttaagtaatacctataagcgattatttataattttcctcatcatttgaaaagaaggtaggtagacttattttctttagaaaacatgtcagctaaagtaaaagtaaggtgttttttttttgtctagttgcatttgtatggtcatagtttattaaagggtgaaatgggtgggacatgcagctccactaaatatatgggtttataaagcttaatatgattgatgtagtttgagaggtgatccatctacaaacaattcatgttgagtgggtgagaggctccatgcatgtagtctaacatgaatacgataacgattagatataattgtgcggtgattaatataattgtactatgttcctaaaaaaattcagtaaagaatttaacattattgattgtttctctgttagtttaatagctaaaaattggtgtcgtgtgcatgtgagtgtgataaggaggtggaggagattttatttttctatttctaaaaataatttaagtgaaagccaatcatgagatgttttattttccttagaatttctaagattcctcctttttttacatgtgatgcatggcgatttatggtttttcaaaacataaagatctgatagttaaaaataatggatacatcaatttaatttgattttttttaaaattctacgacatgatacgcggtgacttatgagcgctctggtggggtttaattgatttttttagtacaatgatttagtataaaataatacatattttcaattaatctttcgttgttatttagttaccatgcaaatgattgggtctacctttaaatgttatattttgaaaaatatagctaatgtgatcttgatttacttatttaattataaatagaagaatagctatgactgtttttatattatgttagttgaaaaaaaatataagatgagataattgaattggtgaaagaggatgggagagttgagcgggagggtcggaggtatacgtaaggcagcaggatgggaggatgattcttatctattttcataaatacaattaatcttagttccactaggaaataatttgggtattgtattttctaattagactacttaaattgtttcaaaattttctaatttaattgcacgttattaatcagaagatttaaaaaatctattggatcagtgaaaatttatatagtgatatagttaatttggatatttcaatttctaattttatcttaagtaatctaatgttgtgcaccagtaaaaatatagcaatatgatttagataatatagttgtttaaaatttgttatcataatttatttttccatataactaaaagaggaaagtcggagagaaagaaaataggtggggaggtacctactggatggaggggttgagacttgcaatcttttctttatcctttttctatctggataagtaaatctaatggtagaaaacaatgagtcaatcgtatattattgaaaatcaatggttgtatgttttgtttattctagatggcacgtgatggcgtactagcatttgtaggacgaaaattattatattgctctattagctctctatgaatcggaaaatgtttgaaattaaaggactgttggatctcttttgtttttggaat

SEQ ID NO: 60494 - DNA, 1395 bp, Oryza sativa
agaaactctacatactgagagatatgacaattgtcgtaataatatatggtaccccatgatatatcttaatgctaagaacagaatgatggcaccgaattttacactgaaaagatctcttgctacttgaggaccataaaagatctcttaataaatggtcagtgaattaaaggaagtttatctacaatactactccccgttgcactatttccagtgacattgttatacttagtgcctataagtacagtgcggagaaaaggagagagaaaacccaactagtggttgaaaacgttattgaggaaagtgcccaaaccatcattggtatgcatgactgttagtccatgattttcctctcagaccacagcaattgttccgctcttatcgtcacagctaagtgatgcctgcgcttcgctgttctcagaatatatttttcaacaatccagctagcagtaaacaagaaaaaaataatgaaacataagggttttattagtatttatcatgaaacaaataaatgatacccgtgctttaatgtgaaatatattcataggtatatgttaattatcataaaaatgatagatgtatttgttaaaataatgtgcaaattatgtgagaagtgatgattggatatgcttacatgatgatttgtagaattaaataaattgtagatgatgttgtatgcttacatgggtgatgatgtggcatgattgcatgttgagctttacaattagtgggctataaatttataaaaagtatagataccatcgatcaacataaggagtgaagacctttaattattggataaaatccttaattttttttgtaattgttcaggaaaagtatgtttgtttgtatttcgtattttctatttccgttgttcatagggaacgaaataccttgaaaatatgtgcttctgtaatattggatctagatatgtcctcctgtgatttgtgtaatacaaatcgaaatatgtccatattcctactagctagaggagggctaacttaataatcaactcttatagctagttaatatcaatgatggatgagttgttttgtagactgcgacctttgagtaatgcatcaatcatgcggctgatgttatttctgttttgattgggagattacaaaagacgataccactgtataacgaagcaattcaaacaactgatctagaccagtctgaatcagtactaacaacgttaattagtttagacgtgcaccgaacacatttcgtgtgtgcaatctaaatccgttcacagtatttttatatatttacatgggaaatttgccaaaaggaaaaaaacaccttataagttacttgcaatttaacattctatcccataaaattgtgttttgttgcaaacgtccacacagtactcacttttattaacaaacaact

SEQ ID NO: 60495 - DNA, 10582 bp, Oryza sativa
tcgcagtttacaggcggaatctgtaatttgttttgttattagtctacgtttaatacttcaagtgtgtgtccgtatatctgatgtgacacgctaaaattttacatctctgaatctaaacacagccttactctggcgatctatatatagttgcatacattgtaatattattgctgaattcatattcccatctgagccaaccatgcattggtgttttgcataatggaggtacccattgctgccatgacttttgcccacccagccaatgttatgactctggcttcaaggcagccaaagagtaaaaggtcccatatctcccctgctaccacggctcaccgtaatctacagactcgcctggctcaccaccaccatgcaacaccagcttcattgcctatggcaatctgcaacacagtagacaaagtgatcaataggttcattgacctgccggagcagcgaccaacggtggatccgcggcgtgtgctctctggcaacttcgctcctgttgatgagctgcccccgacaagctgccatgtcatccgcggctccatcccaagctgcctcgccggtggggtctacatccgcaatggtcccaacccacagcaccggcttccccagcgaacacaccacctcttcgatggtgatggcatgctccactcccttctcattccctcggcctcgtcaacactgttgtcggagcctgtgctttgttcacgctatgtgcacacgtacaagtatctcttggagcgtgagaccggaggaccggttttaccaaacttcttcgctggcttccatggagtggccggcttggctcgtgcagtggtcatgatcgcaagagtgcttgctggtcaaattaacctgaacaagggcttcgggctggccaacactagcatcactctttttgcagattgcctatatgcgctatgcgaatctgaccttccctactccatgcacatcaacccagccaacggagaagtcaccacacttggtcgatgtgactttggtggtgatctttcttttaggatgacagcacaccccaagaaggacccggtcaccatggagttgtttgcttttcgctacaatgtcttccaaccattcataacatacttctggttcgatcgagcaggcagcaaggtcgcagatgtgcccatcttgtccttgcagaaaccatcggtgatgcatgactttgcaataacagagagatatgcaatctttccagagtcacaactcatcgttaatcccatggacatggtcatgcgggggagctcgttggtaggattggaccgtaccatggtgccacggattggcgtgcttccaaggtacgccaaggatgagtcagacatgagatggtttgaggtgcctagatttaatatgttgcacacgacgaatggttgggaagaggctgatggagaggagattgtgctcgtggcacccaatatcctatctatcgaacacatgctaggaaacatggagctcatgcgagctcgtgtcgacatggtacgtatcaacctctgcaccggtgacgtgtcgtgcactgcactctcaccggagagccttgagttcggtgtcatccaccaaggttatgttggtcgcaaaaatcgctatggctactttggtgtaagtggtccgttgcccaagatcaaggggataagaaagcttgactttgatctcgtcggctctggtgattgcacggttggacgtcgtgactttggtctagggtgctttgctggggaaccattttttgttccagacaacatcgacgggtatggaaacgaggatagtggttatgtggtgtgctacacccatgaagaggacaccggagagagttggtttgtggtgatggatgcaaagtctccagagctagacattgttgcagaagtgcaacttcctagtcgtatcccctatggctttcatggtatttttgtcaaacaggccgaacttctcgcacaacaataagcatgtttgtgaaaaaccttacccactactctacgtataaagataatacttcataacttcataagcgagatctgctacaaatgtactttccagcatttgatttagaatggtcataagagaagtattatagtctggttgtcatttcacatctatctatatatcttttattatatactaaaagtccattaaacttcctacaaacgctcctaagccgccacgtgttctcctacaaacgctcctaagacgccaagtgccagtctaaaaatctaaccgttgatttttctttaaattggtgggtccaacacttttaaccattagatcaaataaaataaataaaatcctcctctcaacatcggtccccaccacctgtacgttcctcctctcatctccagttggcatattatatggcaccttaaataattctacagatatgtttcgctaaattatatcgatgatatccaatctatctattatatagtaaaagtctgtgaaaatttttataaatgcttctaagctgtcacatgatgcttatataaatgctcctataatgccacgtgacactccaataaattagcaaaaatctaagaaaaaaaacctagcctttgatttcactaaaattaataggcccatcactccaagccgttggatacttggattagattgatttttctatttcttacaaagaggcatcccctcttcccgtgcatacgcatgtacataactcctctccatttctcttttaaggaagtttttttttttttgctatcggatgaaattacatgttctatttgtgtcattattatgactaaaatcacaaattagaatttaatacacctcttaactataatttagcttgtaaaaattatgaaaagaaagtgacattattatattgtttcatgctatataataacttcactggcatgtaactaaaatagttctacaatgtcagaaaaatgtagtttacaccagtataattttacttgtagaaatatattccctaaagaaacatgtagatatatattaggcacatttcgacaacttgtatgccatatctatccattatatgctaaaagttaactaaaattcctacaaaatactctcaaaccaccatgcgggactcctacgaacacacctaagccaccatgtgacactaccactggtggacgaatggtctttcctcccaatttgtaaccccatgttctcctagttttgaaataaccgggacaaaaagaaatcaatttttagtcctggttgatgttactaaccgagactaaaaatgctagagccagaaacggcagttggcagtttttttaattgtttttttttcatattgatttcactaatcattacatcccctaatagagaaatccccaaatcatctccaaatcacagatcaaattcatcataaattctaaaaaaaattacatcacaaattttgaaaaaccatcacaaaaaaattagaacgatagtattaagtaaattaaaacaatatgaattcatccgattataacttaataaagataaaagaatactgaacctcgacaaagaactctactaaggcctggtttagttcccaaaaaattttattttggggtgtcacatcggatatatgaacacacgtttgaaatattaaacattgtctaataacaaaacaaattatagattccgctaggaaactgcgagacaaatttattaatcctaattaccatcattagcaaatgtttactttagtaccatattgtcaaatcatggcacaattaggcttaaaagatttgtctcgcaatttacacgcaaactgtgtaattggtttttttcccacatttaatcacataacatttaatcatcacaaatcctcaaaaaaagaaaatcaattccgaaggccgccgcgtgcgattccccagcccggccagccggccgccgccgccgccgacctcgacaggccgccgctgacccagagaggccgtggtaggaggaggaggcggggagggggaggagaggggaagtgggagaaaggggagaggagaaggggatcggaccgaggaggccgatcgagaaggagaacgcctgagattgagatgggatcgaagaggctggagagtggagatggtttctaatgagagaggaagtgtagatggtttttatcggtcttatcgataagaccgagagagaggactcgacatgcgctcgggaggatttttggtcccggttggtatgaagaaccagaactaagatctaagataattggggcctaactcgacccaataaattctttgaaccgagactaaaaatgatctttagtcccgattgataacatcaactaggactaaagatcaaaaagtttttaaccaggactaaaaataatctttagtcccggtttctattcgaattaggactattgtggttttaggcgaccgaccaaagatggtttctccagtagtgtacaataaatcatagaaattctaaagaaattacataatacacctaaccatcaattattttaacttaaacatggtgtacctattattttctactgctatcttaacaatataaaaatggaaaagacacacttcccaccccttcatacgtcatgtatgtgttcaagtgacatctccatacgtacattatctctgcttctctcccttcacatcctctctttttttcaatggacaacattacgtaaaaatacaataattagaaagattaatgattataattttaaaagttgtatcttatttttagtttgtttcaattgttgttttatttataactaataaataattcaagttccatgttatccatatttttattataaatttaaatacatcatttgaacattggcacctatgttttgcatggaaaccaaataggaatgagacatttcgaaaaggttgactatatgcattatgttatattaaatcagtctacttgataaaatttgattaaacgtcccatattgcacttgtaagtaaccatgtatcatgtctcaaaaaatagaaaacgatccaacttaactcaatggatttcattattttcatcaattagatcaatttttgaaagaaccataagtacacatgtcatctatttttagaaaaaaaaaaacataagacaacacgtgtcatgtcttacaagttataaaaacaataaaagaaatgctgagaaaaaagaaacatctctcatcggttttcactaaaatccttccacctcctcctccatctcacatgtagagaacactgccctcccattccttatttttgtaacatgtagaggacaactacaatttttttataagctatacatgtctgatttctatctaattattctctatttataattaaactaacaatgtaatatttatatatgcatatattttgctgtatagaattatagcacttgggcacagtccacccatgcactttgcaccacatctatataccttaaaattttgacaataaatattatgtcattatgaaaaattctacaaacatgcatagctaaattaaatcaatagtaccagaataaaattttcatatttaatttgccaaaagaaaaagaaataactcaacaacatagagtcgcaccatgctatgttttgaaacatgtatagctaaattaaaggtacacttcgtaaaaaaaataactaactgaaatatgaattgtctgagccactgcataaaacatcgagttcctttaattagagataatagtccaattacttaatgcttttttctgaatgtgctcaaataatccaaataaataaaatgatcttttatacgttcagattaatatttcatcattataagttctcaaacatagtctacgatgcatgcccgtgcgaatgcacgggctaccttcctagtttttttaattgatacaatggctctgtttttttttacaaagtgactttgattgtttacgccacatacagtactagaatatttctcttcaatggccacgtgactagagtagtttttgcgtgtatttccttgagctgtaagtctgtaggctggcttgggtctcatccctctttgaggctatgcactttgttgagttcgtgcggttttagacacgtagccagttgtcagggccaagaaaaagaacaaaaatgattgattatgctgtagcgctaatcgacgcgctgcgcgtggaatattaattcaagcgccgcacaatgctccatccttccggtttttcccttttttaccacctcacctttactccgcctcccacctttccttcactactagaaaaaagatttttccgggtggcccaaaaccattttcgtaggcgggggaaaggaccgccggtaccatctcgcctgcgaaaatagaccattttcgcaatcgggcctgtggcccgcctgtgaaattcatctcagaaaaataaaaaaaaaccacagggcgccgccaccggcctcacgagcgccgccggccaaggctcccctccgtccgctgccgtcggcgccgtcatcatcgtcgtcgcgtcgacgaggatagccggcggccggatgcgagccgtcgtcgtcgcccgtcgtggccggtggaggaggcggcgaggagggaagcatgtggcggaggaggcgagccatcatcgtcattcgttgtggatggtggcggagggggcgaggaggggaagcggccggcagagacggcgaggagggaagccagcagcgaagagggcgaggaggggaagcgggcggcgcaagcggcgaggaggaagccgacggcgcagggatctggagtgccagcgtcgtcgctcgtcgtgggtgacggcgcgtggacataggagaggagcgagcaggcggcgccgtggtcgtcgtcgtcgtcgtggccggcggcgcagatgtgggagaggagggagctgtcggcggagggaaggagtcgccggcgaggagggagacggcggcgtcgcggtcgtcatcgtcgtcatggccggcagcggagggagccagcggcgcgcagacgtgggagaggagggagccatcggcagcgaggagggagcccgccggcgacgaggagggagccggcggcgcgcgcgcggacgttggagaggagggagccggcgattttttctaagtgtgtgtgtgagagagagaggagggggagggaaatgagtggtggagaggagaggataaggatggtggaggagaggataaggatgactagatttttttttgttggtactattttggcaggcggaccacataaggtgcgcctgggaaaatagattttcgctagcgtccgtctgtgaaaataagacccccacgccgggtaaatgcttttttctagtagtgcttaatttgtttttttcgtttttttaccaccccaccttccatgttccttttttctcttttgcatcttacccatggttcatcaaagggcccagtaaaatattaaccatctagatttttcccttttttttccttctctccagtttttctgttttctcatttagtaaaatatttactgtctagtttttctttctgggttttctatttttctagtgtctccccacgtttcaaaagtaacgaatttacccagtgaagttttcgtttaactcccagcctcccacttccgctccttcaaaagtaacaaatttactcgcatgaatacccccttcaaaagtaacaaatttactttcgtgaatgcccccgcatcctatagcactattccttgatggtcataaaagaattactaccagcttacaacgctagtaattctttcaccagtgtatggtctgcgagtaaaacaattaccacattcctctcaatatagcgcatgatcttagccactttgtagtaatatgtttactgagactacgtggtctacacgtaaaaaaattatcaccttcctctcgatatagcccgtgatctcgtagcaaccatgtagtaatatatttaagaatgtgttcaatacatagtataagagtaaaaactgatactaagagtatttttaatctgtatcacaaaatggacatacgaatcaaaaaattacagactcaatcacatagaagtgataaaaattactcacaggtgtatcaaactagaaaagaaaaaaatgattcagccaaaaatccatcgtgaaactaggatcctgatggctttgctggatcttgctataaggatggagaggctggtctgtgtcttatcacacgtagtggagagggaaaccgggtggcgagcagtagtcgacgatgaaatcatgtaagggtgtagtggcgtggtatagagatgggctcgacattgcgcagtagcagccatccatcttctagcaagcacgaaaaaaatgcaaaagcattctcgttcatgtcatagagacgacaagcaaaagaaaaatagcaaacaacctctatcactggaggactccaccctatcctctgaggctagctacatggagcaccatgtgcaaatgtaggacctgtgcatcctatcaattcagataaagtaatatttgagattgcagtaatttgtaaaaagaaataggttcttcatgcgtgaaggtaaaggatgcaaattggagtgccaattccttacttgcttgttctgtcaatgtcgccaacatggagcagccgctagttgttgctcttagcccaggtgaacacctccttgctggctaaggtgccgcccgacgtctcgcagcgaggcccaaagcagcgccttcgcctcaaccgccaccagccaccgctcgccggccaccgccatcaaccaccacggtgtcgtcgtcttcctgcatggtgcgtcaccgatcagtggtctggatggtggatcgattcaaatctaaaaaaaaagggaaaaatgaagttggagcaagagtggttggttgggtaccggaaaaataaaatatatacgtaccggaatcaaggaaagttgttttttatttactccggtaatagtgggagcaggatgacggggcgtggggtgggatcagaagtagggaagttgtttttattatcgaagtaaatcgtttactctaataatgatgggagcgggatgataggacatggggtgaggtgggcctggactaatacatgtttggcgctcagaatactaaggaacacattgcgctcctaacagtagtactattgattatgtacattttgttttgtttgttagatgtaccagtgactagtaaatttttttttgccaactcatgcactcctgctatgtagtaccaataaccacaacactgttatataatgagcgacaaaaagttttatatagatgcgcatgcgaattagtcgatatcttttggaagtatggatcctccaaattaaattaaactaaaacaagttagacagcaatcttctgagcaagttagaaatacatatctactgagctgctttgtttgcacatccaccaatttagtagccacacaaaaccctatgcatgctcatctctcatatattatagtatcattttgcttttttccctcggctactcctaatcaaaatctgatgagaagctttcggtcgtgccccagggtggacagagttgcaaacatgcagttcatgttactgtctcaactgattaggaaaaaactccgaaacgttatgtgatgaatcctatatatatatctatatggtttgatccccacttagtgtagttaatagcaattctcagctttgtggttaagccacatcagcaacaaaatgttggccgtctgatttgatctgaatggctctgtactctacaaggctaaactggttgcatatgaaaaagccccagttcacaccctggcccaccataccatccgacccttcatctccttcccaggacggagcagcccgccgctcaatgcctctgcttcttcctccagcgccagcggcgcctcccctcccctccccggctcccccgccctattgttgcttcctccagcagcacctcttgccgcctcccctccaggatcctctcggttgctttacgccggcagggagcatatccgccgcgctaacggtgtggttgcgcttcccctgcccccaccacacccccgcgggaaagccggaaaccgatgattcccttcataacggtcatcatgtgctaccgacaacccttccctccatggctccattgattcgtctcctgcatcttctttcacctcccgtatgttctctccttcacctgtaaccaccggcctcgtccactttgaagaaatttcaaggacatctaggccttgtttagttcccaactttttcttcaaactttcaacttttccatcacatcaaaactttcttactcacatcagcttccaacttttttcttcaaacttctaatttcagtcaaactttcaattttggtgcggaactaaacacagccctactgaaggaactcctttctttggcttcaacaggcaacagcgcgccaaaaactgatctattcaccggtggccacgttcccgcccataggtatgcttcctcgtgatcttttcctcattttctgttttgacgccttccagtcggaccaaattgattttttttttatctactgaccctcagagtatcgactaacaaaaaaaaaagtccctgctcttctccagcttattgaaaaaggcatttctcccgtctatttagccgggtactgaaattgatttcttttgtaaattttactggtactcttaagatgagaggcagggctgcagga

SEQ ID NO: 60496 - DNA, 32005 bp, Oryza sativa
  unsure (1)..(32005): unsure at all n locations
tttctccaaggtttatttacctaaacctttgatagcatgcattccctattcaaatatgtgtttcactcttcctttatcattccctgtgggcaatttgattgcttcgtaatctgttcagttgagaagatgttagctgtgcaatcctatattgcgattcactcttttatcatcccttatagcagttgtataactttacgtctttctaatccatgaatcttttatttctctcacaaacaaagaggtattgacacttcagtgttgacgactcatttaggtaagacttcaatccatacaaattcagctcctcagttgtccagtaactttgttccatccaagtttccacctgtacgaggtactacattttcatctatgctgcataggtgccacctgcaataatcccctgtattatttgattgattaactgttgtaggcatctgttagcttacttgccgctctttcatatgtacaactgcttccaaatgtggtgtgctgctcctgtcaatcttcaatccgcaaaaataaggctggtgtgtaatcactttcccttatatatttattttggacatggccaagccagtaacggggtttgaggctatctttttcatactccgatagttgaaatccctgcctcgacaaccatcgatttattttagagttttatcgtccaaatacatgaatctgcaacagctggacagcagtgccgttcgacccaaagcattatagaggaagccgtcacagttaaagctctactaaaatgaatatcgaaagaaaaaactacaaaacttaaagccaggagcttaagactactctctctaaagggtttaatgtatgtaaaagcaaaagaagatattattcatgagagatctccaagattgcacagaaagagctatattatcttcatattattttttatattttactcattctttctttcttttttatcacttgctggcctgctagctgggtttaatcttcctgtgttttcccctcaacagatagccaaaggtttgtttggaagattcagtattctccgtaagcagaagttctcaaagctaccttctacctagatggccactagaaggttggactccctttttatgctactagatcatacatccttacattttttctttggattttcatggcacatattttcgctaatggcgaacaagtttatgatcccctatctttccatcttcctatttcatttgtttgtcactaatgaaaattaggatggtgatttcagaactttttgagggattcaccctattttccagttctttcagctcaatatcgttccttttgatcgtaatgatataatgtcatcaagtgatttgatcaagcagaaagagtgcaaccaataaccatttgcatcagtacacaggtatatatatttgatttttggtatgtttagaactgataaccaatttctatgttctgagaatttttcttaccatcattcagaatcgagtcactgaatttcacttccctttactaaaatgttaatttgaatacaacaatttgttaaaccattaaagttttccttgccctaatattacaatcgcgtgtatttctttactattttcaggccatcttgcaatgccatctcctatataggtcagcttgcgcaaatacgctgttgctccattgatcacgttgtttgctggttgtagatgaagatgcttgatgcttaatcaaataatgtacggactgctgcttaaagcagttaaattagtatgtttaaaaagaatgaacctaataatcagttccattcttgatgaacttgccgtaagttaaaaacatatttggcatgcttttctaattgtttgagtttatattgtagacaatcccatatcaattgactttacgggctataaaagaggtgcacatgtcaatatgtaatattgctctgctccacaagtacatatcctaaaatatatgttatttagttgagagtcccaactacaactccgaactttcttctatccttgagtttatcactctctcactattaattcttaagctttcttattgtccatatattttttttaacaaaaatccccgcagcaacacgtggggaattatctagtgctctataaaaggttgctgtggggacttcagctcctaaagcaagtcagaagtgaaatctccaagattcagtaaggttggagaacgactctatgaaggcttgtcgaaacaagatttcggcaatactaaaaggggtggctatcaagttagaaaagtggatgggtttagagacaaggaattttatacaggttcaggccttcttaatcaagaagtaataacctactcctgtccggggattgattcgccgagtgtattattgatcgtatgatctgggagaaaatcgtgcccctagaagcacccagacctctccttatataggggaaggggtccgtattacaaaatacagtccatatccttaatggaatatatagttacagataaaatacaatcgtaaccgactaggatctcggatatttccttgacatacaagtttaaaacttaacccgagtcttctcgaagatattctatctatgcatggcaccccatacccagtcggactatacatgccgtgtagatatgtggtatccataatctccacagtagcccctgagaccttttcagtcgacgaaatagccttctcttgaaacataaagtaataatccgagtgcttcaatttcttctgtattgatctccctagtaccaaaatcaaagactgtgaaggtctaaaaatagaaaaaactgggtgcatcgactagatgcacctaattagatgtagcccccgactgtatgattagttaaaaactaaacatatagtcaagatgtaaactacatccaaccgagtgatcagacaaccatatagcaaagcatatgcggcgttcaacaaaacagccagccgactgctttcagctttaatataccaaaaatgaagatatggaaaggcctgagtgaaaaacactctaaaggtccataaattcacacatttgataagaatccgagtaaaaactctcaaaaagatccatcaaatgtgatataaatgtgataatcataacaagtgataaccttgatgcacgggaaaaaggggggctcccatggtggactgctaggcgactggctccgctcttgcgtcggcggcctctccggccacggcgttctcttcccaaccagctttagcgatgtcgcctttctctggagcatcgctggctaggtctctaagcccagacactcacccccgtcaccataggcttcgcccttctccaaatccaccgcttcttcccctacccccagatccaccagcttccctagcctctccaaccctcgagttcttccctcctgttggtccttcccgtcagccccctactcttcctagcctgggcgtccctgcttcagatccagctttcgtcagcagaagatatcgggttccggggacgggctgccctttccggtctgcggtatcctcgccagatctgcagaatccgatgctggattcgagttctgctccaaatcctcgcctgtcttctcgatgtcaaggttcgccgaaaggtgaactgccgggattcaagcgtctttactccgatgtagttactgctcctcctcaacctccagctgccaagtcttcagatttcattgcagtgcagcctccctcaagattttcaggggcagtagcaaaggacataaggatcctgcagagtggacgtctgctcgatttgtctacccaaaatctctctgcatcagcgcaaggtacaggagacattcaagttggagagaatccttggaaagaggtcaaaggaaaacgcaggtggagaaaccactccgcattcactacaccaaacaacctggagcaaatgcattcaagaaaagcaagatttcttcaacacatggaaggcaagtgtttccgttgtttgagtacaaagcataagatcgtcgactgcagggagccgtttcgatgttggcgctgcttaaaatttggtcatctggcttccagctgtagcaagaagtttgcctataagtccaccttgcctcctctgaagactcacactgaagcttttcctgctcttgctcctctttgttttcccccacgatcgtttccatcccctcccaagtccccgatcatggacgacctcacagctcgtcccctcctcgactcggtggtgatctcggccacaggggagatcgagaggaaccgggaacgcttctcggcccattccttggtggcatggcaagtgggtgcccaagaaggaagggtcgagctcaacacgtttgcagatgacgtcccctcagccttcaacatcagaagagctgacatccaattcaccaagttccacccagaagacttcttcatcacttgctccaaccagggtgatcgagacgcaatacttcgccagccaagacttgccacggcttccgggagggtgtatgtttttcgtccttgggacgaaagcctgcacggcgtcgaggcaaggttccggtaccgagcacgagtatgcattgaggggatcccaatgcatgtgtgaactgatgaagcagcggctaaggtgataggccggaagtgctccattcactatgttgaagagtactctcgccgccgcaactacaaccggaccttcgatttgtggatttggacggatgagccgagagctatcccgcgtggaggtaccttcgctattacctctgctgatgaagaaggactggccacagacattcctctgccagaccttgaaccactccgcaacccgccgccgtctgagccgaagaaagggtggacatacaatgtcttggttcatgttgacaccttggaagatctcctctctcgcaaagctcgagcttacaagtgggattatgatgttcaagacgatggcactctctacaaagaatatccactgccctgcagggcagaacctgacccaacaagaggaccggcagatgatgatgaagacaaggacagagacaatcattccaggagtcgccacaggagccgctcgctgtgggaccggttgaggaggcgatcttcaagccgcagtagggagccggacagaagagacggccactgccaagacaatgaaaacagggggcgtccgcgcaaccgggaacgctccgagcatagaagcagaagctgtcgttctcgtgatcctagcgaggtgagaccgcctttctcttcgcgctccatctctcaagatgactctgttcaggctactcttccactttcctctactccgtctgcttcaccttgcaagctacagaattccctacgtagtccgagccctgatgggggcgctgccgcaagcccttctctcaactagcacatccctgatcagtccatccttcaagctgattcttgcttctcctcgcaggggagcgaggaggttcttaccctcctggagagccatctcgaccctatgcttcatgaggcaaccgtacagcactccatctattcgccagacacatcctctccgcgtgctgtttcccctgtttttgtgccttcttttgcagtacagggaacctcgcaagaggagttggcggcaacccaggcaagccctgtccaggagttcattgctgctctgtcaacaccagtgcagccgcctctcctgcctgctccggaaacacaagctcgccgtccgggaagagcaaaggtgacaatcccggcgctttcttcagctcagcgtcacagcgaacgcctgcttcgcaagcgacgagcaggggcaaagcttgaatcttttgctcaggaaatcctatctaaaaattttggtataatggacgaaagatcttcctttgatcataacatcaaaaagatttatttgcagcgctacaagaagcctctgtctccagcgtccctgaagacaattgcagaattggtggagaagggaggctgcaaaagcattcgcctgaaggcttccaagaaggcgacggtggcgcccctgtaagcggttgactgccaagcttgaagcgctcagcattggccatggaaaggaacaacctgagaagatttagctcatctctcctctctctgtcttttcttagtccgtgtcaaagatgtaaggttcccctttgcctgtgtttcttccaactgtgttggtcgtgtttcggcaaaggagcaatgaacttctcctccaagctagttagtgccagttgctgcttgtgttcccatcaaagatgtaaagttcccctttgcctttgtttcttccaactgtgttggtcgtgtttcggcaaaggagcaatgaacttctccaagctagttagtgccagctgtttgcttttgttcccatgtcacaagaaaatgtctatctgtttaattggaatgtgagaggtttaaattccaaagcaaagcaggattctgtgagatgtattttacaacagcatggtgcaaccatcgtatgtctacaggaaactaagttgtcttctatcagtgatcgcattattctcaatactctgggccagagatttcttcggcactgtgtttctctaccggccaccggcacaaggggtggcgttctgcttgcttgtgatgagaattacttctccatttcagatgtactccttggcacctactctgtatctgcagtgttaacaatgaggggagaggggcttcaatggtctatcacggtggtttataggccacagttagagccagataaaatcaattttctttctgaacttgaagctctgcagacctctatgaaatctgcttggctcattattggagatttcaacctaatatataaagcttcagacaagaacaacgaccgacataatagaaggatgatgcaacgttttcgtggcctcattgacaaattgcaggtgaaagaactgtacctcccagggcgtaggtttagctgggcgggagagggcataaacccaactcaaacaaaaattgatcgcgcctttgttacaactgattgggacatgatgtttgactgctcgaatctttaccctctgtcatccgcatgctctgatcatgctccccttcttctggttggaaatgagaaaatgaatagatttccaagtttcagatttgaagctttttggctgaaaattcctggctttcttgacattgtgacagattcctggacaaatccaatcttgtcaaccaacagattagccatcatccgtttaaagctccggcgtctagctcaagatctcaaaagatggagtcgcaatcacgtgggtgacatcaagctgcaactcgctgttgcaacagaagtgatctttcaattagaggattggctgatggagagcgggctttattgtcaaaccttaaaaatagaattcttgctctgtcagtgttaaacaaaatccaaatcaggcagcggtcaaggcttacctggattaaagaaggagatgtaaactcaaaatttttccatatcaaagctaattctaggagaaggaagaatttcattcaatctttacaaacgccatcgggcatcgcaatttcagcacaagacaaagagaacgagctctatcgtttttttaaagagaggctggcaagtgcctcggcacccaacgacgccggactgcgactacgtagctcgtagccgcactccagtcctcaccgcgaggttttgcccctctgctggtggcttgtgcctagtggagagagagattaggaatgacaatctattagctgcctttccaacgagactgattacatgattatatggccactggcctaaccaaatatagaaggctatccttaattctagggacaccaaaagtagcagcagatttcttctttcctttcttcagcctctggacatcgtcgtcgtgtgctcggccgctcggcgcatgtcacgcctgcgcctgtatgtgcggccgtacatgacatctccccctccgtcgaagtccagctcatcctcgagctgaaacgctgggtacctggcgcggaagtcgtcgaggtcttcccaagtggccgactcgcaggctcgtcacgccactggacgagcacctgccgaacgccgcgagtcagacggccgcgtgtgacgcgtgcaggttctggaaccaccgccccatggagagtaggaggcagggccggggtggaagtgggcggcgtgcccacaaacttcttgagcactcctacatggaagacatcatgaagacgggcacccggcggaagttgcagccgcacggccacatcgttgatgacttcggtgacgcggtagggcccgacgtatcgaggcttcagtttccctgtagtggtgcacggcagggacgaggctgctctctggcggagacgaaggagcgcccagtcatccacctgataggacaccggccggtgaagccggtcgtagtgcttcttttgcacttcttgcgcttgctcgagtcggtagcggacgtcggcgaggaaggcctcgcgagcttctatctccagggcgacagcggcgacgcgggtctcgccaggctcgtaagagcggatggagggcgggtcgcggccatagaccactcggaacggcgtctcgtggagcgaagattggtatgcggtgttgtagatgtactccgcccacggtagccagcgcagccactgtcgggggcgatcgccggtgaagcagcgtaggtacatgacgatgacacgattagccgcctccgtttggccgtccgtctgggggtggaatgccgacgacatgagtagcttggtgcccatgaggcgcatgagctcgcgccagaaccccgaggtgaacactgggtcgcgatcggacacgatcgactggtgtattccatggaggcgcacgatgtcgatgaagaaggcctgcgccacggactcggcggtgtacgggtgcgccaaggggatgaagtggcaatacttgctgaagcggtccacgacggagaggatgatcgtcttcgcgtgcacccggggaagcgcctccacaaagtcaaggccgatgttggcccacacaatggacggaactggaaggggctgtagcaggccagccgggtagagatgttccgacttgtagcgctggcaggtcacacacgccttcacaaagtcctgcaccaaacgacgcatgtggggaaaatggaagtcgcggtggaggcggtggagtgtgcggtggacgccctcgtggccatcgtcatggaccgcggccacgatctcctgtagtagcggcgaggccgacggaatgtaaagccgcccgtcgtaggtgaccatgtccgtgaccacggcccacggcgccgcgcgcgtgcctgcacggacctcatcgtggatggcgaccaggctcggatccgtggcctgggcatggcgcagccgctcgatgaaatcgaaacgaggcgcggagatggccaggagctcgccctcctcgatgtcgcggcgggagagggcgtcggcgacggtgttcgtggcacctgatctgtactccaccgagaaatcgaagcccaagagcttcccgacccagtggtgttgcggaatcatcgctaggcgctagtcgaggaggtacttgaggctgtagtggtccgtcttgacggcgaaacgacgtccccataagtacggccgccagtgccgcatagcctagacgaggccgatgagctcacactcgtatgcggcgagggcgcggtgatgaggggcgacggggcggctgaagaaggcgaccggatggccctcctgagtgagcactgcaccgaaaccatgggacgacgcgtcgcactcgacgatgaagagcttggcgaagtccggtattgcgagtactggggctgtagtgaccgcggtcttgagggccgcaagtgccaccgccgccgcttcaacccaagagaagccatctttctttaggagggcagtgagcggcgcggcgaccgtgccgtagttgtggacgaacttgcggtagtagcccgccaagccgaggaagccgcgcactgcccgaggcgaacggcgagcaggccagtcgcggatggcctgcaccttggacggatccatggcaacgcccgccgccgatatcacgtggccgaggtaggcgaccgagggggcgctgaaggagcacttagtgcgcttgacaaagaggtggtgtcggcggaggtcggtgaggacggcacgaaggtgacggagatggtctgcctacgtcttgctgtagatcaaaatgtcgtcaaaaaagacaaggacgaaccggcgcaggaaggggcggatgacgtcgttcatgagggcctggaacatggccggggcgttgcagagtccgaacgccatcaccaagaactcatataggccgtcgtgagtgtggaacgcggtcttgtgcacatcctctgggcgcatacgcacctagtggtacccggaccgaaggtcgagcttgcagaagaaccgcgccccgtggagctcgtctaggagctcgtcgaccacggggatggaaacgcatccttgacggtgagcgcgttcagggcgcggtagtcgacgcagaagcgccaagtcccgtcgggcttcctgacgaggaggaccggcgacgagaacggggagtcgctgcggcggatgatgccttgctcgatcatggcggcacattgccgctccagctcgtccttgtgggccgccgggtatctgtacgggcggacagccaccggctgcgcgtccggcttgaggatgatgcagtgatcgtgcgcacgctggggaggcagacccgtgggctcggcgaagaggtccccaaatgtcgccaagagcccatccaggaggggctcgccgtcggtggtggcggcgagggccggggcgccgggggtgggcacaccggaccagcagacggtccgcccttggcgctggaacgacatccggtggctggccaagtcccagacgatgggccccagggtgcccagccaacaggtgcccagtacgacgtcgaagcccaccagcggcatcacgaagaggtcggccgggaacagggcgccgtcgatggtgagcggcgcggccttgaggacgcccgcgcaggtgacgcgctcgccgttggcgaccatggccgtgagccgggggcgtgtgtgcaggggcatgccggagcgccgtgccgccgcctccgagatgaagttgtgcgtgctgccggagtccaagaaggcgacgagcgacgccggcccaagcgcgaccgcgacctacatggtgtcggcggcgggtaccccggccagggcctgcagggagaagacaggcgcctcggcgtcctggtccgcggcagcctgggcgtcgtcggcgtcggcgagttccaccccatcgatgaagaagacgcggcggcagacgcggttgtggccgcgcgtatacctctcatcgaagttgtagcagaggccaaggcgacgccgttccgcctggtccgcctgggaaagacgtttcaccgggttcccagccaccggcgcggccggcgcggcggctcgttcaggggccggcagggcgaggcgtggcggaggcgccagaagaagagcgcgcggagcaggccgggcggttggcagcgccggcgtggactgcttgatcaactccagttgccgcgccaagctcatcgcggcggccagcgactgagggttgtgcacgcggacggcgtggctgagcgggggcagcagaccgcccgtgaagagctggacccgctgtgcttcctccaagggtccggtgcgagggagcagcgcctggaagcggtcttgatactccgtgaccgtccccgtgcgtcggcagtcggcgagctcgaagagcggcgtggatcggagcgggggcccataccggaggttgaggaggtcgacgaagcggcgccagggcgggatgccctcgtccctttggacttgaatccactacatctgggcaccatcttccaagttgtaccccgccatccaaacttgctcctccgccatgattttctgctgatggaagtatgattcacagcgattaatgaatacgagcggatcggacttgccatcatacttgggaaaatcaagtttctggaagcgcggaggtggccggtcggtgttggtctcccccgtgcctgccttgggacccgaggacaacgacttgtcggcggagagtgcgaggattgccttggtgttggccgccgcggtcgcctggagggccttgacggtttcggcgagctgcgcgatggtggtcttgaggtcgtcggtgtcgctcatggcagcagcgcagcaagcggatgaagacgaggtaggggacgtcggcacggcgggcggtgtaggggaggtggtgcgggaaggagaggatcgccgggatcgttataccaggttggcaagtgcctcggcacccaacgacgccggaccgcgactacgtagctcgtagccgcgctccagtcctcaccgcgaggttttgcccctctgctagtggcttgtgattagtggagagagagattaggaatgacaatctattagctgcctttccaaagagactgattacatgattatatggccactggcctaaccaaatatagaaggctatccttaattctagggacaccaaaagtagcagcagatttcttctttcctttcttcagcctctggacgttgccgtcgcgcgctcggccgctcggcgcatgtcacgcctgcgcctgtatgtgcggccgtacatgacagaggctaggatcaggttttcaaagagaggctgcattaaattgggattccctgcatttgccaagcctagacttgtcagacttaagaagaggatgtaacagaggaagaacttaaagcgactattttctccatgccagctgaaaaggcgtcggggccggacgggttcataggagttttcttcagagcagcatgggatgtgatcaaggctgaccttctagcggcagtaaagtctttcttcgacctaaacacttctcaattacatgatctaaactcggcttatatctgcctcctgcccaagaaagaagatgctacttatagcagagcactaccgccctataagcttgatccatagcttctccaagataatttccaaacttatggcaaacagattagcgcccaggctaaatgagcttgtctcccaaaatcaaagtgcttttatccgtaaaagggctatacacgacaatttcctttacgttcagaatatggtacagctcctgcacagaacgaaaaaacaaagtttgttcatcaaagttgacatagccaaagcttttgacacggtgtgttggccatatctcctcaatgttcttcacaactttgggtttggaattcgctggttagattggctatcaaatatcctggcaacctcttcttcccaagttctgcttaatggatccccgggccagccaattcatcatgttaggggccttcggcagggggacccgctttccccgatgctatttattctagcaatggaaccttttcatcgtatccttaaagcggctgaaaatgcagccatcttatcaccgattggcgggagatgtgaaaggttcaggtgttcgttatatgctgatgatgttgcggtcttcgcaaggcctcagaatagtgatatatctactttggcccagcttctatccttctttgctcaagtgtcgggtctgcatacgaatattaacaaaacagaattcttcccgataagatgtgaagagattgatgtaagctctcttttggcaaacttcccaggcacagttaagcaattcccttgtcgctatctcgggctgcctcttcacttcagaaaacttagaaagattgactatctgcctctcatcgaaaaaataggggccaagataccaggatggaaaggaagatttttcacttcatcggggcgtcaaacgctggtacaatcagtactgccctccaaacgctgcccattcatcatcttactgccctccaaacgcctaaatgggtgataaaaagaattgatcgattccgaagatccctcctctggaaaggtgaggatcctgatcacaccaatccgggacgtagcctagtcagctggcaaatggtgtgctaaccgaaatctttgggaggcgccggtcttccagacctagaaagattttcgagagcgctccgtctacgttggttatggctaaactagaaagaggaaggcaaaccgtgggctggtatgaatgttccctgtgacgattccgacaaaagattatttcaatcagcgacgactattactcttggaaatggagcaaaatcaagtttttggcacgacaactggcttcaaggcagatgcccaaaagacatcgctcccttgtgtttcagactggcaaagagaaaacagaggaatgtccaatacgagcttcacaacaatgcatggatcatctcctttcgacagataactacagtggaggaattgaacgaactagtgcatctggggggaatgatacagaatgttcaactccatcaaaatccagacgacatcacttggaattggtctgaatcaggtgtttactcatgcaagagtgcctacttgtaccaatttgaaggctcatttacctcaattaattttaaatcaatttggaaaacaccagctgaaccaaaaatgaaatttttggggtggttgattcttcatcaaaaaactcttatagcacaaaaccttctcataagacactggccgtgtgattggatttgttgcctctgctcgagtgcgttcgaagacacaaatcagtgaatgtgactttgttcgggaggtgtggaacctggttcatgcttggctaaacttatcaatttctacctccaatccgcaagctggaactgcaaactggtagtccaaggtaaatctgactgtttcaaaggttgataagatcgcgacaagaggagccttgctcacaatgtggtggaatatttggttagaaagaaatagaaggatttttaatcataaaagcctttcggaaagagaagtggctcacttagtgaaacaggactgagacttacgttgctgggtgtttaagcctccttgagctatgttttttatcttttgtaatcaaggatctgtttgtattctgttttccttcttaatcaaattccgacagagctcctgccgtcgtcttcctcaaaaaaataacaagtgacaagtctaaatagcctaggctatgactcacaccagaagaataaacatataatatgccgagtgaataactgttcaaaaaccagttatctcaacaaaacccgaacagcttttgcagcctaaaaagacttacaaaattagtataacacttttctgttgggcacctttttatttgcatcatagtaattccaaagaatcatccaactgcatcaaaaaggattttaacagcattgggccatactgttgtgagcaaaaattaccaaagcaaaaatgcctaagtccctaaggatcacaactagccacgctggtaatagaattgggctaaagtactgtataggcccaggcccatcaacacccctgaaaccctagcgaaataaacgccgaagtcaaggcgtcgtttcgtcttcccagccgaaactctcgcccctttccccattctctggtacagtgcaaaaccacaccggcaaaagctagggttaacaaatccacttcgatccagcctcatgagctccacaaaaacctttcgcgcaaccactgcatcgattccccatccatttccagccacatcccgaaccaaatcacatcatccagtttatattcatggcggaagagagagaaagcttcgagagtcaatgggcgccctctgacgttacggaggagagcttgaaggaaatggtagcgcacggtgttcttccggcgaaggaaatcatcgggtggcgtccgacgtgcggcaaagcgtttccaacccctgatacacatgaagtcgtggtattttctcatttcttctatggcggattttctcttccaacctcaagattcttccggggaattttggatttctacgggattagtttacatcatctaaacccaaactccatagttcatattgccaacttcatacacgcctgcgaagctgttttgggcatcgtaccacattttgccctattccgtcgcatcttcttccttaagccccaaccaaacaaaagcaagccatgcgtagttgggggagctggattccaactgaggggaactctgagccaaaagtatttctccatgcccttcaaaacctcaaacaaaggctggcatgcaaattggttctatgtacaaaaccccgagcctgctctccccgagtactcctgtcttcctccagttttcgatggaaaacttgaatcatcatgcccaggaattcgccttgatgaagtcagaccctccaattgctcaacgccgatcacctcgccggcagactggtcaggcgagtggaggaccaaaaattcggtctaatactcaaccaaacacctcaaaatcagccagccagtcaaactcccgcaagaggaaattggttctgagtgatgatgagggcgatgatgctggaaaaatctggcgataaagaggtgactggaaaacaaccaaggcataccaatccgaagaagaaaacgtctagtcatcccatgccaaaaatcaggaaatcttctaggtatgaatcatttggccatcttcctcgtattgctgctcacccactgttgaaataacactgatggcataactcaaattcataggaagccatctgatatagatccttccggaaaagactcggagccgactgacatggagacaggcccttcaaaagaaaccgggccaacaacagaggattgttcgagtgacaaacaaccgacaaccaacaatgtagaagctagcaacgagcccccgactgggaactagtcagccgaagctggagctgatgctaatcaggagcccccgactggaaaccagtcgtgtacagaaccaaatagagatattcccgaagtagaagctcaaacgaacagccctcctagaaagaatgccagtgctgatccagtgcccagctctcctgtcaaagtacaagagcctgcttgtcctcgaccggaaattattacaggtaaacacatcctccgaacccgttttgatctgacagactttcttcaattgtttcacctttattcatgaatgcccaaggcccaatgatcggcgacgaagaagagatcctccggatatagtcagctgaggattctcgcccacccattttagtcaagtggtgggatgacgacatgcaacctcagggaattgtaataaacaagcaaaaggaagacgaggaagtatgcctgctgaataaggcactcagccaagccactcgcatcgtaaatataagtctcctcatgcacagcttcaaccatcctgtttactactttgctcaaataccaacaaattctcgtattacagagaatccatctcaggaacgaagcgaagactgcgactcttgagaggttagttctccatcttggaacccttgaggccaccagaaatcagctgcacgaagctaaggagcttgccagaaaaactgagcatgatctacgggaccgaatcgccgagcttcaagattctaactttgagctgagcggttcgtcaaaaggtaaatacaatctctatcaactaacttatgctgccactcttgtaatattaattaacaagaagcaatacagtgcaagctgctgagatatctgaattggaaaaacgaatccaagctctggagaatgacaaggccgaattggcgagacaaagggactcggctctaaaagacgtcgaaggtactagtgactaatactccagaaactattcctttccttatgcccactcgttgatataaatatatttttgcagatcgcaaaatcaagtctcaggctcaattcgatgtcttggtcaacaaaattaagaggcttgaaggggttagggatgaagtcgccatccctactacaccactcgtgcaagccatgttcttcaataacaatggtccaagtacatttgatgcttccgaaatcttcgacaagctgagaattgctccggatacatactttaagaatatcaaagaggctggaagtatgggagcaagcctgacgttagcaatgaccaagtctttatacccgaagatcgacattgatgccattgatggctttgcagacggaacgagcgaagaggccgcccttgacctcatcaacgatgcgcagaaagccgccgataagattgccgttgatgtagttgagagattccaggacaacgatcttcggccgactggatctaataactccgatgatgaaaaaactgatactgattgatgtcatatcataacaatgattctgatgatgatgatgatggaggcacaatttgtacaatactgatgaatttatgctgtgattgatatttcaaacttagctcctgatttcttaaaagcttttgtcaaaccttattgagcctaaaacccacaaaagttattaaaaaactttcagtccttattgactaagccaaaaaatcaagtagggcaatgataaatcaagtaagcaaattgaattgataaaaatcatactccataattattatagtagccccctactgataactcaaggagaaacttgatgttagcagtcaaagagggaaatacaaagtaatgcctaagtataaaaacgacgaagatgttcaatattccaagagttgttaataggggtaccgtcttcacgcttgagttggtaagaacctggttgagtgacttcggaaattatgaatgatccttcccacaagggagataacttgtgccgatcccgtgtagtttgaatttttctcagaaccaggtcaccgaataaaaaagctcgtgatcgaacgttgtgattatgataacggcgcaacccttgcaagtaccgagccgactgaattaaggctgcttcgcgggcttcttccagtcggttcagattatctactcggtcttctccgtagcgctcctcgctgaagttgcgaaaacgtaaagattcaaattccacctcactgggcaacattgcttccgctccatagactaggaaaaacgtcgactggcccgtggcccgactggtagtggtgcgcaaggaccaaagtacagacggcagctgttctacccacttgccggcatagggattcagtcggtcaaaaactcgtgcctttattccttggagcaccatgccattggcgcgctcgacttgtccattgctcatagggtgcgctacgcgcgccacggaggcataacaaattttaatgccaaagtcttcacaaaagtctttaaatactctgccagtgaattgagtgccattatcagtgatgatccgattaggtaccccaaatcggtgcacaatgttgatgaaaaaatttctagctttgtctgccgtgattgtgatgaccggtttagcttcaatccacttggaaaatttgtcaacagccacaaagaggtgagtataaccaccgactgcctttttaaacgggccgaccatgtcaagcccccaaaccgcaaacggccaagacaacgggatggtctgcaactcttgagctagtagatgagtttgtctggcaaaaaattgacaacctttacatgtccgcacaatcttgtcagcgtcggacacagctgtgggccagaaaaaaccttgccggtaagccttgccaacaatggttcgtgcggcagcgtgattgccacagatgcctgaatgtatatcctttaacaattgtctcccctcctccaaagatacacagcgttgcaggattcctgatggacttttcttgtacagctcagtctcatgaatgatatagagcctgctgcgcctggagatccactcggcttcatctttatcttagatgagttcttgtttggtcaaaaatcttatgaggggctctctccagtcagcttcaatcatacttacgtcttgagtgtccgtggcttcagttgtttctttccttggtaaagttggctcgtaaagatgttcaacaaatacgtcagaaggagctgcttctcattttgaaccaaaattggctagtctgtcggctgcctcattattatgtcggagaacatgggtgagctcaagtccgtcgaatttgtcttccaacttgcgtacctcctgcttgtaagcggtcatgttatcatcaaggcaggaccactctttcatgacttgattaacaacgaactgagaatctccacgaactatcagacgctggattcccaaggagatcgcgatccttaatccgtgaagtagcgcctcgtattccgccacgttatgggatgcagaaaaatgtatccacaatacgtagctcaatctttccccagtcgggaaaattagaacaacacccgctccagtgcctgagagcctcttcgacccgtcaaaatgcatggtccagtactccatcttctcctcgggcatgtcttcttggcactcagtccactcggcgacgaagtcagctaaagcttgggacatgatcgaagttcgcggcttgaaagatatgtccaaggacatcaattctagggcccactttgtgatccgcacatttgcttcgcgattatgaagtatgttcccgagtggaaacgatgtgaccaccgtgaccgagtggccttggaagtagtgagatagtttcctgacggtaatcaaaacaccatataatagcttttggacctgaggatatcttgtcttggagtcggccagaacctcgctaacgaagtagattggtcgttggactttttgaatatggccttcttcttcacgctcaacaaccaggactgtgcttacgacctggaaagtcgccgatacatataacaacagcggctcttgagggtgtggtgaagctaagaccggtggagtggtgagaagttttttgaagtcttcaaaggctttttgttcttcgggtccccactagaaattgtctgttttcttcaacagcttgaaaaagggcatcccccgctcgccgagtcgcgaaacaaaccggctaagcgccgccatgcaaccagtcagcttttgaacatctttctgggaacttagcggcttcatgttgaggatggcattgattttctccgggttggcttgtatgcctcgatgagacaccataaatccaagcagcttccctgacggtactccgaagatgcacttttcaaggtttagtttcatcctgaaagcgcggatgctcgcaaaaggatcttctagatctgtgatctaatcatccttctgcttggtcttgacgactacatcatctacataagcttcaatgttgtggccgatctgagttgaaaagcatctctggatcatgcgttgataagttgctcctgcgttctttaatccgaagggcatgatgaatgaagtctttaagcaatcggattcctttagtcggatctgatgatatcctgaatagcaatccaaaaagctcagtagctcgcagccggcggtagagtcaactacctggtcattgcaaggcaacttgaagggatctttgggacaagacttgttgaggtcggtgtaatcaacacacacacgccattgtcccgttttcttctgaaccaggactgggttagccagccagtcgggatgaaggacttccttaatgaagcctgctgctaacagcttggtcaattcctccttgatcgcatccttcctatcctgtgtgaagcggcggagtcattgcttgattggtttagcgtcttccgtaacatctaaagagtgctcaatcacctctctaggaatagtaggcatatcagatggtttccatgcaaagatatctttattattttgaagaaaggtgatgagcacgctttcctatttacaatctaactcagcgcctattacagcagtcttagtaggatcagaaggatctagaggaattttcttggtcttggcgtcgctttctccgctctttggcatcttggttacaggcacttctccttcgtttgctgtggacgcagctagtcggatttcttctcgagcgagcgtgatctcgcgggtctgggccatctcgcatctttccttgtcgcatgtgacggcttgcttgatgttgctccacagggatatgactcctcgaggaccaggcatcttcatcatcatgtaggtatagtgcgggacagccataaacttggctaacgccgggcatccgagtatggcatgatacgctgtctcgaaatcagcaacttcgaagcaaacgttttctgtgcggaagttctcccgagtgccgaaggtaaccggaagagtgatctggccgagtagtgtagcggatagacctcgaatgactccgtgaaagggcgcattactcggctttaattccgtgcgagggatctgcatatcatccatggttttagcgaaaaggatattgagtgcattgccaccatccatgagagatctgcgaagcttgatgttgcgaaccactgggtctagtaccagggggtaccgccccgggtggaccactcggtcaggatgatccgagcggtcaaacttgattgttgtctccgaccaccgaagatattggggcgtgtcgagctgaacagtgttaatctcccattcggtcagcttttgctttctcttagattcataagtcaggggtccgccaaagatgtgattgagttccttgcgatggtcttgaaaacctgtcggggcatcatcgtcatcgtccttctttgacgtgctttgatctccgtcggaggcctttcgtgcgttcttggcgtattgttctgcaaattgtttgtagacgaagcaatctttggccgcgtgattggaattgggatgatgcggacattgggagttcatgatcttgtcaaaagtgttgacgcgcgaacgttgtcgggaggaaggtatagtagttgcaacaagttcctcgggcttacgcttacggtccttgtgattggtacttccactccctcctgtagtcggcgtatatttcttctgcttctaagtggtgcccgactgcttggacacgataatggcatcttcggctttggcatactcgttggctttttcgaacatctgtttgaccgtcttggggggtttgcgcccgaacttgccgactagatcttcgtgacgaattcccttggtgaaagcagcaatgatgacgtcatcggtaatgtcggagatctcaaagggattctccagacttctgaatgacgttgtagagatcaaactgtgtaccagggcgttcaaaggtgacctggaagttggcgatgaagtggtcgcgaagttccgcccataatctgattgtgccacggggtaacccatgaagccagaaccaggcaaaatccgctaaagccacaggcaagtagtttgccatggctttgctgtctcctcctgctgcgcgaattgcgagaccgtagacggtgagccaagactccgggttagtggtgccgtcatacttctcgattctagttggcttgaagtcagctggccaatccactcgacgcaggtcgcttgtaattgcagcgactccatccacatcgtcatcgtagcgatccggtgaatggtggggggcgtaacctcgtgccgcgcagcgctggttgattgtatcacgaaaatcgacggggcgcctgcgaggtggggagcgtggccgttcaacttggcgctccctgtgtcattcgggaggcgagtgaacaaatcgctcgtcgtgaggcgatgctgaggctcggctagtgatagtcttgagattgaagatggggaactcggctgctagtcggcgtgcggacgcttgcggagttaaccgggactgaggcggcgatcatggtctttgtctggttcaagatgttgacgacgtgattagcttagtttagtatgtcttccttgaggagggtgtcgaggagggtgatcgctgcaaccgcgttctgttgaggggtgcgaaagaccgcagttcccttgacgtctagctgcccgataagttctcgtgctcgtcgcccggcgtccaaggcccgttgtcatcggtcctcagcctcctttgcagcccgctcgcgttcctggtgctcatgctgcagccgttctcgctcttgtgcttggcgctcctcttccaattggcgtcgtttggcttcctgttgtacgcgtagctcttctgcttctcgggctttgtgttgttcctccgtctcgttgtcagccatgaagacgccgaagtagagaggggtgtagttatctttaaagccctcgtcgaagtcgtcgaggttgcggttgttgtagcgatagccgaagtcatcgtactccacgatctctgttggtcgtgagtcaacgccgggggagctgaggtagccgtccagttggtccgtcgaaaccgtgccaagtggctggagtatgacgccgacttccctagagctaggccggaccggggctgaagccggatcctgcctaggcctacggggagaagacgcccttgtagtgaagacagcagccaaatcatcggggagtttcatcaggattggcggataggccccatcatcttgatcgggtcatgttggagtagattggatctcgtccgagtggtttgaagccaattcggcggagatgaccttagggtagacctcggccgagttcgggatcccgaacagagcggagatctagcctctttccgactggttcgaatccgagtcgaggagagaaatcttgccaaagtcgttggtgatgaagtcgaggctgccgaaccggaacgcctgcccgggagggaagacgaagtcgtcgatgccggagacggaacccatcgcactagtcggcgaagaacttgatgctgtgatatgcactagggttcccgatcttccgaaaggttctgataaacaacgatttggatagagtcgcaacacaaatcgatccggcttcttgaacgcgcacgctcttgagccccgcaatcgtagcaccacgtctcctctagttatcacccgtgtcgaaacgcggatgacctcgccgagaaggctaattcctgtttgccaatcgaagaacacaaacaagaacgggatagaaaaataaccaaaattgcagatgaatgattaagctcacgagttggggtcttagaaaccgatctagcggcgaaactgttctcaacagattaatctaagcaaaatccaactctaaacgttgacggctactgaataaatgtgattagggacgtcctagggtttcccaagggcgcacacccccttaggctaagcccacgacacaattacaaagcccaaaacccaaatcggattcggattggatgagatacgtggcttgttttgcagattcccggtagctcagttggaattttaacgtgggaccaaaaccatctgaaagtagactccataagctttccaacaagtattcatgggccccgaaatttgtcacgcccggaaattcacaagtaatttctaaactaatttgtgcattaaatcctcgtccaggaatcagccgaagtacacagattgacaatttaatatacagattcatcaaattaactaaaacgataaattgaggcacttagtcctcaccatgaagaaaactgcagcggaaaataaaatctagcgaagctccggctccactcccacaggcagctcaactgaggtataagccaaacgtcttctccatcgcaacttttcttcaactgaggtttgattgattattgcaaggtgagcatatgacatactcagcaagccacacaccaaatatgcaagtgcacaaggataccaaagaatggcataatataggctcatttgcaaaagcagcatttagcaaacatttgagaattgtaaaacaatagagtaattaatcatcaatattaatcaacactgaacagcatacccatactgcacaggcccaaccatcctgaacaaccatacccggttgtacagatctatctccaaaccaggaatgtaccattccaaaccaggagctaatgaaattattatcagttatagcatcatttattatggtgagaagtgtgagactaatcacgaaagacattgttagacccgcccataaccgcgggcacggctattcgaatagttttactctggccagaggtgtaccactgtacccataagacacaaccccacgacatgtcaccatgcgcctcaataccaccacggtacctcggaaaagagctgtgacagtaccccttgcacaacacaatccaccacagcgcaccgttcctggatcataatcaccccattataaacaaggcatggactccccagcgaccccagtaggcttatctccaccacttctcagtctggtgccgcgcaatgaaccatgctatacaaaaggtaaagccgttgcccacgctggcttgtggttggcacggttaatgtttcacaaccgaaactcatgaaccggtccttaattgtcataagcacgatcatcaaaaccatgtgctcacaacccaccattatcaggttttagttggcacattaattaattaaccaatcacgattagccatcgtgagctatgattaaatatccatcattagataatagtgaaacattagttatcccaatcatttgctaatgtttctaagcatggctaagcaattatatctaatatatctagctgaaccaatatataaatccaactagtcaaattataacctaaggtaatcaagacatagggtaatcaatgcaaattagccataacaaaggaataagttcacaccacccggtgacattcgaaaataaatgcacagttgaaataaatagagaatttaaatataggatcaacatgctcaaaggaattgtgtttgggatctgtgtgacttgcctcgcaatattcggtcttccattaatcttcttggatacttccaacgcactcacgaactttcgaaacgacaagctaacacgcaaaacgagaaaaaagactaataaaaaccaaataaacaatacatataaagtaaacaatcatgtagatcataattttagatgaattatgagacttgaacggcctcattccgatttcatttgaattagttatgaatttttacaagatttaattccaattaaacctattaaagaaaagactattccaaattaattaaaccatttacaaatgatttataacggagagaaaagattaaaacaacctccggaaaaagattagatcatatgtggtagatgacatatattaaaaaggaataatatgccattgaaaagaaaacggatttatatcgattttggacggctaagattaatcttgatcgtgtcgaccaagatcggatgacttggattgatctggcaagcaagcctcacgagataccgactcaacgagtcaattctacgtgacacggaatcacccaaatgatcaaccgaaaccggtgaacggaaccggtggctctgaacggctctaaactaaaggacgactccacacagacgaacgaacgaagcacggggacacctcgtttgaacgaacgagcgaacgactcaacaacggctgcgactaaaccgatgagctagatacgattcacggtaaagccctggtacggcaaacgataggccagtagaaatttagggatatacctacggctagacaacttggctaccgagcaacggctaaagtggcggctaggttaaagcggcacacagctgcaacacggcggcactagggcgacttggctcggctaggcagcggcgactgggcggaggcacgtggctagggttagggcgacggcacagcgacgacgacacacagcaacggcagatggtggctacggtagcgggatggcagcgacttggcacgcacgagcagcagcagcacggctgtagcagggagcggcacagcgacggctaggcggctagtgcagcggcgacgctagggcagcacctaagcatggcacggcagcggctactcgacgacaaaaacgagagattaaaaactaaaccgagggaacacggatagaagtctcaccgaaccaaagcgatcggagagagatagatgacgacggtgaaccggcggcaacacatggagacgatgacgacgctagggccaaacaagattagattagattagataggattaagaccctagggaaaacctcacagatgaacggcataggagcggtggttgccggcgaaccacgacacaataatgcaaacggagggcaccgggaggtagagaaggcgacggcgattcttaccaacacttacgcgacgacggacagcgatggaagatggccggtgacgagcttcgaagggcggcgaggtactgtccacggtggcgacgactttccggctacgaacggcggcaacagaggggtggacgtccttcggcttggcgctgcgatgccgaaggagggagcagctctgaccagggacagctgggacgacggcgaacggcggctgtagaacaaaagacggcggcaacccactggttcacggcgaggatggcttctggcgagatttcggcgcaagggaaccggctgccgggcttctcctcctccttgcgaatccaacggcggcggcggcgaccgaaggagacgatggacgacgacgaacggcgcggctggagcggtgcctgcgcttggagagagaaggagagcgcggggagagaaggtttccggcgacggcggaagacgggacttgaggagataggtagaggacgactagggggtcctttatataggcacgggagctcgggtccgggcccaaatcgacgggaaaaactcgggaaattctagggttctcgccggaggaaggaaagattgaaccgcgaaattggaaaggatttccatagaaacttttggggatttcttggggaaaaagaagaggagattgagaggattccattcctgcaactaatttggaaataggagcaacgggtaggtcggattggtgggaggaggcggcggcactgtgcacggcacgggagacagtcggctctgtctagagctggaagatgaacagtggcgcagggacacaaaacagactttcggccgggctaagaggaagggagagaatgggctcaattcggcccaagctgagaggaaaattcttattacttttccaaatagagatgatctttcaattgttaaaaatacttccaaagctcaaataattccaagaaaaatcttgaacatacttggacactctaattatttaaaaaaattgaaaccagctcatttaatgattaatttaatatgtgaacaattacagaaatattctttgtattattaaaattaagaattgagctccgaaaaatccgagaaaattccagagagtataattaatcatggagaatttaataaaaattaaatccaaccatgctttatatttaggaaattttatttcccacatttaacttcacttgtaaattaatgaacatttaatataaattctattaataatttattaaataatttataaatcctgaaatgaaaatcaggctgtgacaaaattccttctagatcagcggctaggtccgtttgaagttgatgctgtcaggaggcccgaatccgaattcaaaacgtgcacaacttaatctctagtcttctatgggccaaaagtgatgtggagagatgaaagaagacttggagatggtcttggtttggtccccaatcaacttcttcaatcatccatgcattccttatgttcggtttcttttctttcgcccaagcaagtaactctgcaaacaaaaacatacaaaactcatcgtgtagcaatgtttgttcaaatatataccaagtaaatctaatatacaacatatgcacctttggttgattaatacataaagtagccatggttatatccgagctagttgtgttctcatcatcctccccttcttgattggaaaccgtcctcggtttcaccttgtcatggagcgtattgaacttatctttatctatcacatccggtgaggaacatttcttgatggtcatatgattggatccagaaatctttgtagtcgaaaaaccactacactccccttcttgcaaaccaacctgtaactcatttaaacaactagaggaactagatagagaataacttatacgcatgttgtgctctacacaatacatttcatcatgaaaaggaggtatggtcaaatttgaacaaatatatactcgatgcacattatattctcctttactatcataattgccaataacatgaaaaatcacatcagaagggcatggcaattcaaatctagcaaataatttcttccctaaacagttgagtggacaaagatcatcaaattgaatatatccccaagtatttaaagaagatagcaatttaagctcttcattctcgctagcaatgtgaataacatgtttaaactcaacacatagtggctctactaaagaactaagatgtcaattcattagatgtgacatggatataagtgaagcatcgcacaactcttctttatcacaagaaatatcaaccaaattattttgtgacaaaggtatctcagcaattgtttccactatgggttgctctaatgtagcataagtagtggacatagttggcacatcataactatgcataccttgagcagttgtagcaccattatctttaccttttttctcatcttcagaaattgtaggcgcttggtcaattaaacattcctcaagcatgcatggagctatggatagatcttttggctcttgtttttcttctcttcctcctcattaccttggttgttctcagatgcctgcaagatattagtatgcaaagcaatagtcacaacaatacattcgttttgtaattcagacttggttgaatacatcacaatnacatctttcctggtatctctgaaaatctcatcgattccattgttcatcctttgaaaattatcttcgaaaatttcagtaaaactcatgggtaccaatttcattttccgaccattatgtctaaatgtgtatgtgttagcaacaaaattatgtgatccattattatcatatacccatggttgaccaaacaacaaagaacatgcttgcatagggacaagatcaaaattggcagtatcatggtaatttccaatcgaaaagtttattctcacaattctatttaccttgaacttactacaagagttgaaccatttgatgtaatatggatgaggatgcggttgtgtaggcaactcaagtttcttaaccaaatctgatctcacaaagttattgcaactctcactatcgattatactatgacatgttctatccttaaccacaaactttgtttcaaataattcgtggtactgccattgctccgctttctccatttgagaacttagcacttgttgcaccaaagtacggtcatcacgtgcaccttgttggtatcgctgattttgagcgccactcatacttgtcattgcaaacataaaaataacagcaaacaatgaaggttatccctaataatctgctacgcggtgtagtagtgcccctcaacaactcagccaaatggagcaccttaccaagctcttacaaatgtcttaccatcaatactaaggacggtacaaccggtggctggtccgtgacaccttgaagaacgtgatgtggcgattgcaaggatcaaagcggtgctgactagaagtatatatgtggagcttgggaggcacagtatatagtagcaaagggacgcaattgtgctaatcaaaaaatgcaaagttgaataatagttcaaagtactagtcaatgtgctggcctagcctagactcaactctagctcaagcaagcaaccgacaacactaaggactagatatgaatcaatgcacaactctgcactctgaaaacatactcaaaggatgaatgattttttttatttcttggtgcggcttttttttaagcacctttctacctttttttttctttttttgtgcggctttttctttgcacctttctgccttttctttttttttatttttttactttttttttcaacaagaactgaccactgacctcgaacagggactcaaatgtaaatatgaatattacagggactcaaatgcatagtgcaaaattaaaattagatcacctaaaaaatggaatgcttacatcacgtaggttacgtttttataaaaatatctcaaatccgctacttaacaattttagtgctacggacgggagagacgggagtattcacggcatagatccgatctcctctccctcacacgcgcattatgacggcaatacaggaactttagaaatcgagcaaatcccaaaccgcctgatgaaaacttctccaaactacaaaaacagaaacccgacgacgagacgattcaattattcaaggtcccggcaacaaccgacgagatgaaaaactagacccaaaactgacgtacaactcacacacttgagtgatg

SEQ ID NO: 60497 - DNA, 9411 bp, Oryza sativa
gcaatactcaaaactaaaaattaaatctaaaactaaaccagcactcgacacgatgatgcaatctagaattcaataaagcaaaatctaatagaacaatgcaacggctcaaattgtctaggtaaacaataaatatttttgtgtggtaattttctggttatggaagataaattacctaacgggcaaccgcactctgataccaactgatgagggatgtaggtcttgatcttccgaaaggttctgataaacaacgatttggacggagtcgcgacacaaatcgatccggcttcttaaacgcgcacgctcttgagccccgcaatcgcagcaccacgtctactctggttatcacccgtgtcgaaacgcggatgaccttgccgagaaggctaatccctattttccaatcgaagaacacaaaaaagaacgagatagaaaaacaaccaaaattgtagatgaatgattaagctcacgagttggggtcttacaaaccgatctagcggtgaaactgttctcgacagattaatctaagcaaaacccaactctaaacgttgacggctactgaataaatgtgattagggacgtcctagggttgcccaagggtgcacacccccttgggctaagcccacgatacaattacaaggcccaaaacccaaatcaaattcggactggatgagatacgtggcttgttttgcagattcccggcagctcagtaggaattttaacgtggaaccaaaaccatcagaaagtagactccataagctttccaacaagtattcatgggccccgaaattccttctagatcagtggctaggtccgtttgaagttgatgctgtcagcaggcccgaatccgaatccaaaacgtgcacaacttaatctcttgtcttctatgggccaaaagtgatgtggagagatgaaagaagacttggagatggccttggtttggtccccaatcaacttcttcaatcatccatgcattccttatgttcggtctctttttttcgcccaagcaagtacctctgcaaacaaaaacacacaaaactcatcgtgtagcaatgtttgttcaaatatataacaagtatatctaatatagaatatatgcacctttggttgattaatacataaagtagccatgattatatctgagctagttgtgttctcatcatgctgcccctacctggcacgccaactgtcgaaacaagatttcggcaatactaaaagggggtggctatcaagttggaaaagtggatgggtttagagacaaggaattttatacaggttcaggccttcttaatcaagaagtaataccctactcctgtccggggattgatccgtcgagtgtattattgatcgtatgatctgagagaaaatcgtgcccctagaggcacccggacccctccttatataggggaaggggtccgtattacaaaatacagtccatatccttaacggaatatgtagttacagataaaatacaatcgtaactgactaagacatacaagtttaaaacttaacccgagtcttctcgaagatattctatctatgcatggcaccccatacccagtcagactatacatgccgtgtaggtatggggtatccataatctccacaaggctggatagtgcatgataaatgtaagatcaacgtgtgttttgattcttattctgtgatgaacaattggcatttgtgactgttggttttgatatttggagattactgttgaagtggttttggagataattgattttcaggtgatgaacagggtttgctgttttgtcgggaccggtcagaccgggcggtggttgctggtcagaccggcttgtgttgagcggtcagaccggctagcccgcggtctgaccggccgccgccgtgtcggtttcggtttcgggttgtttctttggatatccatgattgtttcatggttatggcttctagatggatactatacatatgtaatactgttgtttgctaacaatgagtcaagttggtgatagcttgatcttggaatatggtttttttgtttgtttcttgtgtaggtgactcgatgcctcgggagagtatttgcggtgatggaccgggagtcggcttggtggtaagacgatgtatgtggtggtcagatattatgcgggataattaggctagagttgatgcacgtggttggtgaagatttcatatggcatacgatggaggtattgtgtgagtatgggatgcggagtcgaatttggaaggagtccaaatttggtatgattggttatgtgaagtttgtttcttgtactagagggtttcctaaggtgtttaggacttctagtatgagtttggtttgtggctttaggctgcctacctcacgtataaatagagggggagcgtgatgcttccctgtatcgcttttgagagcaattgagttgctagtttagctagggtttcgagtttagtcgacatttttgtaaggagtgctgttggtgcactttgtaaacatagagagaagcaataaagttgtcatctactttgagagttcttcgatttgtgtttcaccgggtttcggcggactaaccggcatctctccggcggtcagaccggcggcatcacggcggtcagaccggcggcgtaagggcggttagaccggcggcggcttcaggccacggcaactgatcaggtggtcagaccggagttccaatctcggtcagaccggtggcttccaggcggtcagaccggcacgactacttcggtcagaccgcaatccgtcgaattcatgggtaacttttatttccgctaaaagttttcggtttttaggtatatcaaccattcacccccctctggttggcttagttcttgtgtttcgatcctataagtggtatcagagccttgttttcttttttggatttttatcgatctagagtttttgccacggctgctcctgttaggtttttaactaagcctcatgttttcaatggaacggatttttctcattgatgtagtaggatgcaatcttacattatggctgaagattatgatatttggagaaaagtttctcatctttatgtgattcctaaagtaattaatactgctgctgcaaaaactgactttgaacaaaattaaaaagctcgcaatattcttttgagtgggatttctcgttcggattatgatcgtgttgctcatcttcaaactgctcatgagatttggattgctttgagtaattttcatcgaggaacaaataacattaaagaacttcatcgagatcttttcaaaaaggagtatattaaattggagatgaaacctggataagctttggatgattatctttctaggttcaacaaaattttgagtgatcttaggtctgttgattcttcttatgatgttaattactcacaatctgaggtttctcattgctttttgaatggtcttgacatgtctgtttgggagatgaaagttacatcaattcaggagtctgttgatatgtctactttgactttggattcgctttacacaaaactgaaaacacatgagatgaatattctttctcgtaaagttgattctaagtctagtgctttggtttcgtcttcaacttctttggatgttggtgcttcttcatcgaagtcttctgtccttgctttatttaatgccatgtccgatgatcaactcgaatagttcgaggaggaggactgggttttgctatctaacaatttttctcgggctatgaataatgttaggaacaggaaaagaggaggaccgaatcattgttttgagtgtggtgcacttgatcatcttcgttcacattgtcctaagcttgggagaggcaagaaggaagatgatggtagagtcaaggaagatgacgtgaacaagaagaagatcacaaaggagaagaagaagaattgcgtgcaatggctaatccaagaattaataaaagcttgtgatgaatcagaggatgaagatgagagcaaaggtaagcagaaagcttgtgatgaatcagaggatgaagatgagagcaaaggtaagcaaattgttgatttagcttttattgctcgtaatacaagttctgatattgatgaatctaatagtgatagtgaagaaaaagcttagttatgatcaattagaacatgctgcttacaaatttgctaagaaatttcaaacatgttctattgtgcttgatgagaaggatcacactattgagattctaaatgctgaaattgatagattaaaatctttgattcttaatgatgatgaatgtgaatcttgtgaagttttattttctgaaaattaatgctttgcgagatgtcaattcaattaattgcaagaagttggaatttgagattgaaaaatctaaaaagttggagtcttcttttgctcttggatttgctttacatgctcgtgttgttgatgaattgattttgacaaagaatgttttgaaaaaatacaaagttgctttttgtgcaagttctttggtcaatgcttcatgtgcaaataaggcaaaacaaaacaaagatgttttgatttctcaagattgttcaaagtgtattttgaatgagttgaagttgaaagatgctttagggcgtgttaaacacatggaagaaattgttaaacaagatgaggtattttcttgctcaacttgtagaaaaagtgtgctattcttactccggaggtttcttatttgaaaagttctttgcaaaggttttctgatggtaaaaagaacctcaacatgattcttgatcaatccaaggttagcacaaataatcgtggtttaggttttgattcttatgcttatcatgctagacatcctcctactgtttttggtgctgctaggagaggtgaaattttgattgaaactgagcctaagaacactgtgtttaaatctgctggcatcatgtcttctttaaatgcatcttcttcaaaatctaatgttgtgcctgcaaaactttctgttgatgcaaaaccatcaatttcaaatccatctacttcacaaacttatcgtgagaagtacacttattcttttttggaaaagatggacatttggttggtttttgttttagacttgcccataaacagaaaaaggaaaaagaaattgcttttgcaaaatgacgttggcaaaaatcgggttttaattcgaggagcactgttagaccgacgttgtcgagtcagtcagaccggccagcggttagaccgcaggtgaaccgacggtcagaccggttgccaggcctgctcagaccgcaggcacaacgttcaagattcaatcgaagatacaaattccggaagtgttcaaaaggctcatccttagttgccataaagaacacccaagaatattgagaaattcgtcaacaataaccaacacaaaccactttcctccaatggattgcacactagctggaccaacagtgtccatgtgtagtagttttcctggtgcatccgtcgtcatagaaataataagagcatgtgaagaagcaaccatcttagcatgatgacatggtgtacaaaccaaatcaagacctttcctaagtataggcgaaccacaaacaagatccaaaccacttaacttcgtcagatgatcaaaaccaacatatacaagtctacgatgccaaaacatcaaatcttaaatgaatttagcaactaaacatgtgaccacgggtgaaacaggattttcaaaaccagctttaaaaactcctccatagcaagaaatattaaacacataatcaacaatttgtgaaactaaaagtaaattatacattaagtcctataccaaagctacgtctttgaattcaaacttgtcacttaccaagacagataccgtagcaagaaagatagttgaagcatctccaaagataatcgattctgtcttggatgcttgtttgagggaggagaaccaatttttatcactggtcatgtaccgcgaacaactggaatccacgatccacatgttctccttcctcgccaccaaatcctacacacaagaagacataggattggagaggtacaactcctcctttttatattagtatagataaactagcgtatgaggcatatttagggtttatgtctaatttatgcatcaatccatagccgatctagtccaactacatcggatgggatcactaacgatacgtcatcagcctcggccgatcggcaatctaactttccttgttgtttccttgctggtcgtagaatcgaaccagctggcacgctcttagcacactcgaggcaagccttggacctgcgctggagttaagcagatctcccaggccgccgtgtttctcgtcaacacgcttttggcatgcccggtgggacaaagttttcattgtttaattatgttgttggaaagagattggattcacaccagttatcatattccctcatgaggtgacgactgttggtatttcttagtgacactactggaaatataattcccagcaatagcactagaaataatcctagtatattatggttacagatatgatccacaagcgcacggatatacaattgtagcatttcaccagggagtattctaagttatcgtatttattttatcccaagggaagatatgataagagagtactaagatatatctaatttcgttgttttgatgtttgtccagaaattgtttgcctgcttacacctaaaaaaggtcagttacatatatatatcatggtttcttctgcaatccttataggaattctgtttaacacattcgtgatctacgattttgattaaaacaatgaatcgcgtttttcccctattaaatgagttgttttattgataagtttgacagcaaaaacccatataatttatttaaagaatactgagcattaatcataattttggggcactggcagagaacaaatattatcaaaaaaatttcttaatacaaactagcagctaatgattaattattcatgccctgtctctgtaaatccgtatatactgtatgtactctacagcatatacatattattgatcaatgccattcgattttgatcattatgttaattttctaatcacaagtaatgccaaataaacatcccccatactttgtccaaatacatttcttggaatgactacatgattctgttcacatatgtatatataatttatcagcctaatccatagttcttcttaattatcaacgtagaattttaacacaatggcatgtcttatggttaaattttttcacattgagaaggaaatatggaaagtcaatgtgcaagcaattagactttaggacaacataatccaaacagcaacgtatatgcacacataaaagtgattctaggtcccttttagagattaaggataagcgtataaaccaagatgtccgtcactaaataaggagtagttggagagggcaagggtgattggatttaaggctgagagaaaattaaataaatggtccaattgggaaagtagcactccaaatcccttataattgtggataaattacgagccttaaaatccattatactccctccaaattttaatagatgacttaattgacttttgaagacatgtttgataattcatcttattcaaaaaaaatactaatgtataatatataaatcatgcttaaagtactttgagtgataaaacaactcagaataaaataaattatagttatgtaaatttttttaataagataaatggtcaaatgtgtgataaaaagtcaatggtgtgatctattaataaacggatgtagatttgtgcatagagggagtacttattacctcaatgtcatactttattagcgtaaatattttttcatgtatggatagtgtttatgtttaatgtcttcttgcttatattacttgtctcatatcccatgttaaaaaaattttaggcccattaatagcaaatggtgaaaatgtacatgataacagatctcaaggtttcatttgcagcattatattgtccaactgtcaaccataattcagtcaacttcttaaacattaccaaacttagcaaaattagaacaaacatttatattttcaagcattgagagtgtttccaaagaaagcatacttttatggtaagatgtcaatatgaaaaaatataagtcatatttataatatgttaataacaaaacaaaccataataaaataaataatacttacgcaaatttttaataagacaaatgtcaaatgcatgtcaacaagtcagcaacatcaaacattataaaaagcggaagaactatattgtaagatgaactcaaacacaagtttcgatctgatatattaaattaactaagaatggacagaccctatctgagaaagaagagctaaaataatcgagctatatagatagaaactataaattgacttggtacaagcctccaaagctttcctcttgatacaaaatgtttcaaactataaaaccttcattttattttgctacaagccattgctacaaaaacataacagtctgaagtttcgtattaagcatctctaaccttagcaagaggtgatatatccatgacactatgctccaaactgtgtaagtttaattaatatcatttaatccatataagtattggcaacagtttatttgaaattttagcatatgcacagttgagacaatttgaagcacactatatatggagtgacaagaaggggacattggaaaatattttatttaactcacgagcaaatgtatattttgatataattactgacaaaaataaacttatgtataatgtttaaaagtattattcataccttgatttgtttatatatgtagattttgcaatccatgggatgatatacgatgacataatttatattttcaaccttttccataatcttcatgactatttagaaggcatgcaaataatcaacaataatgtttcatttccatttctcataatttgaaggaaaattacaaagtaaataatgaattcagtcgaggaacatcatggaaattgcatgtaaattaattagggtgtataagaaaaatgtcatattaataaaagaaatggcctggccattattctaacagttatcttagatagattgtagtatcgtgaccactcaacgttaaatcatatcaatagctcatattaaataaaacaagcaaattcaaattttttggacgatggatttaatatttgttaatttaatttcaaattaataattgtaaaattatagcaaacatgtccctgtataataaattcgaaattgtaggtaatttgaaaaataaccaacatttagcctataataaaaaatttactatatataaaagaatatgcccccatataaaagcccgtgcaacacacgggttggcgaccagtaactctaactctctattcagtgaccaggtttactctggtatacgattttccggacaagaatgtgatcccatctgtgcatccgcaattttacatacacggacaaggttgttaacagatgtataatgccaaaatagaatgtttgactgatagtttttgtc

SEQ ID NO: 60498 - DNA, 22640 bp, Oryza sativa
  unsure (1)..(22640): unsure at all n locations
aagacaaacggttaaacatgttttaaaacgtcaacgacgtcaaatatttagtgacggatggggtattaaacaagtgaatcaagatcgctacttgttcatacagattctttgacagattatactgatgatatttgcttaattgacacattgttgtactcctgtacatttttgcgataagactttgagaccaaccaaatgctcctatgatcgaagtattctgctaccttgtccatatgttattcgctaataccaagtagaaataaagcgtcatccgtgagagtagagtgatccctatgtcttgctctctgatgcatcccactctcattgtagatagtcaacaagttcatctcttcatcagttttcagtgtgtcagcatatggcttggctgtggatgcatttatgcgaatgcgcggtgagaattggggggggggggggggcaagaatgcgggacgaggcatctagtgggttgtgttgctggacggatggatgggaggtcaccagacagagctttgtgaatcgcgattttatatttacaaccatgatttacaaggactatatactggactctacaatcttgtgcatttgggttgtttgaacggataggcagatgttgaattttaataaacatggatggagaaattatattgttgttttaatgcatttacttctatggtcgcaattcagatgcatctacaattctacatggttgctaaaatatgtcaaacatatcatattacctactactctgtccaaacaataataagttccattcagagcatatatatatatatatatatatatagctaaaaatgcttatatttgcgggtggatgtagtacgtgatgtccacccaagtcttatcacatttttttttcttttactcatcacttcttgtcctttgtcaaaagtaactagtaaacacttgttagctgttatgaaaatagaaacgacgttgtttgcccaagttacgtccagttcccctctctttgcagtctagatgagccccggccatggcttgttgctgcatgatgaccatgagatgacaaggcaaacatgaagatatataaatcaagcgcatagtttttattgaaactggggatgggttaaagttatctccaggatgatgtcattttataatttctgggtatcataatggactattatgatttttggagagggtcgcttgcttttatgacgactgaaattcagtcttattaatagtatttctcccttttttttattacaagagatggatgtgcacacgctgaaggagctggtgaaaaattcacgaagctcataaatttccaaccaactgcacctcgctccattaattggtttcttcttttttttaatcaggttttaatctaaaaattaactgtccttaatgggaaagactcggctgctacatatatttatcctttatttgaattgaacgtatttaaaattattatttcacatcacatggttttcttgacattatattgtattggatgttttaccatattttttccttctaattcaatgtgtttacatttttatacatttacaattgtaccatgaagcaaaaaatagaaacactttactgagtaatggatgttgaatggatttttgtagggaaatcatcaactatgaatgttcgttgataatttaacgaaattatgacccgaatacgcaagagaacggcataatgcattcaaaagaagaagaagaggacgaggtttgaatatttacaagacacccacagtggatgatggaaagggaaaggaaaaaccaccaaaatcttccgaaaccaataaaaaacctgaaatattgtaaatttaagtttcctagctagttcttattgggaacgtggactttgaatatcgaaactgcagagtcatacttaatcacggaaaatataagaatttaattttattgtttgctaagaaatgatttagtttatgaacgatcacagctgcgaaaagcctctttagtcccggtttgtaacccctttagtcctagttggtaagaccaaccgggactaaagatccctggcacactgacaacccctgactagggttaaactttttggtttggcagatttgatcgggcatcaccaaaataccaaaatttccaaaattttgaacaaaacttagttgaatttgaacaaatattaccaaaattcatgaaaaaattataaaaatgaaaaatttcagccgaaataatatcgtatcggagaggttcgaaatgactgaaatttcggaaatttcagtccgaaatttccaaccctgcccctgacagaaagtgaaccgggaccaaaaattataaagtcccattgcgattttaaaccggcagtaaaaatgatctttagtcccgtttcctattcgaaccaggactaatatcatttttgcatggcccacaaaagatgagttctccagtagtaaattcaaattaggtgtagtgtcaactgtatagttttttactgatgtggcaacatatatccatgttgttcttgcagtacagctcttactttcaatccggcaaagaaattgtcaggctgaattacttacaagctttagtacttgtgggattgttttcttgtaagaagatagatccagtgtacattggatatcactaaattaggtcatatcatttgtttagatatagggaattacaggatatccattatgtcaaatattgacccgaagttaattatttaaacaagaatatggattaatttatacaagtaactctatctgtaaatagttgaagacattgcaggaagcagcacgaacttttgtaaaaatatgcatcatgcataaacatctcgcaaaaaggggcatattacacttctgcaatgtgtaaccatgggtaagaagaaaccattcaacatattttcttcacttgtccttttgcaaaacagtattcggatttcatttgttcaacaagaaatcaaaatgtcatggtgcaaccggcaattgaagatatcaagatcaagatacatatgactttttatatggaagaaattattgctatggcttggagcatttggataaaaagaaacaacaaaattttcaggggcataggtcctcacaacacaagagtttgcaatggttatccatagggcaaaacatagttattaccctctcattttttttaagggagccccacatcttacaatggttagaaagtttgtaacataaaacctataaatttcgtagctctgtttataaatatataacaatatatatgttatatgaatctttcatacagtttttaccaaaaaaaaacatggccatattataggtagagttgtagtgtatatatcatatatactaaatcaatagcacgactcctttatcttaatatatatatcctttttcgagcgtataaaaaacatttactaagattgctttatctactgaaattatttagttctgtttcaattatgctcttcttaaaaaaaattccaggcaatgaagacttgtgagtgtgggtgtgctaggaaaaagcgctagaaattatgcaagtcaaagtttttttctagaagtacaatgcagatgtataaacttagtacaagtcacaaaaaacacatgcatacatataacttatgtcctttataaatgtcatatctgcgtcaccagcacaactaatagtttagcttcgatttatattattgaactgattattgtcgcaggctatcaacttcattaagtatgattaaatattttaacgattgaacttaacaaatagctcaaactaaaccatgtaagcaatttagtaaaacaacgattttcttactgaatgtattttctttaaagaaagagccaaatttaagaatctatttcaaaaaatccttgtcctgtgcatgtcatagtgtgatggacgacaaataaatagaacagatcctgaaaaacaacaagatcagtgagtccagtgcttagaaactcaataaaaaataccacctcccattctcgccttggtctgacatgagtcactcactgggtcatccacccagcagcggtgctagtgcaaactgcagcatttgtgtacagcgagaatgggatgcatcaggaagcagagagctgcgccgtccaatgccacatgccgacctgtgtctaggttctttaccagagcagacgattcggaacatggtgacatgtactctatattgctcctccacctagctgcaagcctgcaacaagtgtgagaagcttccatgtacgagtagacagctagaggagcatagggtttagagcattcacctgctagaaggatggctgcaatcaaccactttgcatcctgcacccatgagacagagtttcagaactgtgttcatcctcatcgtgtggatggcacggaaggggcggaattcgtgagtcttctctgtttttcgcctgtgacaggatgccaatcatctacgtctcaagaacttttattctccgagagacgcgagaaattaagttgaagttgaaaactttcttttccacatttaaacctattgtctggggagtaaaatgcacgagtcatcaaaagatcctcaaatcttgagtgttgccaaaaaaaaaagaaaagaaaatttccaattaaatgtacaaataatgtgcatacagtactgggaaaatatttttacatgcggtcaataatccagtaatacaaatatttcatgaactaggaaggtggcccgcacgatgggcaagcatttatattgttgaaagatgagattatatttttttagaaattgtcttataggtaacaaacttatgatcgaacaatatcctttggaaattgatttgggggttctattttcttaacgtatctcaaaaagcattcattgactcttcaatagaagatgtatcaagtaaatattatactaccgctagcttaattatcaagcatatcacttgtatacataccattcaaatatggctataagcgaaaattgcgagattaaggaactcaaaatgaatgatcttatgaaggcatatgacaaataaattaaggataaattaaaagttggattacaagttctcaatagctatgaagaactttaaaaggttttggtgcatacagattacctacaccatcgctttgcttggtattgcaaaatatcaacattgtttgaagctaatttctttagttttggcaagtttggttattttcctgaaataatatttgtctaaaataataccatagttgtataaatttaattagtatggtagtttacttataaatttcgaattgttttgtagtaaagtttttctatcatgtagtctggttatatcaataatatagttttgttcaataaattgaatattatttacaacaccagaattaataaaaatttatgaaaccatccatgactacttaattttttttggttttcttatttgtttattttaaattcaaataatcacatattctccttctaactggtatgtttgtcattattcataataaaaaaaattccttgtacaactgacacattgatgttttcactcaatcacatataaatgtaaaatattttttcattattcttggaccgctcattcctcggtggtatcctccactcatctatcatcttgtcatagtcgcatacaccatattttgtctaattttttagtttacatatggggcgacaccacgttcctccaccctcatgcatggaacacagtgtccaaaatgttttttttcgaaagcaagttcttaattaacccgtgtaatttattagaaaattacatgtgtaatatatgtgtatgtgatacatggtaattccaaagcagtgcttgattcttcttctttctacattgcatcttcgtgatttattttcatgttattaaaaaaaataatcgttgtccattgatgatttgataagtcctcactttagcaaggcagtagcgctacaacatcatgatcaccttagctaccttaggtatacgatgcttcatcatgcgtgtagaaggtaaagatgtcacatgtgttgtatagagagacaaagaggacttccaaggctttgtttattttaacaaaagatagatctcatggtctaaataatatatccaccggtttaactaaaaatcaacaaacaaatatttttattaggaaatagtctaagataatatcatataatggtgtaaactatatttttaaatattgtagatctagtttatttacatctgttaagacttatatgctgatattcaatgtttataaagcagctattatttatagtgtctcaaactaaatacatggaaaaatcgaaagcaaaaaagaggaaggttacataccacctgagtggaaggaagggtggaaccgtagtttaatctaacggctcataatattggaccgatcaatttaagtggaaattaaggatatatgtcttgcttttttctcaaattttataggatttggcaacttgagagtgttttgaggaagtttaatcgacatacgtcgtatgatttgtttgagacacttatataacgataatattaagtgaagaacatctaccacgttttctccctaaattgttttcgtcggctttgcttttataattttgtaacctaatagttacctttatactatatcgtatatcgtagttaagtaatacatagaagcaattatttataatgttattcatcgactgtaaagaatggtaggcttattttcctcaaaaaaatatgtctactaaaataagtgttaaagtaaaattaagacttttttaattggatataggttattgttttctattaactagccgccaaccacgtcgactcgcgtattgcacatgtaggtggccggtgcgggagtttcgcaacattcatttgctcgttcccgacgacatgaggcggctagctgttgtacgatgctgattgcacggtgaatgtggtcatggatataacactcaatcgaccacctctgcctccagggaggacagatcctgcaacctccaggcagaagtctcggttcgttctcagaagtctatggtaacagccattgaaaataatcaactttagaaacaaaatactttcccgtttcagaaatttgaaaactcaagttccaccatatttgaaaaacgtgtaccaatctaatgatatcacaagcataacactaaccacgtatatcgttagttcaaactgaatgttaatactaaactcaaatgttaaatctcctaaaaacaagggagccctatattttttgggcggacaaggtagtatttattgctcaaatcaataatatctgaaggtaccaaattcaagacaaggaaaatcgtcgactcggtattaagattacatacatgtgcagcggcgagcggagggcgcctgacggtgcgtgtagttacacacggatgggtcgggcagatgggtggctaggagctctccaggccagggggagctccgggagaatgagggaataccaagtcgacgacccctcattctcgcgactgagtccgggaggatgaggggtcgtcaacttggtatttatttccctgtacgtaaaaaacttggtattaagattaagatgaagatgaagatcaagttgtttcatagttcgtttctcctgaagatgaaaatcaagttttttttacacaaaacgtggtggtatcaatatatgattgattgagttttaattattacgaacttgaaaaatatattaacataatattatagagcaactttcatatagaaacttttcgcacgaaacacaccgtttagcagtttgaaaagcgtgccacgaaaatctttatcttcgtccaactcttgttggagaaatgaacatgacctgattatgcgcataaaccttcagtgatggaagataaaacgatttggttataaaattagacgagtcgtatcatcaatcattaactcccctacccgttgcgattttctcctttttttgaattttttttcggctcctcggggaggtttagcgtgatttgcaattttgcaacaagctcttcgcatttgcacgaaatattacaaatgttcttaaatgaccgataccccgttgtcacttatccggaaaacaccttgtctttcattgaaatacaatggtaagaagagaaaattgcacttgtagggtagcgctgtaaaaaaaacaaaggcgtatttctgataaatgtcctaatctaacccaaaccctaccccattccctccccatctccatcacctcagcgccgccgccggcctgcccccgcccgggcagccccccctcccgtccgccgtccaccgtccaccgtccccctatcgccgcccaccgttcccccattgctgctgccgccgccttcttccctctgccaccccccgggcgccgccgtcctcgccggcgaattcgaccacctggtggaaggggagggtcgcgagccattccctcaccctcccggagctccccctggagcgctcgtatccacccatccgcatgtacctacacgcgccatcgggcgccctccgctcgccggtgcacatggccccgtccccgcccaccgcgcgtgcgccgccgctagagccatctctgcctctggcccaaggaggtgctgttgctcgacacggtctagagcggggccgacaggaacaggctcgctgcggatgagtctatggaggggagaccatgtcagaggggaagctgcactagtggagaaaccatctttgcccggtcgaccaaaaaccagaataggtcccggttgcagtaaaaaccgggactaaagatggtttttactcccggtttatatgcagaacgggactacgtgaccaaccgggactaaatatcatctttagtctcagttcacatgctgtcaggtgttaggcccctccaggatctttagtcccagttggagatacgaaccgggagtaaagatcggatctttaatctcggttcgtaacaccaaccgggactaaagatcacatctttagtcccggttggtgttactaaccgggattaaagatcaaaacacactatataatccctattacttatcatattttcccatccacacaaactcctctctctctctctccatctctaatccttatctcatcccttcttcccttcctccttatctcttttctttcttatcccttcccgtgtgcacagcaggagtgggtgggcgggccggccggcggagggcggcgcggcggcggcgggggaggaggggaggcggcagccggcttagccggccggcggctttgcttccttttttttctttttttttgaagaatttgtgatccatgtatagattgagatgaagaatttgtgattcattgcatggattgagatgtataatttcttttttagaatctcattgcatggatctgagatgtacatgatttgtgtatttgggatatttctttgatttgggttttgatttgggatgtataatttgtggtgtatatgattgatttgtgtatttgggatgttactttgatttcgggtttgatttgggaatatgcatcccacctaacttgggagaaaataaattagagattaagtagtaagtagcaataaatgaaaaaaaaaaactaaccgtgactgcccgctcccatctttagtcccgggtatttgaaccgggactaaagatagagatctttagtcccagattcgtagtcccagtttaaaaaccgggactataggggttatgaactgggacttaaaacgatttcaccaccagtgctggagaccagccaaggcggtggacggtctggtcgaactccaccccgcctgagagagcggtggacggtctggtcgccaaggtggtggtggagtgcgagatgtgtgggaaggcggtgagcatggtggtgacggccggagggcacaaggctggtggagtgtgacgcgcgttgtggcggagctcgccgctgacccagccaaggcggcggcagggagtcgggagggtcgccggtcgggcagagctggacgcactgtacatgaccacgtcactacgacgacgtcctaggacgttacacgtcggtgtgcagggtgagagcaagcctccacggcttcgacttgatccagggctccacatgccgctgaagctcaccgattgtcgcaccagatgtagtggatggaggaggtggcccagagcagcccatggaagcggcacaagcacagaagagcaggggccgatttgggttcatcgccgaggccttgggggtcatgctcaatgtaagtgttgttttctccgaacctatgacaagccacttaatattcaggattgctaaacttttgattaatggatccattgatctgcaaaagatgtttggcaaatggagtgggtgtggaagaactagattgattaggaagcattatcacctcccgtgggaggccgcatgaatatattgattgagccggcaaaacgcggcgagagttacagggagtttgttacataggataagcaacacaaaagataagaagataaccaatctaatcctgaaacttatctctactctaacagcccccctcaatcatgactttgacaagttaagattgtgctgaaattcatgaagtttctgaaaactgagcgatttggtgaagccatcagctacttggtcattagtagaaacaaatctaacctcaagaagcttctgcacaacccgttctctcacaaaatggaaatcaacttcaatgtgctttgtccttgcatgaaatattgggttagcagacaaataagttgcactcaaattatcacaccacaatcttgccatagacgggcattgtataccaagttcctttaacaaagttttcacctagattacttctgctgttgcattggccaaagccttgtattctgcttctgtactagatctagatgcagtagcttgtttgcgtgcactctaggatataagattacttcctagaaatacagcaaacccactagtagatcttctatcatcaacacatcctgcccaatcggcatctgagaatgcacttacaagcatagactgagatttctgtatcttgagtcccataccaagaatatttctcaaatatctgataattgtttaaacagcagaccaatgtgtcaaagtaggagagtgcaagaattggcataccttattaactgaaaaggcaatatcaggtcgagtcaatgtcaggtactagagagctccaacaatactcctgtaattagttgcatctccaggacctaaaagactcccttcctgtacagataatttttctgatgttgacaaaggggttggcgcaggcttacaggtcgacatacccattctcttcaatatatcatgtgtatatttatcttgagacagaactaaaccatcacttatcttctttacttctatcccaaggaagtaattaagatcacccagatctttcaaggcaaaatccatcttaagatcatgaagcaaagagctaacaacatcttgtgacgaacttgcaacaattatatcatcaacatataccaagacaaagatagtcacactaccttttctatagaaaaataataagatatcagcctttgaaggactgaatcctaattgttgcagcttcatgcttaatctagaataccaggctctaggggcttgtttcaaaccatatagggccttgtcaagtttgcaaacatagtgtggcttagatttctcttcatacctaggtggttgtctcatataaacatcctcctcaagaatgccatgtaaaaacgcattcttcacatctagttggcgcaaactccatcctctagacattgctattgaaaaactgttctaatagtggtttcctttaccacaggactaaaagtgtcttcataatctctgccataacattgtttaaaacccttagcaactagccttgctttatatctatctattgtgccatcttcttttcttttaaccttgtacacccacttgcaatcaatgagattactaccatcctcaggtggaactagatgccaggttttattttgtttaggagcatcaaactcactatccatggctaccttccaatccttatgttttaaagcctcttctagactttcaggttctccagtagatgtaaaacaaccatacctgacacagccattagtataaacattgggcttgcgcacaccactttgtagcctagtgtgtggtcgagggatgtttgccgctgtatcctccgccacagaggatcctgaaaccagctcttcctcatcagtgcgcgtaccagatggcgagctcacaatggtcgacgcggcatgcggtgagggaggtggcgatggaggattgggcgacgctggtgcaaaggacggcgaggcgagagaatttccccctgcgctccacacgtcagttgctggatcatcggtcgcggcagacgatgattctgacgtcgattcagcgcctgtagcggagtcaatagcagccgaatcggtctggtgctccgcggcatctgttgctgctgatatttcatgtgaaatctgcaccgaatcatcagcaaaactcgcagaattttctgcattagacatattttcaggcacagtattttgattagcattattaggcacatggtcacccccagaaaaaggaagaaaaagaccgggagtaagatcaatttctttgcgaagaagtgcaccagcattaggatggagctttgcaaaggggaacacattctcataaaaaataacatcccgagaaatgtagatgcgaccggtggatacatgtaaacatttaaatcctttgtagagacggctatagccaagaaacacgcattgcgtggatcggaagacaagtttctttgaattgtagggtctcaaattaggccaacatgcacacccaaatgtgcgaagggaagcatattctggtttttgatgaaagagacgctctaggggcgtatcaaaattaatcgtcttggccggagtacgattaataagataggtcgcggtgcaaaaggcctcatcccaaaactttagtggcatagacgcatgagcaagcaaggctaaacctacttcaacaatgtgtctatgtttgcgctccgcagcaccattttgttgatgtgcgtgagggcaagagaccctgtgagagattcctattttagtaaaaaaggaatttagtttttcatattcaccaccccaatccgtttgcatagcaattatttttcgatctaaaagcctctcaacaaaactcagaaattcttgaaatttttggagtacctcagacttgtacttaaggaaatatatccaagtaaatttgctaaaatcatcaataaaactcacataatagttctttctgccaactgaatcagtggcaggaccccagacatctgagtacacaagttctaaaggaacagaggaaatactgctagacttaggatagggtaattggtgacttttggcttgttgacaagcatcacacacagtttctttgttggactcactagaacacaaaatattatgcttcttaatgacatgttgaagaacaaaagaggacggatgccctagacgactatgccactttgacgttgagggtttgatggcgccatatgcttgcttccctgtatccacggatctgggaggaaagggataaaggccattcctacactttccttgaagaagaggtctcctcgttgttttgtccttaaccaaaaagaatttatcatgaagttccttttggcttgaggaacataaaggacatcattaagattaagtgcccgaattgaagtaggaatctgggtgtgaccaatgtgactaatatgcatacctgagccacttgttgtatagatttgttcgccaccattgtacctctcacgcacggagagcttgtctagctcgccggtgatgtggtctgtcgccgccatatctgcataccagttggtatcggtgttgttgccatggattgctgcagctgcacttttctccggaacaaagtcctcgttgtaacggtaccagcagttgccccccatgtgaccaactttgccgcaaagctggcaagttggacgatttcctcacccgccaccattgctaggtggtctgccgccacgccacggtttccgccaccgcgaccgcgaccgtcgctgccgcgcccttgttggttgcctcctcgtccccgcgaagccacgttcatggagtgttaggccgcccgacgactcaggcgctcctcaaagctgaggagttgagtgtatgcgtcggcgatcgtcactgcttcagtgcgcccagtgatcaccgagaccaccgggtcgtattcttcatcaaggcctgccaagatgtatgcgacaatctcctcgtcgtccattggctttccagccgctgccatctcatcactaaaagacttcatcctgttaatataatatgtaattttcagattacctttcctggttgtggtcatcgccacacgagtattgaaggattgtgcccgcgtctgggagcacagcatgttctccagagtcctccagagctcggctgcagtttctattgacaccacctgtgtcaggatctccctcgtgagggaggaaaggaggtagctcaagacttgttgatctgcaaccacccacttggtgtactctagattggtggctttcaccaccttctcgccttctttgacgtcgatgagacgggccggcggcgctgtggtgccgtccaggtagcccatcatctgtgcgtcgcgaacggccggaagaacttgtgtcttccaaagcaggaagttgtttcttcctagcttttcttccaccggttggccgaatggagaaggggacgccgttgccatgacggaggagctcgccattatcaatctagatgagtttgaggagtaggctctgataccatgtggaagaactagattgattaggaagcgttatcacctcccgtgggaggccgcacgaatatattgattgagccggcaaaacgcggcgagagttacagggagtttgttaaataggataagcaacacaaaagataagaagataaccaatctaatcctgaaacttatctctactctaacagtggggaatcagaattcgaagtcatgggggttcctggatagtgcagaactgcacgtgcatgcccttaattaagacgccttcattttctgaaatttactgaaacaccaagcagtcggcaacccagctctgaattagagtcacgaaagtttctctgtttttcttccagattttcctaaagcaacttgccaacttctaatattggttgcacatgttgcttgaataaggtttagatgatgaagagatttctttgctcaagttggatggggatctcttttagagatctttgatttctacagttttaatacttcctccgtttcatattataagactttctagcattacccacattcatatagatgttaatgattttgtgtctagattcattaacatctatatgaatatgggtaatactagaaagtcttataatatgaaacagatgaagtagcattttttcatcattacagatgtattgggttctagaattagcagtgatgcattacaggcagagtttaccctctatatttgtttgaaccgatgcgttttctgtaaaacttattatattgggccttaggtgaggatcatcgttttaactactatgcatataaccccaactacatgtttttgacatccttaatgatgggaataatagagcccttgtactgattttataagctgtagtgattgtttcaaactgcagatttaactacggactcactattctttgcatattatgatcggtaatagagtacgctcacttttacccaactaaattgaagtaatatttatgtttcttccatctgctggtggtgttcatattattgttgttccagtcgattgtgtcaatgaataatatggtgacttttaatcatcgcatgattcaaaacctgaatttatctcacgtgttaataaaatggagaagggaactattcttcttcacttcctggttctcgctgtgtgatctactgaatcttcttctcgcattttagtttgcatcaagttcctttcgacaagattctatgccgcgcggcaaataatatatgcacctgttttttgctgagattgttttcttctcttctctagcacttactgtcacctttttcttcagatatttacatgggaacaaacttactgtaggaacatgagtaaatttaaaattatgttattcgcacttgtgggcaaaacgaaccgcaaacgtgttctgtatttctgttaatttattatacaacctttttctgtactgtacacccccatatactttcattgtatgcttcttactaactctatgcacatgttagcgtgcgcggcgttacgccgcccttatatttctagtactactagtgttttactaaggctgattctgaaggaaaccagagagcaagtccacaacagatggctaagggtcatccatatatatcactttccattagtttggtaaggctgtgcccttttcctctgtttggagagaaagttcattagtttggagagaggtttttaacgcacgccaaacgagaaagctcaatagtcccacacgtcattcgcacgtcacttagtttagtgcaaactgcagaggagatgagcttgtatcttcattctgtgaaatgagagtgagatgcatcagggagcaaatcaaaggattgctgatgctatggtgtaggccagtgtgatcctaggtagaaccagggaactacagagggcgaagatgaccaatgggttggacaattttatttttatgcgcataagaattcgagcagaattgtctacgagaagatcactttgtcaatcaagcaaagaccaccagaatattccatgaataatgataatccctcaatcctgaagtagtaggcatgtcggtcttcttttgcttggctcagttatatctgttcgtttccaatgaagggctgtttctttgagccacagttatcactgcatgattcatctaatacatgaaatttcgccacttgacatgaattcagttcctgcatgcccattcattcaaacaacccaattgcattcactatgaatgcaatggatcatcttctaaagcacaagatcctcttcagcgatgcgtctcatcagtaccatttcccactcccgtcgtctaggcctcacattctgtcatttatttggcataatgctagtataaacatgcaaaagagaggaactgataggtggaaccgtggaagtgaaacacaacacactgtaatcaagtgttgcttattcttgactcgcacatcgccacgtaaattgcttcgcacaactagtaaagtagtgcagaataaatagctcaagcaaacaccccatgcctcctccctatatacacacttggcccacaattgaatcagaaggagggcttcctgtgaatcagcgatacaaaatagcacatgcaaaggttattcatcactcaaacaaataccctaaactttccattggaagcggctggaaaaagaacgcgtaccataagaatgagaggcactgggaaaagaagaagcagctccaggaaatcgtaaagttaccgagagcattagtgctgtagtgttcagttcaatttcatcgcgatgccgagtgccgacatatttctccactcggattagtgctcagcttaaaacaatagaaggacgactggatgaaattgtttttggtttcctaaattgaaaataggaagtgaaaaaactcctccctccaacaaatagcctaaattcaatccccaaaacttaaaagtggacccttctgttaaactaccaacagaaaattctgtttttttatttcacgcgcagaaagatcgctatctcccacgtgcgggaatgggaggagagaggcgggagtgcgagattgggagcgaatttcacacctacatataaacggagcgaggaatcgggagaaggtaactccaaaaatcgggtaggagagttggggatctgtcggagctgttttttggactaaaatccctcaaaatcagttttgagaattagataggtagactgttggtgatgctcttaggacgctactgcttatgtggtgtggggtcccaaggccgcttctctgatggattcgagctgtcttgatacctataagctcaaattgtacggtgccatgtttagtagattggtgccgtaagtaggtaataattttcttcaattcatcaagaatcactagattacgttgtatgtgtgtagttcgtatatcgaggatatctctctgttaatgtgatttaaacacgagagtgtttctttgcaaacaaacgtatgaaatcagagtgcaatccgcaaattataaggttcaacaaaaagatccaatgaagacatgtactccctccgtttcacaatataagtcattctagcattttctacattcatattgatgtgaataaatctagacatatatatttatctagattcattcacatcgatatgaatgtgggaaatgctaaaatgacttacattgtgaaacggagggactagttaatttgggttcatcatgtttccaagaattttgtgataaatataaataaaaataattttctgaaaaaaacaatcaataatgatttctgtacatgaaacctatcgatctatgaggataaataagggtgcgttcaaccgaccaacgtccttgagctttttagctgcacagaaaatgaggtaagtatttaagatgtgataaataaagttttaattattagaaatttgaaaaaataattatttgattttatttaaaaaactgttatatcaaaagttcttttaaaaacatatcatttagcggattggtgagcatgctaataaaacaggtaacttgcgattgcaaaaggagaagaagagcagggcagagatttaaatcctcttgatatctccaaatataactctatacatgcacaaaatggcttggttatgcccattaatgatctcttacaacttttaagttataaaaataagattatttttacagcccagagataacaccataaaaatgtgtttttttaagtagcctcaaaaagaatatgagtcatctattcacacgacactacgggacagatagttactattggaaagaaattgtattgcagatagctattattggaaataaattgtattgcataagaatacatttcaaggaaaagagtgaatgccaaaatctcgcgacgagacaaacgaggcttggcggcacaaagataatttggttttcctccatcgacacaaatcacaccacgtgggcaccctatctccacgctcgcacaataacaaatctactgacagggaagacagagattgtcagttgtcactggcctcctgttcctctcttttaggaagaattgcagcgagcacaaatttagggtttcatccaattgaaagtaacataatcaaataatggtcaaatagttccaggaaaaatcacaaaagctagaaatggcaaacactcagttccctgttgaagtctgtagtctcctgtggtgaaaacctatagtataggatttgctgaccggatcatggcagcggcaactacctacacacggcattccctttttagaggcctttattacagtccaaacattactatgtttgagtataatgataaagattgtttgtggttataactcgctacggcttgatatctttttgtcacatcattcttccttgttttataattatagattgtgtacgttctaactatgtagagcctatatttggtcctagattaattatatcatcgatatcttgatgttgttttctgagattaataaaaaaattcatttataaatacaatggattttcttcaaatgcaaaatacatactatagagtgttgcccggcctacttaatatcaagtctccatccaccgacctctacgtcctgtaataataaaccattgaaagtatgatagatatggttttccattactttatagccttcgcattgtcatccatcaagccttatatatagccagtgtaatctatggatagaggggaactggttggcattgtacaacgagactagaatgtaccacaagtttgtgactcattccacttagcttgataaactgcttcaataatatgtcttggattctagagaactctaaccgacttgattattccaccagctcgaggacttttgaaaagccacaataaacagttagcacattgaggtcagttcattgaaattaattagaagtcaaatatcctaggaatgagaagctcctggaaaagaaatggttactcaagagtgacgagaagtcaccacgaatactagtgctagtgtctttagttcaacttcatctatgtcacaacatgttagtcagcttccaattcatgtcactatagcttggcattctccaatacctacctggaggaactttgttgtactagagtgcagtattagatcatattgtcctctgaaacgatttcgtacacagaaccatacttcatatatatgtgaagccgtacacaaccgtgggatggattttgatctgcatatatttttcaagtcaagataatccatatttcccttcaacaagagaaggcaaatgttatgtgtagtatggaattgtactcataggcgtcctaatgattacaacgatatcaatttgttaaccatatcggttattacttacagaacctgtgtcgatatggtgcaaacctgtttcgaagggtacaatttgacatggattacacaatgtcacataaacatgtgcatacatgtcctccacatagggttgaaagttgtcagaggcaaaaaggcttcttttagataagtaacatgagaattacatctccagcctctaatgcacataaccaaaagttctaataatttaaaaacatgacacatagccataaaaaggacatgtgtgtactcctaatattgaagctttcgtacccaagaaaacaaggaatacgcaattaaatctccccaaatcactagacggagaaatataaatggcatgtgacacccataactttccatcttacaatcatatccatgcaaagctgtcctcaatgtcgtcacatatattcatagcggactctcacctttctcttatgtctgcatggtatcctacttgcaaggcccgtttagttatacaaactgacacgaatgattgagagcctaaaaatgcctctacaagacaaaattagcaaatacatctagtagatgtcaagagtgcctaaaaaatttctttaacgcagaactattgtagacgattttaaaattgcctctataacttgttaataggttacggaactctatatttcaatatagagatgattcgaaaattgtctctactaatgtatcgctatcgaatatttttgtcgtagtacaacttctcataaattcttggcgtattcatccatcagttagaatgatccatccgctttcattttagatgcacgatattttctgaaaaatatgcaaaacagagtccagtaggctgctcaagaaattgatgcacaccaaggtatttcaattttcaactcacaaataactccatcaacgataggaagctccctttcagcaacaataaaccatgcctcatgtcattcgcattgggccagaaggcagaggtccgtaggcagcccatattatcaattaagttagagataagattattagttaagttagagataaaattagattgaattcttacttaagggtcaagctataccatctatcaattagtctaatctctccctcccagtaatgttcttctctctagcataaatctacatcccttctccaggagccgatgccgcccggctatcttcccggtggtgtttatcctgtcatggtctcgggtcatgacaacttggtatcaaaggcactcaccatagcttccgatgccgaacaagttctccatgtcactatgagcaatctgctctatccagtgacagaggatctactccatcgaggatttacatgtatgagatggaaacacgtgtgaaagcttcggttcaattccaatctcatgaggatgcggagtatggacaaaaaaccttccacggacgcaacttctacaatggctgctatcggatggatatacatcttgagttttcatcgccggctgcaatcagcagcaactccacactgacaacacctttctccctgataatcgaagagttaaggactgacctgaaagaattggcggccacgttacaggaaaagttggtgaatgaggaggagaggcgcaccagggaggcggggctgcccttccggtgaagacagcaaggacaccgctgcttgtgtcactgttgcctcagttttctccattaaaagccagttcctcgcaggaagaggaggcatcaccaacgataaatgccaccatcaagaggcgtcaactattgacctgatgttgcattgctagagtgaaactgcaagagtggaagactgacgttgtaaaatgagatccggaatacatctcacaagttagcactgattattcttgcctcaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60499 - DNA, 6861 bp, Oryza sativa
agaagccataaccatggaaaaatcaaatatccaaagaaacaatctaaaaccgaaaccgacacagcttcgaccggtcagaccgcgggccagccggtctgaccgctcgcatagcaccggtctgaccggcaaccaccacccggtcggactggaccacataaaataatagcacctgtaaatccaatcatccaaaaccactttgacaataaactccaatatcaaaaccaataatcatagatgccaattgttcatcacagaataagaatcaaaacacactttgatcttacaatctcccccttgatgaacacattggcaaatccattaaaaatgttttggagtttggaaaattaaaaacaaatgcggtaaaaagcacacttcgtacacatgtacacatcgtgctcaaaactccaaaagaaaacttctccccctttttaaaagaaagaaacttcgtacacatgtacacatcgtgctcaaaaatccaaaagaaaacttctccccctttttaaaagaaagaaattcccaattgaaccaaaaacaagaaaacttctcccccttttaaaagaaagaaattcccaattgaataaaaaaaacatgctcttctcaaaaactcttctcttctcccaaaacacaactcttctctccaaaacttatctcttctccaaaagatccaaaaattttcacattatttctcccccttttaaaaatgatttcatcaagcatagaaattatgttcattaatgtataagagcttaacatacatataacatatcatgtcatgtgttgcaataaaaagaagatgaatccatctataatataagaagcatgcattaaagtataaccatgaattaaagattttacaattaagcttgattcaacaatcaaaattcatgatttcaaacgatttataatgcaacatcttaacaagcacatagattaaagaataaacactaaacacatatacctattgcttttatcactctttctcaaataacctttagcacaaaataacaaagagaatttttaaccttttcttttcttgagcctttttgcttatatttttctctttttttattccgagtacgtccctatcgtcaagactgtttccagggattcggcacccattattttgctcacatcgaatatgtccttgtcgtcaagattgtttccaaggatttggtattcattttttttatatttttattctctttttcacaataagcaattaaagctatttgaggaataacaagtcaataaagcatatatataaagcatttaaaaatcaaaccatatactagcatcaacattgcatatttacttaattcaagtataatttaagtgtcatgcatcatctcccttaaaagcaaaatctaaatctcatgaaaagactagaatgcatacaagctatgctagagacaaataaaccttcaaagtattgctagcatgcacaaaaaaataccatatgcataaacaaagctctcttttatcaattttttcattgtcaaattattgcttgataaaaccatgaggtacaaactccccctcaaaccatgccaaaagaaattcacgaataagcactaactccccctcaaaataacctccaattctcctcgaacaaaaaacaagaaaaaatcaaagattttgaaaaattgacatccaattgccaaagatatcacaaatactctcaaaattgacatacattcattagtatcaacaaaaactacaatctcaaacactagcacatgaaaagctaataatcaagaaagtagaacaatattatgtcaatccaaaagtaaattgatgttaccttgaaaagcaatcgtcatctcaacattgaacgcacatggggagtatgccaccaaaatacctacaaacgtgaagatgtcgagacctccgtgttggggttagaaataagaaattttggaatccaacactaagtcacacgaccagtagaaccagtaggtacaaaagcactaacaaaatcagaatcagacttacctgaaaacttaccttgacgcttcacaaaagtctgatttgaattgtgcgaaaaactgccccgagaccggtctgaccaccgctgtgcctgcggtctgaccgggcctggtaaccggtctgaccgcccgttcacctgcggtctgaccgctggccggtctgaccgattggacaatgtcggtctaaccgtgctcctcgaattaaaacccgatttttgccaacgtcgttttgcaaaagcaatttctctttcctttttctgtttatgggcaagtcaaacaaaaaccaactaaatgtccatcttttccgcaaaaagaacaagtgtacttttcacgacaagtttgtgaagtagattgttttgaaattgatagttttgcaacaatagaaggttttgcattcacaacatttgttttcgaagaagatgcacttaaagaagacatgatgccagcagatttaaacacagtgttcttaggctcagattcaatcaaaatttcacctctcctagtaatacccaaaacagtaggaggatgtctagaattatgagcataaggatcaaaacctaaaccacgattgtgtgtgctaaccttagattgatcaagaatcatgttgaggttctttttaccatcagaaaatctttccaaagaacttttcaaataagaaacctcttgtgtaagaacagcacaatttttgcaagcatccaaaagacctttttgttttctacaagttgagcaagaaaacacctcatcttgattaacaatctcttccatgtgtataacacgcccaaaagcatctttcaacttcatctcattcaaaacacactttgaacaatcttgagaaatcaaaacaccattgttttgttttgctttattcacacatgaagcattgaccaaagaacttgcacaaaaagcaactttgtatttttttcaaaacgttctttgtcaaaatcaactcatcaacaacacgagcatgtaaagcaaatccaatcgcaaaagaagattccaacgttttagatttttcaatctaaaattccaattttttgcaattaacagaattggcatctcgcaaagcattaatttcagaaaataaaacttcacaagattaacaattatcatcatcagaaatcgaagattttaatctatcaatttcagcatttagaatctcaatagtgtgatccttctcatcaagcacaatagaacatgtctgaagtttcttagcaaatttgtaagcagcatattccaattcatcataactaagcttttcttcactatcagattcatcaacatcagaatttgcattacgagcaataaaagctagatcaataacttgcttacctttgctctcatcttcaccttccgattcatgaaaagctgctatgattacttagattagccactgcatgcaatgcttcttcttctccttctccttcatgttcttcttcttgttcacgtcatcctctttgactctaccatcatcttccttcttgcctctcccaaacttaggacaatgcgagcgaagatgatcaagtgcaccacactcaaagcattgattaggacctcctcttttcttgttcctgacattgttcatagctcgagaaactttgttacataacaaaaccaagtactcctccttgaactgttcgagttgctcatcggacatggtattaaccaaagcaagaatagaaaactttgatgaagaagcaccaatatccaaagaagttgaagacgaaaccaaagcactggacttagaatcacctttacgagaaagaatattcatctgatgtgttttcaattttgtgtaaagtgaatccaaagtcaaagaagacatatcaacagactcctgaatagatgtaactttcatctcccaaatagacatgtcaagaccattcaaaaagtgacgagaaacctcagattgtgaataattagcatcataagaaaaatcagcaaatctaagatcactcaaaattttgttaaacctagagagatagtcatctaaagcttctccaggtttcatctcaaatttaatgtactcctttttgaaaagatcacgacgaagttctataatatttgaagttccttgatgaaagtttttcaaagcgttccaaatctcatgagcagtttcaagatgagaaacacgatcataatctgaacgagaaatcccactcaaaagaatattgcgagctttgcaattgtgttcaaattcaagttttaaagcatcaatattaatttgatcaggaatcacataaggatgagaaaattttctccaaatatcataatcctcagccataatgtaagattgcatcctactgcaccaatgagaaaaatctgttccatcgaaaacatgaggcttagttgaaaatctattagtagccatggcaaaaactctagatcggttaaaatccaaagaagaaaacaaggctctgataccacttgtaggatcgaatcacaagaactaagccaaccagaggggggggtgaatggttgatatacccaaaaaccgaaaacttttagcgcaaataaaagttaccctcaaaatcgatgaaatcggtctgaccgaagttgatcggccggtctgaccgcgcctattctgccggtctgaccggtgtagatcgctcggcttgaacgtcccgaagtcgcctctgcctatcgacgccgccgccgccggtctgaccgcaggtacgccgccggtctgaccgccctgatgcgccggtctgaccgccggtaagtcgccatttagaccgccgaaaccggtgaaacacaaatcgaagaaccctcaaagtagatgacaactttattgcttctctatgtgtttacaaagtgcaccaacagcactccttacaaaaatctcgactaaactcgaaaccctaactaaactagctctcaaaagctatacaaaagcgatacaaaagagataccgggaagcctcacgctccccctctatttatacatgagataagcagcctaaagccacgaaccaaactcatactaagagtcctaaacaccttaggaaaccctctagtacaaggaacaaactctacataaccaatcataccagatttagactccttccaaattcgactccgcatcccatacgcacacaatacctccatcgtatgccatatggaatctctatcaaccacgtgcatcaattctagccttagtatcccgcatgatatctgaccaccacgaacatcgtcttaccactaagccgactcccggtccatcactgcaaatactctcccgaggcatcaagtcacctacacatgaaacaaacaaagaaaccatattccgagaccaacctatcaccaacttgactcattgttagcaaacaacagtattacatacgtatactatccatctagaagccataaccatgaaacaatcaaatatccaaagaaacaacctaaaaccgaaaccgacacagcgtcgaccggtcagaccgcgggccggccggtctgaccgctcgcatagcaccggtctgaccggcaaccatcgcccggtcagaccggaccacataaaataacagcacctgtaaatccaatcatccaaaaccactctgacaataaactccaatatcaaaaccaataatcacagatgccaattattcatcacagaataagaatcaaaacacatgttgatcttacaagttcttcccaccatcaactggatcaggcagtagaagggtactgactgcctgagccctgtgtcctgtcaccttcataaagctcagacagttcacggccggagctgaggtgattaactatggtttctggcacactgcctcgctgatgacccaactacagtattaaacctctcggttactaatatggtccatcggccacttataaccatttccaagtggtatctaataattctcacttacttaaatatatatcccgtcggtcacatgctaaatagccgagcgttctcataataaccctcgttaaaatatcaaaatacagacagcatgctagatgttaggctgtatttcgagaatgggtgacattggaaaacagacacacgtgtcttgacactgcagtgcacatttgttgagctattagggagctaccgtatgacaacgggtctctgtatccctaagctcattgacagttgtccatggatacgccgagttgcaattgaggtaaaatgatggaaagggagaagcacatacctctaccactgattggttttgtcaaattatgcctaatgtgcagcaggccgtatcaattatgtaatgcaatgcacgaagaatcaggccaacgcaagtgagccatcaatcacatccaaagctagcattatcctgaatttgggcatgtggggttgataagaaaaccgcataatgttgtaagcttgcatgtaactattgttccagaaacatacctttttatgtattagaatttggttcgaaaatgtacataaaaggacaatttgactccacacgcacttcgattaaaaaacagtaacattgatcgtttcctccctttactttggtatgtgttaagattctcttgaagtactccatgcgttctgcccgtaaagtgagaattaaatttaaaagtatactatttatttgtgttttatctcagaaatacttcggatgtaatttttttacacaaatattgcatcattctcgctgaaccattaaataaaaggaaaaattggttatatagcattgaaagttcacgtttttaaatttatagaaccgaaagataccggttcactttaataacacccaaagttcaccccattcccattttcaacacttccgtcaattctcgatcgttttccgtccgtctttatcccagccacgcacacgatatggcgtttctacccgtcccaagtataagtagaatatatgttaatgagggtagaaacgccatat

SEQ ID NO: 60500 - DNA, 10800 bp, Oryza sativa
cgatcgagaattgacggaagtgttaaaaatgggaacggggtgaactttaggtgctattaaagtgaatcggtatctttcggtgctataaatctaaaacgtgaactttcgatactatataaccaattttgccataaataaaaataacgtgggtgctacgatgcggccgatatcgtgcggtgacagaccgcacggttgcgcagttcggaacaacgagaccgaactgtctcgcacatgtaactagcgtgactgaacgtccatgtccaacggctccactttagttagcgattaattacctaattaatgattaactgataatatttagtgaacagacatcctgatttgcaattattaatcattaaaaaagataattaatcaaattgaagcgcccagcctgttgggtctccctcgctggtcatgcgagaccactcgcgtgatatctagcggtctcgcaccgtcgccatgcgagaccatccgcatagtcatgccccagacattttcacacaagagttatgtgagattgatgatatatttctatcaaataaattgcatctgaatattaatgagaaaaaacaactgtataatatattttcaaatttaattccgtgaagtgatcgtcgtgggcccaacatcgatgcaccaaccgatctctacacgtgctgcgcccattccgctgagtccatcactgctacctatagtgccaaacttatcttaattcagtgcatgccgcaacaatagtacatctttaggtttatcgctgatactaagtaagggtgtccgttctaacatggaaattcatagtatttttgaaggaattagaaaaacatctatatttagtccctcaaccatggctactgtattatttttaactataaaactatttacttttggcccctcgatcaactctcaaaaccatccacattgcatccaaagtggggtggtttttgaaaagtgggtaaaaatcagcgtattacagcatctctcgttgcttgtttacttaaattttctggaaatgaccattttgcctgaacatgataacgtggaggtggtcagctacaagtcctttcctagccatgaaaaatataacgtggtgatagcttgcatacaattatctttgatattaactacttccatagcattatacatatttatgatcaaaattacggagaataagttgcctatgattcactaatggtgctagttatttattgggtgttttcaatgtttggttgaactacactcttgtttaattactactctgtaataattggctgcagctctcttgagcaaagaccgggatgttatatttcattatctaaaaaaaagttgttttatcacaaagcacgaaaaaaaatgcggcatgtgtgtacatatttagacaaaaacaacacatcatattcacttaagagcgaaatagtttagtgatgtactattgggcaaataagtaacaaaagtgaatatagtggggcaatagagggagagacaaattctacgatggcaaacacgggaagctatcaacttctacgagtaaataaagggtttacttgataggttttttttattggacctatcatgtactttgtcatcaataattatctactttttttacctccaaattgactctattgcaaccatcaacccaatttggatacttcgccttccttcccctctcatatttgtatccatcagtgaataagggatgcttcctctatctacaaaataactataagtgctaattttatggacttttcagttatgtagcttgtatactacagagagtgtgctagaagctagactgtatttgagaatgggtgacattggaaaacaaacacatcgtgtcttgacactgcaatgcacatttcttgagctatccctaagctcattggcagttgtgcatggacacgccgagttgcaattgaggtaaaatgatggaaagggagaagcacatacctctaccactgtttggtcgatagaattattcctaatgttcagcaggccgtatcaattatgtaagaatcaggccaacgcaagtgagccatcaatcacatccaaagctagcatttgggcctgtggggatgagaagaaaaccgcatactgttgtaagcttgcatgtaacaattattccacaaagatatctttttatgtattagaatttggtttcaaaaatgtacatgaaagcacttccattaaaaaacagttgcattgatcgcttcctccctttcctaatttgcgatgtgttaagattcgcttgaggtactccatgccttctgtcgtgaggtgatcatcacgggcgcagcatcgatacgccagctgatctctacatcatgcaagcttcagctctggacataccgtgcccattccgctgagtccaccactgtgctacctatagtgccaactaccaagcttagcgttgattcagtgcatgaggcaacaatactacatctttagatttatagctgatatttacgcaagggtgtcctttctgtaagatcaacgtgtgttttgattcttattctgtgatgatcatttggcatatgtgattatcggttttgatatttggagattatcgtcgaagtggttttggagataatcagttttcaggagatgaacagagtttactggtttgtcgggaccggtcagaccgggcggtggttgccggttagaccggtgctatgtgagcggtcagaccagccggcgctgtgtcaatttcggtttcgggttgtttgtttggatattcgtgattgtttcatggttatggcttctagatggatagtatacgtatgtaatactgttgtttgctaacaatgagtcaagttggagatagcttggtctcagaatatggtttctttgtttgtttcatgtgtaggtgactcgatgcctcgggagagtatttgcggtgatggaccgggagtcggcttggtggtaagacgatgtccgtggtggtcagatatcatgcgggatactaagggtagagttgatgcacgtggttggtgaagattccatatggcatacgatggaggtattgtgtgcgtatgggggatgcggagtcgaatttggaaggagtccaaatttggtacgattggttatgtaaagtttctttcttgtactagagggttttctaaggtgtttaggactcttagtatgagtttggttcgtggctttaggctgcctacctcatgtataaatagaggggaagcgtgaggcttcccagtatcgcttttgagagcaattgagttaagttttaagttagggtttcgagtttagtcaaaatttttgtaaggagtgctattggtgcactttgtaaacacagagagaagtaataaagtcgtcatccactttaagagttcttcgatttgtgtttcaccaggtttcggcggtctaaccgacgactcatcggaccggcggcaaggcggcggtcagaccggcggaagcgaggcggtcagaccggcggcggcagcaggcacggtaggcgatctcggcggttcgaccggagttcgatctcggtcagaccggcgtgttccaggcggttagaccggtgcaactacttcggtcagaccgcgatccatcgatttcgagggtaacttttatttccgctaaaagtttttggttttagggtatctcaaccattcaccccccctctggttggcttagttcttgtgattcgatcctacaagtggtatcagagccacgtttgctctttttgatctttgccgatcttgagtttttgccatggttacttctaataaatttacaactaagcctcatattttcgatggaacggatttttctcattggtgtagtaggatgcaatcttacattatggctgagaattatgatctttggagaaaagtttctcatccttatgtgattcctgaagctattaatactgctgctgaaaaaattgcttttgaacaaaattgcaaagctcgcaacattcttttgagtggtatttctcattcagattatgatcgtgttgctcatcttcaaactgctcatgagatttggattgctttgagtaattttcatcaaggtacaaataacattaaagaacttcgtcgtgatcttttcaaaaaggaatacattaaatttgagatgaaacctgtagaagctttggatgactatctttctaggtttaataaaattttgagtgatcttagatctgttgattcttcttatgatgctaattatccacaatctgagatttctcgtcactttttgaatggtcttgacatgtctatttgggagatgaaagttacatctattcaggagtctgttaacatgtctactttgactttggattcgctttacactaaactgaaaactcatgagatgaatattccttcttgtaaaggtgattctaagtctagtgctttggtttcgtcttcaacttctttggatcttggtgcttcttcatcaaagtcttctgttcttgctttatttaatgccatgtccgatgatcaactcgaacagttcgaggaggaggacttggttttgctatctaacaaattttctcgagctatgaaaaatgttaggaacaggaaaacaggagaaccgaatcattgttttgagtatagagcacttgatcatattcgctcgcattgtcctaagcttgggagaggcaagaaggaagatgatgggagagtcaaagatgatgatgtgaacaagaagaagaacatgaaggagaaggagaagaagaagcactgcatgcagtggttaattcaagaactcataaaagtttttgatggatctgaagatgaagatgagggcaaaggtaagcaagttgttgatctaggttttatttctcgtaatgctagttcggatgttgatgaatctgatgatgataatgaagaaaagcttagttatgataaattagaacttgctacttaaaaatttgccaaaaaacttcaaacatgttctattgagcttgatgagaaggatcacactattgagattttaaatgatgaaattgctagattaaaatctttgattcctaatgatgatgaatgtaaatcttgtgaagttttgttttctgaaattaatgctttgcaagatgtcaattctgttaattgcaaaaaattggaatttgagattgaaagatctaaaatgttggaatcttcttttgctcttggatttgctttacaagctcgtgttgttgatgagttgattttgaccaagaatgtgttgaaaaaaatacaaagttgcattttgtgcaagttctttggtcaatgcttcatgtgcaaataaggcaaaaacaaaacaatggtgttttgatttctcaagattgttcaaagtgtgttttgaatgagatgaagttgaaagatgctttagggcgtgttaaacacatggaagaagttgttaaacaagatgaggtgttttcttgctcaacttgtagaaagcaaaaaggtcttttggatgcttgcaaaaattgtgctattcttaatcaagaggtttcttatttgaaaagttatttgcaaggattttctgatggtaaaaagaacctcaacatgattcttgatcaatctaaggttagcacacacaatcgtggtttaggttatgatccttatactcataattctagacatcctcctactgttttgggtgttgctaggagaggtgaaattttgattgaatctgagcctaagaacactgtgcttaaatctgctggcatcatgtcttctttgaatgcatcttcttcgaaatcaaatgttgtgaatccaaaaccttctgttgttgcaaaaccatcaatttcaaaaccatctacttcataaactggtcgtgaaaagtacacttgttctttttgtggaaaagatggacatttggttggtttttgttttagacttgcccataaacaaaaaaaggaaagagaaattgcttttgcaaaacaacgttggcaaaaatcgggttttaattcgaggaccatggttagaccgacactaactagtcggtcagaccggttgccaggcccggtcagaccgcaggcacagcagcggtcaaaccggccttagggtgattttgcgcgaaattcaaatcggacttttgtgaagcaaaacggtaaattttctggtaagtctgattctgattttgtaagtgcgtatgtacctattggttctagtggtcgtgtgactcagtgttggattccaaaatttcttatttctaaccccaacacggaggcctcgatatcttctcattcgtaggtattttggcagcatactcccgatgtgtgtttaacgttgagatgacgattgtatagtaaggtaacatcactttacttttggattgacataattttggtctactctcttgtttgttagcttttttatatgctactatttgaggttgtagttttggtttatactattggatatatgtcaattcttgagaattttggtgatatcattggcaattggatgtctttttcaaaatctttgatttcttcttgatttttgttcggggagaattggaggttattttgagggggagctagtgctttttatgactttcttttggcatgatttgagggggagtttgtacctcatggttttatcaagcaaaaatataacaatgaaaaaattgagaaaagagagttttgttctatacatatggtattttcttgtgcatgctagcaatactttgaaggtttatttgtctctagcatagcttgtatgtattctagcattttcatgagatttagattttgcttttaaggtagatgatgcatgacacttaaattctatacttgaattaagaaaatatgcaatgttgaagctagcatatggtttgatttataaatgctctctatatatgctttattgaattgttattcctcaaatagctttaattgctcattgtgaaaaaagaataaaaatatgaaaaaaatgaataccgaatccttggaaacagtcttgacgacaaggacgtattcgatgtgagcaaaataatgggtgccgaatccctgaaaacagtcttgacgacagggacgtacccagaatataaaaaagagaaaaatatgagcaaaaaggctcaaggaaagaaaaagtaaaattctcttggttgttttgtgcagaaggctaatttgagaaataatgataaatgcaataggtatatgtgtttagtgtttattcttcaacctatgtgcttgttaagatgttgcattataaattgtatgaaatcatgaattttgattgttgattcaagcttaattgtaaaatctttggttcatggttgtactttaatgcatgcttgttatattatagatgggttcatcttctttttattgcaacacataacatgataggctatatgtatgttaagctcttatacattaatgaacataattcctatgcttgatgaaatcattgtcaaaagtgggagaagagataagttttgggggaagagatgagttttaggagcagagaagagtttttgagaaaagcatgtttttggttcaattggaaatttctttcttttaaaaagggggagaagttttcttttggatttttgagcatgatgtgtacgtttgtacgaagtgtgttttttaccgcttttgtttttaattttccaaactccaaaacatttttaatgggtttgccaatgtgttcatcaagggggagattgtaagatcaacgtgtgttttgattcttattctgtgatgaacaattggcatatgtgattatcggttttgatatttggagattatcgtcgaagtggttttggagataatcagttttcaggagatgaaaagagtttactggtttgtcgggaccggtcagactgggcggttgttgccggttagaccggtgctatgtgagcggtcagaccggccggcccgtggtctgatcggccgacgctgtgtcggtttcggtttcggattgtttgtttggatattcgtgattgtttcatggttatggcttctagatggatactatacgtatgtaatactgttgtttgctaacaatgagtgaagttggagatagcttggtctcggaatatggtttctttctttgtttcatgtgtaggtgactcgatgcctcgggagagtatttgcggtgatggaccgggagtcggcttagtggtaagacgatgtccgtggtggtcagatatcatgcgggatactaaggctacagttgatgcacgcggttggtgaagattccatatggcatacgatggaggtattgtgtgcgtatggatgcggagtcgaatttggaaggagtgcaaatttggtacgattggttatgtaaagtttctttcttgtactagagggtttcctaaggtgtttaagactcttcgtatgagtttggttcatggctttaggctgcctacctcatgtataaatagagggggagcgtgaggcttcccggtatcgcttttgtatcacttttgagagcaattgagttaagttttaagttagggtttcgagtttagtcgaaatttttataaggagtgttgttggtgcactttgtaaacacagagagaagttataatgtcgtcatccactttaagagttcttcgatttgtgttttactgggtttcggcggtctaaccgacgactcattgacggtcggaccggcggcaaggcggcggttagaccggcggaagtgaggcggtcagaccggcggtggcagcaggcacggcaggcgatctcggcggttcgaccggagttcgatctcggtcagaccagcgtgttccaggcgttagaccggtgcaactacttcggtcagaccgcgatccatcgatttcgagggtaacttttatttccgctaaaagttttcggtttttgggtatatcaaccattcacccccctctggttggcttagttcttatgattcgatcctacagaactgaaagaagaatagaccaaattccctcggcgttaattggacagatggtgataggacatttggcagaactggaagaactggcatgtccgttaggatcccccatcatctgatgaattgaggcagcaacttacatttagtatagttagagcatcttcaacagcatatccaaatcagattctccaaatacacatataaccaactctccaactgatttggatagtcaaactaggtgctcactctaacagtctccctattttaccatctccaaaataacaaatggcccgcatatatatcagtctctcttccttttctttctttccatcttcctcttcacctgctagggaaatggacgagctgacgacgggagtctacggtagggatgattggcggcggcgataggggcagcatcggagggtggtgacagatgcgaggcatacagtggcgaatggtgacggcggtagtggctggcgggatagatggtgtcggcagcgcggatgttggcccagacctcagcgaggatagcagccgcaacgcctagtgagctgcacggcggcgaaggtcacgtcacccctcgaatccggtagtagcgtaggccgcacggggatggtggttgcgatgagtaaatatttgtagctagaaagctagttgagacttaaagaggcaagtattcaccaatataatgccagagaaagttgactaaaattggagagtaaacaagcgattaattaatatttatatttctcgatgcccatgtggccaatcttgtgtggaagaatggagagtcacgcattaaatccgagaaagtcattaagaggataggttgttagattgaaatatacctatcaaaaataatttttttagatttgaaaatatgactttcaaaaatagatggagtaaaacccaagagatcctgcaacctcttgcctaccagttaaaatatactgacgactagtactctactactaactagctagctacctcacaaaacactaattaagccactggctttgcccataaaagtataaattagttggacatggtgtcatgaaacatttgatgaatgccatataccgaagatcagagccatcccttcgtggtggactggatcctatttacataccccatgcatatattctccactgtatttcactcagcatgaatttctttattaggaaccgaaagttggagatcattctttgtcaattaaactacaaacaattggaatgcgcagttgggcattataaacaatacctaaaatttgtattcaaataaatccgtggggactgtaattcagtaattgtaagcactgcgtgaaactagggtgtttttgtccaatatataggctactttgcattgcagaaggttgtagcagattaaatatataggctactgaaattcaaatatatgttgttgcaccgcatagcagtttattttaggaaggaagcatggcaagtccaatatatataggagtgtgccgaattagccatcaattttggtgggactaataaatggatttgttagtcctatgtaattaagtttatggcaagttaaattatttattttacaaattaacaagtacgcatgcatgccatatacatatgtaagttaacagattttaattaattagacagtgagggtcctaatgcgtgttagtaagcctgtgacatgacctgccgagatgtttgagggattctacaaaccctgatatgaattcttttaatttgaacctcacaggtagcaaaaggctactaataatctccgtcccgggtcgagccattgccgtgcatcccattgtctccacatagctcagatggttcatggctgtccagcggtgaggacaggtgctcatttggtgctgtcataggcgatggcttgaccgcatgactaatgcatgatagcttgatcgtgtaataattattttgactattttccaatgccacccattcctaaatgcacgatctattgg

SEQ ID NO: 60501 - DNA, 18047 bp, Oryza sativa
cttattcaatgttttaatcttacaaaattttcttacttttcactcaccataacatgcacatgcatagccttagttgtataaatgtataatatataatataaacttgctgcatactctgagggatggcttggtcccagcaaccttcatgacagcgctgataacccattgcctatagctgtgatagcccaccacccgttgccatttttccatggctcggatattttttagaggaaaggccacaaggacccagatttttaaaaaaagcatgagtcttatatagttttcacataacactggggtggcacagttttcagggctagccttgggcctaggccggttatgtgacacctagggcccaggccggaggggggtggggcatcaccacctcccagcccagcggcagccagcccggcaatcccaggcaaagcatgctgcgcgcaagctaggagggagggaggtgagaggccacgtcgctactcatctccacgcgactcttcgttttctgtttttttttttacgcgactccacctctgcgaccggcgactccgctctgcgcgttgcagctgccgtgcaatccctgtctccctgagtccgctctgtgacacaacgccgcgcacccacgccgatggccgatcgatgccggatcaccgcctgatagtgatggctgatgccttgttaacgacgaaatttggtaaatcatgcatcgaatttggagttaaggccgaagcggatttgggaggaaatcgataatggaaacagagtatgaatcggcttcggaaccgtatcggctacagtgtgcattggcagttaccgaatcggacaaggcaagccgatgtagccgattccggcaagatgataatggaatcattgtcggattgagttgacgtgcttcataatgattgccatgtacggatcgagtccgaagaaggcagttgtatctattaattaggaatagtttgttagtttccttttttatccttaggaaagtatgtttagtgtccgattatgaatttatgctttccttttatctttaggaaagtttctttcttgtcctacaaggactagtatctacccatgggtataaatatgtacacccggggtcattgtaatcaatctcgatcaatacaactactctcggcgcatcgccaccctctttcctgaggtttttacttatcaaccggcggaatttggcacctgacgtggggctgcatcggctttcgatcttcggcgaaggggtaagtcctacgtttcgtcagccctagtgaatctgtcggctacgttggtgttgttcaaggctgcatcgcttcgaactcttggatcgctctggtttggttgaaatatttgcctacctgatatctcaattctatctctaattgcattgtgtttagaggcgcatcggtttagttgggactgtctcggttaggtctgatctcctgtcttagccgatatatctctacaatcataatgttgttctaaatatatttgttatatccatcacattagacagatcaatcggctcatcgagtattagattatcatatataatctcgtgctgcatcgattaggttcgacctactagattgttgttgataatataagtcttgttaagccaataggttcatgctaatgttttatcgaggtgctagccgataagttatctggacgttgcatcggcttgtaaagattgcatatacatataaattggatttagccgatcgcaacaaaggtttcactgtttaatctaatcttatggattttatgacatcggacctccagccgatgtatgctttaaccttcggatcgatgcttatttatcatatcattatttgctgattggtttatactagattatattgttattttattacctcatcatcaaccgattgcctttatatcattatctacattgaacatatagtcgattgcttaaaccctatcgccatcggctgatatcggcatcggctattatcggctatcggctggaactactccatcggcttgtcagccgatttgcatatcttgtcagttgcaggatcaaactgactggcacgcctgtatctcatcaagttttggacctgcactggagctaagcagatctctcaggccagtatgtgtttttttgcttcaacacgcctctccctgtgatcccgtctcctataggctacgggcaaactgaggttagagtcttagagtctttttgtactgtgttactccttctaagaaatttaagttagcaacttattacttatggacttaggattttcttgcttgcatgctgtcaattgttcaaaacaattgatactaagagttatctagcatagggtggaatgaggaactggaagcatttataccttgagactcaaacaacatgacaacagtattgagcatataacacacatgaatacttggaatggacttaggtggagattaagcaaaaaccagacaattgatgatgatttgcaacgggaaattgcaaaggaaaaaagattgtcggagacaagtttttggtaagaatagtttctgctatgaaatttcttgctaaacataatttggccttttgaggattaaaggagaaactttatgaagataacaatggtaaaatttttttgtgtcaatatatagtatatatgatttaaaaagtatatactagaagtaaaagaaataaccttaactctttaaaggcctatagtgtcaagttcgtctagggcactcgaaattgttgggccagccctagcggctttcggtaccaggcaggcacaaaaacaactaagagacatgaaagtctatctaaaacagagattgacagaaaactagctaaaacaactgactgagcagtgagaaatagttgggctgataaaatgaaaaggaagtgagaacatacagtgtgtttctttttcaatgccacccattctcataataaacttatatgtaacaagtgttgccttagtatgggcacatgtattgtttcatttggaagataggcagagagagagagaggaggaaacaatccgttcttggatgacatggtagttggttactacaatggaagaagtggatcgaccatcatgaataggaaaaagattttaaatagcttatggttaagggaggtgaaatatgaattaaatatcaatagaaaatttctcaggttcctctaagtttttaaccagtctgtctcatgcacgtgaatatcatacaatcccttatatgcccctaaatttctttatagacccctacatatccattatgttaattgactgtgaagagaccattaacaacagttaaatttggcaaattaggtcttttgccaaatttagtaatttcagccattcgcagagccaccgcccggcaacccgcggctgtggtctcggcaacaggttaatggtctcttcacagtcaattaacacataagtcatcatgtgtgctggttgtcggtttggaaatccgctatgactggttcctaaccaacaacaaataccttattttagtagtgacggaatattatggctggaaggacgcgtgtagaggtaagcctgccaatgggctggattgaaatgggcccaatggattggtttcagctttgggtgtagtttggatggatggaaatggattgaggagtttaatgggctggactggttagggtagaggtggaaacagtttggattggattggtttttggtttctgatttttggatccaaattggattcagtccatggatttctttggatgcactagacagtccagtactctccaaacctagcgtcatcagtcgtccacggctccactccttccgccgccgccgctccctccccttgcttcgcctcctccatctctccgccaccgtccgcgaatccgccgccaagccgtcgccagtcagattccctcccccaccaccattgcttttctttttccctggtttttctcggtctttgatctatcctggttgttttgtttgtgtttttttttgggtctcttcctgatcttggtggttgcgggtgcaggtgaagcagaagaagaggaaggtgcgtgcgccgctgggcgttggcgaggatgtcctcctccggcggtccggccgcgtcgccaatctataagaagcccaagtaccacgacgtatgtgaacagtgtgattggtgtgatagtttctataagattttgtttttttgttggttttactgaggagttaacttgctcaagattacaatctttgatgggtttatgtgcaggagttccaagatttcaagaagaagataaggaggtatagtgaatgcaggttcccttcatctcccaatgcaaattatttaacatatcattacagattgagtcctgatatgattttgagatgcaaattaattctatggtcaatcgaattttagtgtgcaaattttagattgtagcacgtgtacaatgtgtggaaaaaataattatagaccatgttctttcaactatcttgattttagatttcttcctctatgcagacaattgaacaaactcaataataaatatgtccatacaaatgtcagagagttcaggtactaatagtccaaataataatcaatcttcaagaacacgtaagagagctaaagtatgggaacactttcagcaagaggttgtaatgatagatggtgtccccaagactcaatgcaaatattgtagcttaagattgacagccgccaaaaagtcaggaacaagtcaccttattaatcacatagccgaatcatgtccagctattgatggtgatgctagaatcaacttccttgcaacaattaagaaacagactagggaaggtttcgtgtttgttcccaagagaagccgggagctaatggtcagattcttcattcatgcagaggtgccattcaagaaaattgaggatccttattttttggagtgggtggagtccatgcagccaactttcaaagttgtggggcgtcaaacacttcgtgatgatgcctttaacttgtatgagcgaatgagggaagacttgcatgctgaaatacataatcttgattcgcacgtatgtctaacatccgatatgtggatttcaattcaaaatataggctacatggttgtcacagcacactatattgatagagagtttaacattaagaagaaaattataagctttaaggaattgaggtatccccacacgggattcgccattgaagaagctataatgagttgcttgacatattggggcattagaagcaaactgtttactataactttagataatgccaataataacaattctgcatgtcaagagttgataaagaatcacaagaatgcattgatgtttgagggtcagcatttgcatgttagatgttgtgcccatatcctaattattttggttcaggatggtatgaagataattaaacctacaatacacaagctacgtgagttgttgaagcatttagattcttcagtatcaagaatgcaagatttcaattctatggcaaactcgaaaaatcttccttcgaagttgagtttttcttttgatacaccgactagatggaattccacctataaaatgattgtagaaggattaatgtacagatctgtcctggatagctatgcaaatcaacatggtgaagttgcacctactgaactagaatggcagaaagttgaatcaatttaagaagccacattatcggtgtcagcagataggaaaccaacagcacataggttcttgcccttggtgctacaaattcgtcgtgcattgaatgaccctgattggcagactagtgatattttaaaggtattggctgcagctatgctctcaaagtttgtcaaatattgggacagtgggtttaactctgcacttgtcattgccacaatgttagatccaagaagaaaaggagattatttgaatttcttttatgagaaaacatctaacagtgtgatagagattgtcgaaaaagtgggacagcagcagtgttggatcacctgttcttgggaaaagaaaactcgaggaagagtttgcttttacaagtcttgaaggaggactgcacggcaaacgaaatcagaatttgccatatatttagaagaagatgttgaggacgatagtgagagtttcgatgttttggactggtggaagagacatgctcaaaaattcccggtattgtcatctatggccagagatttcctagcaatacccctcagcactgtatcttccgaatcagcattcagttgtgggggcaggatacttggtgacacacgaagtttgttaacacctgaaatgcttgaagctctcatttgtgcgaaagattggttaattaaagccaacgatcctttgatcaatattccaggtgctgaaggtataatagtgataaatgattcctccataaatgttctgtgtatttcaatcatgaagtagtgatcatatatcatttataggtggaaatttgtcctgatttattcaggtggtgaagtgaagaagatggaaaggtgactttccatatacatatatgcaactttaaattcaacttttcctttggcgtattggaaatttggaatggaatacttctcttgaacctgcatttttccaaaattgagtttaccactttgttgcctattctgtttgtatataaaatgttactattcattatttaccaattgaatcaatttggcacattgttttgataacactgcaaaggtcacattatttaaattgttattgtaattttgtatatttgctttcttaagcaacgaagtaacaattttctagttattcctggatataaattttttatgacatctacttctttcaggttactgtcatctgcaagaatgtgtggctgagaattggaagggtttttggttttggttatcttagaaggtaatctaaagattgagacatgaagaaattgttggtattcagttatacatggttctgaggcttgtaatgcttgatagctttttttgttggagattttctcttgagcctgttgctctagtagaatctctagtgataattgtaatatttagttgccaaaacttgttggatggcactacttaaagcatcaaaagttctaagtatgctagtagcgttgattgattatttttgcatcttgcttatgttatttgtaagtatgctagtagctgtatgcagtgtgagtgttcgccggctgctctgctctgcttcctgccgtggattgggtatgggttggaaaatggattccacccgtggattgtgttgaatttggactgagcaactttgtgggttgggttgggtggggttagctcaaggaattcttggtctggattggagtgacaattttgctatagtcactttgggttgggttggattcggggtggatgccaacccattggcaggcttatgtggaagtgtaactatgcattgttctttttctcctaatgccacccattctgaaaatatattaattcctccagcatgctctatgtagaatgtagctagtgtatacatatatgtgtattgcaaaatggaacaaaatgatgccaaagagatagggtttgtttgtttcgttttgcaggcagataggtaggagctcttgcttagtgatcaatataaataggagggggaaagagattaaaaaaaaggcatgtcaatgtagggttcgtaggtgcttgttgcaattaattactcccttcaacaaaattaaaaccgggtctggtaattgtgcacatgtaggtgaaatactgaaaactaaacaaggaattgtcatttgttctgtacacctcaatgaatattttcttttcaagtggtattgcgtgtacgtgtgagttgtacaaaagattattttattgcctccctgaactataaaaatctatagcctaatagtaggatatatatatgaatgtgtagccctttcttgcaacttttcatttcatttgttcttttatactgtttagcttcatttattttgtaatttgtatttgttcacaatattatttgatcttttatgtctataatatatgactttgatcattaaaaaatacatgtgatctaatacttaaaaaatcaattatttttcacccattagtctgtcttggtgtaattcctccattttgaaccacaatatttaacataattgtcaggcataaatccaaagagctagatgtccatgcaaaaatataataagccacttccgcccgtcagaggtgagccgtcaaagcttaggccaatttgatgtagggagtactccctcaattccaaaatatgggacgcaactgctatttttaatgtttcataacacacggagcatgcatgcatctaattaactaaggccaagtttaattctaaactttttcttcaaacttccaacttttccatcgcatcaaaactttcctacacacacaaacttttaactttttcatcacatcgttccaatttcaataaaacttctaattttggcatgaactaaacacaccctaacacatacccgtccctaaattttcgtttgtttaacttttcacccttaagatctctaatataccattaggtacatgtattttatttattatgatgattcaaacgagtaggggataataatcttttgatggtctttgtgtaagtgtatatttttttattttttgggaatggagggaatactgcctacttcacactaggcccaattcagtgtgaggtgtggggaaaactagaataatctttcctttgaccagcaagaaaactcaagacagctatcgctggcagcttatctaaatttgatcctccatatcctcatatggatggccatcgaaaaaagattcctcctccatataccttcccactctaatagatcatccatattacatactccatatcacaccctcctatattttactaatatcttccaactaaccatatatttatgttattttttaagggctatattttgaacaactaaaatttaacggtgttatttatcacgataatctaaatgagtgtattttaacctatatattttcaatggataatttaatgcattaaattgtgacttttctcccgaactatatttctctttctctctctttttctattcattcttttctctctgctcctttctacactcttctccattctttccccttctctcttctgccgactgccgcagctctcctctcctctcctctcggcgtgggcgacggcggcagcagggcggccgagctggcacgaggcggcggtggaggcgagcagccgggcgggcgaggggcgcagatggtcggggaggaggcagccggcggcaggtgggcgaagggcggaggaggcccgcggcggccgcgcgcatcgtgacggtggcaggcaatgcgagcaaggagcagcggcgcgagcgcagtcctgatgggggcgacgcggacggcagggcctccactccggcgaactccaacggcagacccagtatgtccatcctctctattccccacggtacaatccagatggtggcgcaagttcatctgagctgagtagtttggggatagcgtaaggagagaaactccaaattaggcatggggagggcgcggtttggaggaagtctaaaaatggtgtgcgtgatagaggatttgctagagcgtgttttttcatctccatacgtgaaaaatgagatggatggcgggatggaagagctgctgggatgctctaatgaacccagaacccatgatgctgcccaagattgtcaggtggtggctccactagtagatactactaagttggtatgcgcataggtgaatgcgcaatgtgcttctttaccaatgtcacccattctcaaactaaaatccagtaacatgagttttctcttatgtacatattacaaaaccataaaaaagattgcacagagatagtatccacagcttcagttagctggcaggcaaacagatgaaacaacctttgcctagttattattatataaacaaaagagagagaaaaggagatggaagcatatcaaaacagggtagggagtagtaataagtaatttcttggcagaaatttacagtttcgtaattgaagaattgccggtgcaatgtatcacaccataccatcttccacaaattaacgtcttaaattgtccaaatacaataaaaggtacctctagattaaccattgtcacagtaggtaattaatgtgtttgatttgtactgctctctggcactttgcatatcatataaccctacgacatctcgacatactccacgcatatccatatttggagttttgctttgctttgaatcagtttcttgatcgtgcctcattgcatggatcgctttcttcaggtattagctcatgtggatcaaaattcaactgcctactaggcctaattcagtgcgagggcatggtgaccgcaatagtcaaaaaatcaccctgttcctcttcgctagttagaccacctagaaaactcatatttgccatggctggctggaaatgagcccacgaacccaagttgttcccaaggttgtcaggcagtgactctagctagcagtagatgagtctgactgctgcgtgtataggtgcaagcgcattgtttttctttcccaatgccccccattctcaaactaaaatcatgtgacacgctttgtgatttgtacatgttacaagaccgaaaaaggtaatgacaaggggagagcatgtattgtttcaattggtagataggaggaggaagcaaccttacgtagtgatcagtataaataggagaggagaaaatggatagaagtatcaaaatttggtaggtggttgtaataagtgttcttttcttgtagaaagtaagcttagaggtaaaagccaaggtagattatatgctaacttacactggagaaacgaaactaaaattagagataccatcatggactcacggatttaatgcttgcactagtacggatttatgcatggctagcaaaggcttgagactagccaagaaacaaaatttatttattttttgataaaatactcatccgtgacatgcttaaacttaaacccgattgagatgacctcatccgtgacgggcttaagtttaaagccgattgagatgtgtcatccgtggtgagccttagtttatgcccgattgagataagtcatctgtgacgggcgccataccatagtcgttttcaagtatgagcctatcacagatgagctcatcgttgatgggccctagtttggctctagtttgactcatctgttgggtcaaatctatcaatgacagggctttagttttggcaagataaatataattgtcatccgtgacggcaaaatacccgatacagatgacttctcatatcaatgacctttggtccgtgacgggaccgctcccctacacagatgacgcttgccggccaattaagatgagatatcccatgccggtgcttacttgtatagtatgtaaatgtaatctaaacatgtagcatatacttcaatggagctttaacgcaacctttcgttttgtttcatttttaaatacaatatgtgacctgatgagctcaactatatataattttttcatgtaaaatgcaacgactcctacttcaagcctactagcgaagatatgtgtatgcaaattttacagtagtctacgagtagtataagtaatgcaggccttctatttcttttgtttaattaataaaccatatatatttattctatcaaatcatactaattctggaataaaggtggcatataacataaagtaagggacacataaatcaatgtcacaaatcatttaactgttagtaatgaccattccttcgtgaacaaactggtgcactactgaaatttcctcgaaagctagttgagctattgacagaactatattcttcacaaggagctcatgtgaataacccaaattaaccgggtgttaatttcaagtagtgattgctagtgtggctcaggtggcgtcccgtgcacagcttctgtcttgtcaaaaatcacaaacacagttgtgtctttagccacaccatatcaattagctttgctttccaggtgctgctgtagcagcaatactagctatagctttgatgttatggcatgtctaaactcaagagatgccctgacaagactggcagtatctagccgagccaatttgcccgggcagagacatcagcttggcgaatctacctttgaggaaaatgtggcggtgtgtctctcccaatgccacccactctcaaaagcgaactcatgatctacgaagtgtaactgtagtacatgtgaacatgtcgcgaaaaggttgcacgttttcgtttggcaggcagataggcagacataggagaaagcaaacccagcttgattggagggcatgatagttggtttgctggaatggatgaagtagatatacagatcatggattggaggcggaaaaaagagtctatcttgtaaagttatagataggaatggggaaccaagataggatgtatgaatacatagtagatgttggtgattgtagtaagtattctctctatcccaaaatacataggtttatactacttctgtcccaatttaagtgtagttgtagatttctatgtccaacgtttgatcatccgtcttatttcataaatttatgaaaaaaaaattaaaaacaatagtcgcacataatatactactacttccgtttcaggttacaagactttttgactttggtcaaagtcaaactactataagtttgacgaattctatagaaaaaaatagtaatatttacaacaccagcatagttttcattaaatctataattgaataaattttcataatatatttctcttgggttaaaaatattactattttttctataaaattagccaaacgtaaagtagtttgactttgtccaaagtcaaaatgtcttataacctgaaacggagggagtatttatgttttatcatcttaggaaactttcccataccagaaacaaactttacaaactctaattgtactaaatttggacttcttccaaattcgactccgcttcccaattgcacacaatatctccattatatgacatatatatggaatccccatcaaccacgtgcattaatctttagcctaagcatcccgcttaatatccatcatcttctcccaaattgactcccaatccattatcggcaacactctcccgaggtgtaacatcctagcatttgccggcaaagcagagtaaacgtgatcagtgcttacccataggaacatgaataaaaccagatagcacatccatgactcacatggaacatgaataattgaaaccggaaataaagaatcaaattgaaaaccatattgcacatccatggcaagcatggaacttgaactatttaaccagaacctgaaccatattgcgtcaggcataacacatagacacatcacaccactgtaagaagagaatagaatgagtagatggcatgggggccaatccatcccatacccaaactattaactcggtacagtgatagatgtatcacgacctagcactcactctcggacaacctcacttggcattgggaaaaaaaagagtaaaagtcccctcctctaaccactttgcattgcctatatggaagcaaagttacctattcttagtcttataagatacaacattaattacttctataaaagagatttacacaagttagatccatgattaaactagtttaactaaggtctagggcaactaaaactttatcatgtacactcacagaccacaagtataacacattgcaactccatgttgttctccctaatagctttccaaatatggttatgcgcaaacgttaatctccacactatacaccgcaccaatggatcaaaactgaataatttttttatacctcctagctttacttaatatacaatcaaatcttattcgtagaagagcatatatatctagtaacaacataactctagaaattacaaatacaatgagatagagatcagtaatcaataaaataaatcagaagtgtaatggattgaatgacccaattccattctactgtgcgccaatgtgttaaaattttaaattattcaggcctatctcatgttttgtgttaatccattaagcaacgtaaagctcttttttctgaccaactaactctaagcagatctggtcaaagttttttttttagtcaaaattatttattctctcccatggacctaccgcctactctgataccaactgtaacaccccaggtaaccacgtacctagagtgctacaccaaaatacactcaaaccactaactcccaaaattattagaaatttcggcggagtctcccctataaatacggacatccataacaggcaattataagttaaactaataataatatcattcctacagcgcgatccatccttataattccatggaaagaaactaatagatatctaaaagattattacaagaccgaaccatgatatagtttaagtatcattatggacctaagcattatagtttgatagtgtgcaaataaatgtgtatataaaggtgctagtttccgtccatgcatgtcggtctcaattcgtacctaaaaccaaataaaacacaagagtgagtataaaaatactcagaaagtacaatatggaacaagaaaacacatatacacatcattggcaataaagcataaacagatggctttctttttttgataggaaacacattttcaaacaccaagtcaaagaagatagtagttcccatcccgggtaggcatgaattgaaagagtagtttccatcccggacaatagtgaatacatcctatcatttgccggcaaagccgagtaagcatgttcagtgcttacccataggaacatgaataaaaccaggtagcacatccatgactcacatggaacatgaataattaaaaccggaaattaagaaccaaattgaaaaccatattgcacatccatggcaagcatggaacttgaactatttaaccagaacccgaatccggaatattgatacaagaataacgacgtaaacataaaataaacttgaaatctaaatagcatgaacaacaatctgaacatatgcaatcacatatcacacataaatgtaatgaaaataaatagatagagcaaacactctaagaatcacacaattagttcgtcatgcacttgcctccaatgaaggtttggtatcatacacgatctgaaggaccaccacctaatcacaaacaaacctcagcaaacacattcaaacatacatatgaaacaataaaaaaggtgaacctactgcccatcccgtcaaaacgcaataacaaggaatgccgcttggactatacataagactgctgcttcaaacctttatatcttgaaatataaaaaggctatgactgaaaatatatatacattttaaaaatctatagaacaatacctacaacttttatgtagaaatcatatttttattctgccatttaaatggtctaatttgtgcttgaaagccggcttcagaatctgtccagaatttcagagggtacatacagaaacaactatatctggagttctactcatctgatcaaagagtattttaccaatatggaaaccttggagaaaactctacaactttgtctagaggcggcttaactgattccgctgtttaaccccttaaaaaacagttcaatctactactatccagattatgacataaaagcaacagtcatactaaaaaaaattatatctcctaaaccacttgagataaaatcacgccctttggtcagaagatagatccaaacgttatctacaacttcctagctatacactttcgcagaaattaacatttatagccccgaaacatcgtaaaaccgaagcactgcaaatctgcccacatgcagaactgcaacaaaccaaaccgcaaccacccaaactcctcctctagcattcactaaccacgaattaaagcactaaaaccatgctagaacaactgatacaacaaggggaaaagcctcacctagtgatgtgaacactcacgaagggtggcccgatcttcacgacaataggttgaaaaccaaggataagttgctgtagaaatagtgggtaactagctttatacctgccaaggttggatgggaccaaacgacggggagagagacgccaaaaccgtgaggacattgactcgatctccgaacgaccgcagaaccacaatccggaactaatccacacaatacggtgcagccaaactagaagccgtagagcatgaactaggggacctcagagagatcttcctgacaagtccaagaagaactcgcaagaacaaaagggtgtaagacactcaagcagctcggttgcaaaaaccatttaggttatcaaatcatcaaaagttgttttctggaagcacataggggatatttatactaggaacaaccattctagataggtatgaaaagtcttggaattttaaaggacataggctagcccaaaggtctccacaagtgaattcccgagaagactcgcgcgcctgtttgccttctgagcagccttcagtaaaaatgtcattactccttattgacatggggttggttgcgttggaatgctaacttaataagctttcacaccatgtgcataatgcactacaaaatattgtagattgatatatttttgcatggaaagttgaatgtcttggcaagctgttggccttcggagtagtgtccactaatctggccataactctttagtgggaaatccaatggacgaacggtttgttgggtttgaaactagactcaataagcttcccagaaagtgctcattcaccttcatagcttttgagaaacaaaagttatgatgatttattgaactagtccgttttgaaactgaactggctcgattttgctggttcttttttactgtctgatttagcatcctcttgttgcatattcctaagaacaaccaaagtagaacatttaggtaatataacattctcatctatagatgcatcaaatgtagcaaggagtgagttcacctgctattgtagttttttcacatgacttcgcgtaatcggtctttccattacttggtcgcatgtaactgtagttgaacttggtatagtcatgactgggatgtcctcatcacctagggtttttttagagaacttgtgaggagacaataggggagactccgatctaacccctcctactcctctcctcctcatcattccgtttttccacttcgcttgttgatccaagctatgaagatggagatatagggagagcaatttgttgtagaggggagagatgcaaacacaggaggaggggaggaaggcggcgccgtttgaggccggccagggagaggggtagcggcaccatgaggggatgtgggattcgattcccctctctctaggttttaggggagaactagtgggctgggtttatgggcctcctcatgttggcccacttataaaggtatttttattttatttatttatattaacatatttatttaacaagtcaacccaaaccaaaaacctaaatatcttttaatatacaggatattacacgaggcatcaagactcacctacacatgcaatcaaccaagaaattatatccgagtacaagttctttccatcttgactcaatctttgcgcacaacagtattacatacgcatagtatccatctataagctataaacatgaattatccatgtgtggccatacagtcgtcggtcagattgcgggctggctagtctgaccgcttgctacaatccggtctgaccagctttagctagccaaatcagctcatcacctcaaaatactgtttattctcatccggtctgaccgatacacacaccccagtctaaccggtgccaaaaccattttgctaataatctccaaatatcaaaaaaccaatattctcaaatagcaattgttaatcacaaaataacaatcaaacacactatgattttacaaaaaacatagtgtaattggctataaaagggaggcaaaggcaaacctatctgcaaatgctcatcaaaggcgggttatgcctgtattatgcatgaaaaaacttataatttgttctaaccctgatcataaaggaaggctagtagttacactatcagtttttcttttgcaagaagaggtgcattgtcatgagtcaacgcgtggagtaactaaacagaagttctgaggataatttgg

SEQ ID NO: 60502 - DNA, 4355 bp, Oryza sativa
tttaagaacataagtcatgcataaagtaatattcatgttttatcatctaataataataaatgtactaaacataaaaaaaggtcaaataagaaagacgatcaaagttggacacggaaactcatgaccgcacttaaaatgggatggagtgagcacttcctccatacatccacaaatataaatatttctatagtactacttccccattccaatcactcctcgtttaatttcttcatcaacccttatcccaaccaatcaaggattcaaccagatgtatggaagtaattttccgtcaacctaatttttttaaaaaactctaaaagtaaattatattagtggaaggagatcttaacgaatgatggagttatgagctttcaggcgaatcaaggaaacttctccgtgaagaatacaagcacgcatcaaatctaaagaaaacaaaaaaaaagctttaaaatgtcaaaaaagaaacatgtccacatggcttgtttcttcatacaactcatgctctagatacgtaccacactgttggtgtcggcatcacctacgtcattaagcactgacgcagtcacaacaccaatacttacatagaacaataccaccattctactccccactgtcctaacttgaggtgccgctagccaaattccaaccttcatctcatcactccttgcgtgattgcgtcggcctcccacacaaccgacggttattgtccctcatgtatgtcaggccaaaatgaatgctcaagtgtaatgaattaacctgtcaaatgcttggaaaacatttattagtatattttttaaattgtgaataaatatttaaaaactcttatgtttttaaaaactggtcaaataaaagaaaaggctataaatttgttgcggtttcaaaggaaacggattatactcattgttgagagatatacaagtgttccaagcctcattcggtcgttcctgcactggcctccctatgcatttgctcggctcgcaatgcacggtgtcaccactatcccatacatctcctggcacccgaagatgtttctcttcccgtcgatgtcccatccgtcattagaagttgtggccattttggtggtggtaatggaccacatgaaggcggacgctcgtcgactagggcttgctggttcgtggatatcaggtcggctaccaagacagtcctcttcgtctaggtgatcaagctagatacctctactgagtaatctatgatcaagatgtattgcttgtccaatgtgcttctttcctaatgtcacctattcttaaatggacgactgactctaacatgtttctgttgcttccgtaagtgtacatgttatcaaccagcgaaaatgcaaaagagaggatattttgtaaggtaacagtctaacggacagatataggaggaagaaaaacttttgcttggaaggcacaatgcatggtaggtaatttcctctgaaataggtgtgaataaaatgattgacagatcatgggtagaaaagaagaaaggttatccgggaaggatataaataggagaggccaagaagctgaagggagacatatatagggagataggtggctgaaaaatgtacttttcttccacaaaggcctggtttagttcccaaattttttttcctaaaaacgtcacatcaaatctttgcacatgcatagagcattaaaaatagataaaaacaaaaactaattgcacagtttgtatggaaatcgcgagccgaatcttttgagcctaattagtccatgagtagccataagtgctacagtacccatatgtgctaattacagcttaattaggctcaaaagattcgtctcgcggtttccaagtgagttatgaaattagtttttttcattcgtgtccgaaaaccccttccgatatctggtcaaacatctgatgtgacatccaaaaattctcttttcgcgaactaaacagggttgttagtaattatacttcgcagtgtgcagaaaggaaactaaaggagatagcatttgtgttttttactcatgccttaatcgaatgttttctttacaagtgatattacatgtcagtctttcaattttttttcttatttaaaataagcacaacaagcacatgcatagcataacttatatacacgactgtagaaagcatttttactcccggttttgcaacctagagtatgactccgggactaaaaatgggtatcattagtcccgggtaaaataatcgggtctaaaaatccatcttaatttagtcccggttgatgttaccaaccggaactaaagatggcagcgccagcccggttggtcaccattttttttcattgtttcttttcaaatcaagttgctccttcgcaaatcaagttgctccctacatattcccaaatcaaaatcaaagtatcatcagaaatcaatgaatcatatattcacatcacaaattatcaaaagaaaaaacataccaaattcttaaaaaaatcatcacagattatacatcacaaatctaatgaatctcaacttctaaaaattctcagatccaatgtatcgcaaattcttaaaaaaaaaagaacaacaaaatgctgccgctgtcgcctcctgcctccctgccggaagaggggagggcgccgccggccgccggctcccgccgccctcccttccacccgccatctgccgccctcggtgcctgggttcggtgccgtccccgccgcctgggcttggctgtcgctcggccgcttggagaggaggaggcggggagggggaggagaggggaagggggaggaaggagagacgaaaggggaggtggaggctgtaagagatgaggctgagctgagagatgaggctgttaatttaatggggggaggagagaggaagggggaggggataagatcgaccgactgaccgagatgaggcgcatggctcggggtgaattttggccccggttggtataaacaactgggactactttagtcccagttgtttataccaatcgagactaaagataattgggcctggctcgacccgacaactttttgaaccaggactaaaaatgatctttagtcccggttaacaccaaccgggactaaacatcaaaaagtttttaaccaggactaaaaatagtctttagtcccggttcctaatggaaggttcctaatagaaccgggactattgtggattatgggcgaccgaccaaagatggtttctccagtagtgataatatgtagtcaaaacatgcagcatactatagtttcttttatttttgtttaatttgtataagctcgcatgtatatatatgaatttcgagttgttcaaaagagctaactgcacgtctgcacccaatgtggtagtaacattccataagattttccttgctatgtgaaagactggagctgttcatacccatcaaaaccatacaatgcagaagctgtacactatattgctcataattaaagaagtgcaagtgcaatgacaggatcccatcttccatgaaaatatcttaaatttgtcctaatgcatgagtaagaagaggcataacagtaggcaatcaatctctccatgtaatactctctctcactctacagatcttgcaactgcacaccaaatccacacgttccacacatactcatgattgggatgcagcaaacatcggatcattttcatggcccattgtgtcgaccactgtcttttagacatgggacaattgcttatttgaccctgttttgaactgtaattgccgatttggccatactttttgaactttgcttatttgaccctctttttcgagtacgaagcttccgtctgaccctcttttgatgactccgttagggttcgatttttttttaaaaagaaaatgtttcaagagttcctaatgacgaaaataccctccaaaccctattttgactctctctctctcaatcgtgcgtgactctcacggtctcacctctctctcactctctcactcgtgcgtgcagcggcggcggctagctaagggggcggcggtggcggcgagctgagggggcggcggcggcggcgtcaagcactgccccgccggcgcccactcgttgtggtggagggcggcagcggcggcgctttgagggggtccgagtcggcgccgatctgagggggcggcggcaacgatctgtgggggcggcggcggcgagctgaggaggcggcggcagcggcgtgatgtacagccccgccggcgcccgctgtggaggtggagggcggcggcggcggtctgatggggcgcggggcggcgccgatctgtgggggcggcgacgccgagctgtgggggcggtggcgccgagctgtcgtggcggcgacggtgagctcgatgacgaggaagaggagcaacggtggtggagctcaggccgtggtggtgtgcaagcg

SEQ ID NO: 60503 - DNA, 5982 bp, Oryza sativa
tgatgccgccgcccgccctccgcacgccggcgagctccagcgccttcctccctccgtctgcgtgccggcttctgtcttcctccgcgcgcgcaccgccgccgggtcagcaacaacgacgacgacgacgccacggcgaagatcacagggagccgctccctccctccccgcgcgcgtcggcctcaatcttcttctgcgcgcgccgccaccggtcggcaacgacgacgacgacgctgtggcgaagagcacagggcgccgctctctcccccccagcgcgcgccggcctccgtcttcctccgcgggtgcgccgccgccgccgccgccggggaaagagatttttttttatattatccaaactttaggtcaaacaagcaaacaaacaagatataacagggccaaataagcaagggcaaaatggactatttaccccaaaattaacaccgtcacctcacacaaacggaatagggtcagaccagagcttcgtactcgaaaatgagggtcaaataagcaaagttcaaaaagtagggtcaaatcggcaattacaattcaaaacgaggtcaaataagcaattgcccctttagacatcgtctcattgcacggaatactactgcctactacacgtacgcaagcccaaatccagtgcgagggcaccgggacaacaaggattacaaatgcatgctctccctgttgtcccctttgacaaccaataacccatagaattttgatggatggctgccaatgaaaccacagacccaagctgctggccatgattgtctggtggtgactctacataccaaaggatgagttactacaagaaaagaaggaattctcaagagccaatccccgttgggactgatgctgttctcgttgggaatgttattttcaaggggatactcttgtaattggtgccttgggattaatggcctagctaatactatcatttgctaggaccccgttgagaatagcttctgcaagagctaaattcaagagctttccttggaaataatccgtcttggttgttgcatagaacactgacaatctcaagggttgctcgttgcaaataccttttcaattcagtttattaaaaaatctaattatttttatattattagttaattctcctatacaaagaaatacccttgggattgttttgatttatcatttttttattaattctaattaaccaggaatgatatttttaattattgttctttttatgcagtacgtagcaaataacatctgcattggatactgcatcacatgatgcaacaattatatttactctgacagaaaagcgtcaaaggatttttaatgatcaatataaacagtagacaatatatttgcatttaatctaagacaggtctgtagacaataacacataaataaaatagtctcagaaggtaaattgatcaaactgattaatctagcaactataataggtctgataacatgatcctggattcctgatctctaaatgcttgcaattcgacattagcacatcctagaaacgccagaggtcatcattctcacaagttcttccacaatgaccagcttgtggcgcctcttcagtagtgttcatcccattctgaaataaaattacagaataagctacaaagttactgaaaaactataagggtaggtctaagtttgaacttatgaatgatacatagcagtccatttctaaattgaactcactaactagtatcgcaactaaagccataccattggcagaacatttttaaattgatctattgttgtccaagaaccaaatttttcataatgtttgttcaagagaataaataataaggatgtacagtagtaaaaagattgaagtcagtatataccatgagaagtgcatgaaggaactcagggacaacagaagaagatggtccatttgcatcctgtgatttgaaaaataataccagttagtatgttctttctaggtaacaaaaatagctttaatttatacttacatgggaatgagtttctgccttatccttatccactgtctgctctagcctttctatccttgatgctagttattgatgagcattgttcacagcattagtgactgcctgctgaacaatgtcttgcacttgctgctgtgtatatagtggctgtgtctccatgctaccagatggtgcacttgctgaattaccaacatggtttctatctataattcctggaagaccataataccttccacgttttctacctttagtgagctgcacccaaacatgttgtttgtcgacttgattgttttctccttccttgacacgatcattatacaccacctaattaagatatgtagtggcaccattgcatggttttagatgatttcactttttttgattgccaaacttgaaactagaaactagaataagcagaacacataccgctaactgttcagctttcttgttggcatactgtcccttgccctttgcatgtcgatgtgtgcgttcaaagacatcaatatcatcaacatccgtccctgcattctcaattatctatccaaaagtacatatcatagtgagaagtcaaagtagtataaatcataataggaaaatcatttaactttggtaccatggcttgtttatgcatagcaacacttcgtgaaccacaagtatgatgaacaccacctccttccatccgatttttgctgttttgagctgacactttctttacattttcatcagaccacaagtcacacaacatatcccaccacttttgctcaatccaataaggagggaatgccttccaaagttgaggatcatcaacatcaaaatcatcatgagaaggggcatctccatcctgttgtaactcagtcgcacgcatattttcgatatgcttttccaaagaacgttttgcttcagatttctcatgtgacaaagcttggctaaaacgttcaacagctttgcgataaaataatctagcacaatccacttctctaccatcagcaaacttaaaacgcagctgtaaaaggataaggtaggacgtcaatccattaaaagaacctaaatattctatgtgaatgctaacactgtaactcaccaaaaattccttcagaatagttatccttgtatgagcaggaaagttgtgataatgagcaatgacaactgcttcatcctcaggcacctgtttgccatgtttatccaaaggtctatatgtgccagggtagtgagcttttataagacatgtgatggtagatgaaacattcttcttcataggattcgtaatccaagcactagaaacaacataccatttaccaagttaggtaatattagtgtaaaacaatgaaagtgacaaaaaaatatgttcagccatcataatattggatttataggaactatgcatctgtatttcttaaaatttaacatggagtttacaacaagattttcaattattaacaacaatgatatacatattatatggagtgtgtgtttgtgtgtgtgatagacagtgtgtgttttaatataagcagaaatttagagtgtcaacttactctttattgagtggagttatcactgccctatctttctctggaactggtgccatcaaaacatttggaccacgaccacccttactttcttttgttgaagtaaccaaagaatctgaaggttcatcttgtgttgaatcctcaaaatggtcttcaacttcaggatccggataatgtcgatggcgtcttgacatagtacttaactagtaaaaacaagggttattttgcaagcaaatgtagtcattaaagaatagataacatagtaaatttgtaataatgtgtcacgaccggaattaacccaacgggcgttccttacgtgcgtgtattatttcttgtcccaggaggcaaggtacaccaaaagttgatacatttcagagtttatcaagcggaagcataaatagttaatttattacatgggcggcgaaggcccagcacacacaaagacaaacgggaaacagcggaagactagggcgacgaccacaggcgcttgacggcaggctcctcttctgggtttgggaaaaaattgagcaagacagagtacaaccaccgtactcaacaagacacacccacaagtgcaggataaatgtaagggagtacaagggggttataatataaagggttagggtttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcctcctcacgtgtaaccacgtgccacataccaccacggtatacggacagaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctctgcaacggaggcccgaagaccggtccttatatggccgaggtgctactatcaaaaccatgcaccccgagcccagcctaaaaccattttgaggattttgaatagagggggaggtgtgaatccaattccacaataatccatccattccaaagtgtccaggtgatgagaatattcccaaagtctagagttgtaaaaccacctaatgttgcctaattaaccagcgaagcatctacctaaaatcatactagtggtaccatgagtagagtgtccactagttggggttttgtttattctagggggaacaaggaaataataacaataacaataataaggtcataacaaaggaaaataggcatggcttgataaaacagtgataacgcgggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcggcgtctacacgaccaacggaaaagaaaaggcttttactctaataaactccatataacaagctggaacaaagcacaaaaatgggttcttgacttcttaagaaaaaattagagacttgaacggtccaattccgagttcaaatggccaagttatggtcatttgaagtttatatgctctttaaatgaatatttgcgaatttcttcatttaaattttaattttaaaagggcttattgcgtcagccgaggggagggggcgcgcggaccgggtcagcgggagtggggcccacgcggcagcctcacggtccacggtggaccgggtgcacccgggctcacaccgaccagcgccgtgggtcccacgcgtcagccgcacccgagggcgcgggcggctgacggccgggccccacgcggcagccactcggtgcgcccgagggcggccaagccggcgcagccggcgggaggcggcgcccgcgcccctatggtcgccggcggcggccataggcacggcggagcggcggccgagagaggggaagggaagggggaaaagaagcggcggtccatggctcaccctaggtcgacggcgacgacgaaaaaggcagccggagcggaggaaggcggcgactcggctcgggtcgacggggtcgacagcgttcc

SEQ ID NO: 60504 - DNA, 12166 bp, Oryza sativa
aaaccagtcacacttaaatagagccacctttagatcacgtatcactgacatattccaactctattatctcctggatagtgccatagtagtcaggcccttggttatcaaaccaatttgctgacacacaaactccactatttgtcgttgtcctcgttaatttcttttgttcatatggttgtgtacgaaaacgaaacccctgaacatcacatcccttataacacttaaccatgtatcggggcccaatggaaagagcccttacttgttcttcaactgtttcatcttttccagcctgtagaatcaattttcatgaatcatgcattaaaataaataataatccatcagatattacatcatgtattcttaccaactcacgaagccaggttggaaaatctttctcatgcatctcttgtaattgagttgtagtgatgttcctgttttgttgtttcatctccctatcaaatttcctgacatttattgcaataacataaatgtaatatgtcatattcacaaaaatagagcccaagtaataaaataggaaaacagaataatatatacttacaagacatatttgtcaacttctgcacaattgagtaatgcatataccctagcagcctgccattcttctcttgataagttacgtgatgtgctctttccaagagtgcgatatgggatagagaatatagacagccagtcagtaggtgctctgaaaccaccatcatcatgtctagggacgcgagtgtgctttgttcgcacatgatcagcaaagtacatagaaataaaattagagacctcctgtaccctatacccctctacaattgaaccttcgacacgtgctttgtttcgaaccctcttgcgagcctcatgtaactccctatgaattgagcagaaaacataattatgaaattaatatacaaattcacactttagtacttaaccaaagaaacatacctttcaaatacatacatccagcggtaagctacaggccctccaattaaagcttcataagctagatgcaccaccaagtgttccatacaatcaaaaaatccaggaggaaaaatttgttcaagtttacacacaatgactggcacttccttttgtaggtgcttcatttgttctatatccacctcttttgcacatagttgcctaaagaagtagctcagttctgctaaacacttccagatgtgcttggggaggaaatcacgaaatgccacaggtagcaacctttccatgaagacatggcaatcatgactcttcattcctatgatcttgcctcgattaatatcaacaccccgtgctaaatttgatgcataaccatcagggaatttaagattcttaacccattgcagtaccaatttcttctgtgccttatctagactataacaagcttttggtttcacccatcgacctatagatttttgttgcatatgaagttctttgtgattgcatatattggctaatcaaatcgagccttgacattatctttagtcctctttgggatatccatcaaagtattccatatattgtcaaacacattcttttcaatgtgcatcacatcaaggttgtgccgtactaacaactcacgccagtaaggcaactctcaaaagatagatctttttacccaattatgctcctttccaaaaccctcaatctcttgatttcctgccttggtaccaaatgtaatttagggagagatttaacacaatcatacacttctgaagatgatcgatgaataggtgggccatctttctcctccttattctggatgaacttgtcttttgcacgtctaaaagggtgtccctttggtaggaaacgcctatgacaatcaaaccaacatggcttgcctccaacttttagccaaaatgactttgtgtcttccatgcaaattggacaagctaatttcccgtgtgtgctccagccgcacaacatcccatatgcaggaaagtcacttactgtccccataagggcagctcgcatgacaaagttctggttttttgagcaatcatatgtcacaactccttctgtccaaagttgcaaaagttcatcaattagtggatggaagaatacatctatgttctttccagggtgcgtaggccctggtataaccatggtaaggaaaatattatgtgccttcatgcataatgctgggggcaagttatatgggacaacaaaaacaggccaacaggagtaaggggttgcagtttgattaaatggcgtgaatccatcagttgacaaccctaaacgcacatttcgaggctcctttgcaaaattagggtactttgaatcaatatgtttccatgcttcactctctgctgggtgagttaactttttctttctgctttcattgttgcacctctctgattcaagcccatccttgtggtatgtcatgtgtgttgcagtgcctcgtgacatgtagagcctctgtaggcgtggaatgattgggaggtagcgaagcaccttttgtggagtgcccttcttattctcagggagttctaacccttcaatataacgaggcccattacatgttatacatttccttttgttagcatgctccttatagtataacatgcaatcattcttacaaacatcaatcttttggacaggcatacctaaagcttcgacgactttcttgcatttgtaaaaactacatggcaaatttgcatctggaggcaacatttctttcataaccttgaccagctcatcaaagcaagctacagacatattatggtctgattttattgtcaacaaccgagagactgcagataattgagagtgttttccacacttctcccacaatggcttgatgctgcatctaacatatcaaaaaatgaagctgcttcaacatttggaggctcttcaatattttgacaaaaattaggccctacggcatccaacaccatctcatctatatgatctgactctccataggcattacctccttcattcatctcattgtcaatactgccttctggtgtctcactggtatcagctccactttcaccatgtctactccacacatggtaattttcagtaaatcctttattgcaaaggtgcatttgaactattcttttgtcatgcagctgtccattcttgcacttcgtacaagggcatctaacccttttctctgcctgaccttgtaactttgatacagcgtgtgacataaacctcttaactcctttcaaatactcatctgaaatgtatccattcactacccttttatacatccaactacggtcctcagccattaatctcacactaaacaagctattctgacatgcaaataatggctagccctacacttgaaattatatggtaaggatgcatattttgaaagattatgtaaaggaagtttatcaaaataagaagaggaaatattagatgtagactaataggaaatcttcttttaaatacaaaaaataattgctcccagataaatcattattagtgataacttgaacatattaagtagtacatatttctctataacttgtttactctgtctacacttcaatacaccaaaagaataaacaacatgtgtcttagcttgtttaatttactgaatttttgcacacatgccaatggtttgctatcagattgcacaattattaacactcaaattccatcgtactttcaggagacctgaattttctaaccacttaaagcaatcctgagattgcacaattattaacattcaaattccaccgtactttcaggagacctgaattttctaaccacttaaagcaatcctgagatcagtaccaatcataaattaaactatgttaataattcctacctgtatattctaatccgaagaactgatgatagaatatatatctactagagatactcgtaatttttgggcaataaaaatatctagtagcgagcaactaaagaattagaaacacaaccatcgtcaggaacttgagtcatacatgtgcaagttagagagcaaattttagtgtgtattacttaaaccataaacaaattaatccaatatccaacatcctggagcaaggagagtagaagaaaccaaaaggatgatgaacattctttcaaaatcattagttgagatgctcctgggatacaatcacaaaagatgaaaatcacaggacatgacaaaattctcacaggggaattccatcgagcagctggtagacacacattaatcaagatgttacctgaggaggaaggatcggggcacggcagagcggcacactccgacgaggtaggagtgctgggcctaggtgtcaggcaccgggctacaggaggtgccgcacctgaaggctcggagtgcgacgggggtgccgacctgcgtcgaggcaagcacgcggcaggggattgttagcgatcatgcgaggaagaaaacaaatgaagaaaattgggtgctacaaactcacggaggggcaaataaatttctccaatcagatgaggaaatcacaattagaccggcaaacatggggagtgggagagatgggataatgggggtcgatgattttggggggaatgccagaaaatcgcaggaaggaaaaagatggattgggacttgggggtttttttcgtgagagctagagagcccttctttttcttttttttttgagttgacggggtttttctagagggctggcaggtttttttttttaagtacgggaaaacttcctttttttcagggagtgggatgtggctgggtcaaaacaaactccagatattccctcattaaaaaactaactcaggataaaatattgcatcaaaaatttatacatggtaatattatttataaaatatatgaaatctcgtgttttctattatacaaaaattatgtaattattttcaaagttacatgaccataagagtaaaatataccatctttaaatatagattttgcatcctttatttctagataatcaatctagaatttttttatttttttcaatttttataacgatcgttgctaagggagtagagccaccagtaatgacataagtgtggtaggcgtgtacaataataccttcgactaagtggcggtcatggagcttgacgacgaagatagaacagtggcaatgctactcaacctgtcaaccatggagacagtgtatataagacctcggcaacgacaacagtggtaatgtattgattagagggttggcgtgatggcgacaacaagtagtagctactagagtgttaggtagtagtgacaagcatgctagcatgggaaaatatccctctagagtagaggtgccaatgtactgataaatttttatacggcagatacaacggtgggagccttctctcgtttgcatgacacttgttagatatggctaaaaaaatatatcatggcgttacaccattttattaatgtaatatttaaataaaacctatactaaaatataaccttagatgtgactcggtatctctactattaaaatattcgtgttattaaaagatcatgataattaatttatgtttttctattaatggaagacaaacagttatgcatgtcacacgcacatgccctgtttttatcatttgcaggcccttccgaatagttcatttatattttttttatagtactggtaatgaggtcgcgtggtcgacattttatattaacacgtttcatacaatttttatcggttagctatactttaattagcaaactaaaacttagtaaatgtaaaagaagtttttgacagtacaggcacaatttcatttgcaattctttaattttgttttttatttagctatttatagatttttttttacagaaatcaattaaatatatttttatttttagataatgtttaatctatttataaataaaaacaagctcacaagatccatgcatggctagcgtaatactagcaattaactaactgtacaatttatattatgtaatttatattacaaagggatgctttatttcatacaatcccaaggaccatcgcctatgccttggggatgacgatattctacaagggtacgttcatgacccttgcaaataaacattattagcaaggaactagagtgatggtagcagataaggatcttctgcaaggctatactattgcaaggggaaatactcttgacaataattacatttcttgtagtgatataattagtgtgcttgtgcaggtgaatgcgcaatgtgcttcttttccaatgccactcattctcaaactaaaacacaatgacatgttttgtgttatgtaaatgttacaaaaccataaaaaaagattacaaagaggtaacatgtattgtttcggtttgactggacagatagaggaagcttattgatcaatgtaaatttatgttagtgagcaaagggagacaagcgtatcaaaacatggtaggtagtagtaataagtaattgtttgataggaatttgacaatgctaaggtttgtccaataaaacagtactaaaagtaaccctaagcctacctcatgcctagctaccagcaaaagatacacactgatagagcgggtcatcaatttaacactaggataaagccaccgctttttacccaaaaaatagtatgaatgctaatatatatacagatgatcaggctcagggtcattcattcgtggtcgactggaatttttactgtgcggttacaacattttcactgtcattctgtgcggttacaataatttcattattaatttgtgtggctataacattttcattgtcgatctgtgtatttatacaaatatcaacgaagcgaattatcgaaacaaatcctttgagaagtcaaacactcttatagcttaggtttattgtgggttggggggaggtaaatactgcctggaggatagtcggacgacgacagctgctacagatgagagagggactaaggatcacgggagactaattctgatttatttcttaactagaataatatcgatacaatccatcattagatagatggagggaagaacccaatctcatcagcactggtttgacaaaaaccaacattgatgagggtttcccaccgtaactctcgagatcgttcatgcacagtatataccaggcacagatgggaccacatcagtgccaggccttggttacaaccggcactgaaaagttgccgacccatctgtgcttggtaaggccctaacatctacactgataagtggctcatcgcgccccctccaacatacataaattggtttcggtgggaaaatgtaaaacatagacaagcagtaataaacttggagtgaaaatatttactgatgcatgaaaaacaatggccggccatctccttgtttagtttcctttgcgtttggatagttgtgaacctccttttaactttcttaaattaattaccgacaagcacctaccttgtgtcagtgtattgatactttctctgtcttcccctgccctatttatatgcttcctgatggctttgtttttctttctttttttctactattcatgatctcgatgtcatctactatatccatcgaaggaaaaaccatgcaaccctgatacattctcctctacccatctctctctatgccaaatgaaacaactgacatttttgttgttccagaatatgttcacacatactgcaccaaacaggacatgttactagatcgagttcctccattcgggaatgggtggcattggaaaagaagcatatcgaacgtcccagctctactgtatattaatcaggtcattgacgaggccagcatccaacgaccgggggcagtgtgccagagaactgggttgatcgctgtcaagttggtgttggtgtacggtatctagctgtcagtaaccttctgctaccagagctgatggtgggaacaactggaagcagaatagaccaatgtccctcagtgattgccagatggttatagaacatttggcagaatccattaggaccctgcgtaatctaattttaagcgaaatcatgatttttcgtgttaattttgattgttcgtcttatttgaagtattttttaattagttttattgttatttttttgattagtacttttattgttatttttcttgttactagaagatatagtactttatacatgacttatgtgttctaatttttttcaaaaaaaattcaaataacatcgacgattaaagttggatacggaaactcatgattgcgtttaaaatgggacagagggagtacttacatttgtcacgtcacttatgaaaaggttttactccctccgtcacaaaatataaaaacctagcatcgggtgggacattttctagttgtctagattcgaagtactagaaaatgttctatccggtactaggtacttatatttttgggacggaggaactatgtaattattggtagtagagagtgaagggatagaattatgtactacctccgttccaaaatgtagcaacctagtaataaactaagagcgtcataaaacaatgtcacattattatttctgctgtcataattaattaccattacaaaggtagccttaatgaaatatggatgtcatagtgaagatagccttattcttttgtggccaaactagcacaccactgaaagttacttaaagtcgagctatttactactggcaagaccatattcttcaagaataactagacatgacaagatgtttaatttctgaaaaattttcgtgtgccagttattagcgtggctcctgtgggcaccccacgtatagcttcattcgtcacgccaaaaacatcatacagaactcgcttaaaaacaccaatggagttagctgaactccaccgattacacgtagctcaacgctagtcgtatgctaaatcagacagcaagatcggctactgcctgctgcatggtgcaaaccagaatgcctgcctagctcgggcatgggcctcatcacctccatatagatcaaatggtagatggccggctagtgtgagcccagggcattgccctactgtgctggttcacttgggtgctggccttatcgattgcttggcaaatgttcatgattgactggttactcgatgtgtttttttcccaatgacaccaattcccaaatgaaccaaacactgctgcaaaaataaaagtaccaacagaagtgtttgttatcctagaacgcaatggatgaatagtagatgagagagagcatatatagaaaagaaaaaaaagctacccaagcatatatgctctaaatagaagaggggagggaaaacaagaagttgtcaatacaactagcctatgatgatgtgcatttgcgtgactactctacacacatgacacatccgggttatgtgatatgtgagagtaccaatacgtatctcttaggtttcttgttgctagtaaaaatttgggtcaggatgagtgatagtatgaccttgatacaataaatggctacatttgttacaatgtattaccttttatcgcccacttatttttattgatgcacatcctttatggctcatggtcacatattttataggtttttaaaaaatattttaatttgtgtgaaagtcgttcaacctttattaagtgaccatgaccttttcattggaaggaatgtgcatgtctgtgtagcaatgttttttctcaaatacattaacaattaaatgctacaaacaaaattaatcacatgaatatacattttgattatgtcctggatatctcaatcttaactaatgaatctttagttaaaggatgaggtttttttcttcctttctttctttccactcctagtagcttcatctctggaagtctcttgaatgtgttcttaattttaccttctatctaatccaacggtccaagattcattcactctcttttatcttgtagtaaatccaacagctaatatttgctaaatgatgtgggagcgggatgtaggagagcatgctttggcaattaagcaacaaacatttcaaatcatatgtcgaatgccatatacattggtacgttacgttttttaattagatggtgagtgttgtaatctacgttacccagatacggggatatggacacggatacatgatacggtgatacagggcatacaacattttccaaaataatagtacgtaatgcatggcagtaagcgtgtgccatgtgctacaaatttttttaggcagttttgcacttttgccaactctcatctgaattctttgaggctcaggcaacaaaatgaaggctagtgagtactgacacctacataccaaaccccacctctgtccaaggtcttgggccttctacccctgctcctagctgcctagataaataagagctggttcaagattggctagccgtaagcccgagggtccaacccactgccgtcaatgacgtcatacattaaaatatggaggtagtacttaatttcttcaaagatagttcagacagatatatgtagggtatatagaggaaactaaacaaggggatagcattttgttttttcctgccttgatgagtgattcaattttgagtgttattatgagttagctaactccaaaagttggcatgcaattttgactagtattccaaaagtttcttttcttttcactcatctgtggagccttcatgcatcctttagttttgtttcatttctaattctccagtggggtccctcgccaagttcttctatcttgccaaaaattacatacggagttgcagtggtaactagcttgttggtacggcaagtctaagataaaagagatgccctgaaaggaaggcatgtctagtgacgggatgcagtgtatcctggcctgcttgcctgggcagaaacattggcctcacagcccacactaatctacctgagaggtaataaaatgcagtggtgtgtttctctcccaatgccacctactctcaaatactaaggtggtgtttggattcagggacttaactttagtccctatatttagacactaatttagagtattaaatatagactacttacaaaattaattacataaatgaaagctaatttgtgagacaaattttttaagcctaattaatctataattagagaatgtttactgtagcatcacataggctaatcatggattaattaggctcgatagattcgtctcgcgaattagtctaagattatggatgggttttattaatagtctatgtttaatatttataattagtgttcaaacattcgatgtgatagggacttaaaagttttagtcccatctaaacagggtctaactcatatgtaccaaatgtgcaactgtagtacgtgtgaaaactatggaggtacttcgttgctgtaccagatctttcattggtacctaatgaaatggaggtcgccattggaggttgctactttgagcttaagtttgaggtggaacaggctactcaagacaacaatgtggctacagactaacgtgaaattggatgatgatggctttatagatggccaaacgggccgtccggccctacatggcccatgtatggcccaataaggctcgggttgtgtcgggtcggcccgaaggtacgacagcccatggtacttcttcatagaataagtctattttcggggctgtgtcttatatgactagaacaagtttattttgtatatctcttctctttggaccttgccttatatggctgcttaagtatattttggatccctttactatttttcttcaaccgtgccgtgccgggctagcccaccgtgctaaggcatcaacctaggcacggctgtcaagccgtgccgtgcttgggctgcgccgtcgggccttgggccttatggccatttatagatggctttaaccaagatgggaaagttgatgtgcagcactgagagttttaaagataaaaaaaacacacgaatatgttgattctcgaggggacatcacctgcttgtttgcacatcatctaaataattatcaagaaatttgtagaaaatattaacaagatagattaatatctgataaatcactccaaatacatgcaaggtcaaatttaatttctacaaattgccaaaaaaataaatttgactatgaatatacctcaactagacagtatttttttgcaacttttggaagttgatcaattttcacttttatgtttatgttgagttctatcttgttgatatataaccatttggataatatgcaaataatgagggaatgttccctcgagagttgcgaatccgctctcaaaaaagacagtgagacaaccttgacatcatctctacacaatggcaaacagggacttatgaccggagatgatgca

SEQ ID NO: 60505 - DNA, 3832 bp, Oryza sativa
  unsure (1)..(3832): unsure at all n locations
agccgccgccggaggtgtcctgcagcagcacggtgaggaagctggggtcggattgccgggtcgtgcccatcgtcgcctctagctccgggcacggccggtagtagttcgccgccccgcccagcccgtccttgcacccggcgtcgaggccgaggtaccccgcggggagacccagcgcctccgacagcagctcgaacagccattccccgagccgccgcggcgtactcctcagccacgcccctgcacggcggcgggatctcctccggcgaaggcccctccggcgccatctccatgaacagcgtgtcgcgccagttggccgccggcggccggaacaggtcgtagttggagctgaaccgaaccttgctgccgacgtccctggtgtagtatggcgcctttgcctccaggggctcctcgtggaagtaccgcaccgctgcgagcatcgcatccgtgagctccttggcgacgtcgtggttgaccacctggaagaagccgaccgtctcggtggccaccctgacctcggcaaccaccctgccacggtcgacatccgccttagcgaggtcgatgagcgggatggccgccgccgatggcgcggcgatggggaggcactactacagaaaagcatttcagtgccggttgggagaccccctattgtgtcggttttcccaaccggcactatgttagcggcactaattagggagccagcaccaatcccattttaaaaaccggcacctttgagacttctgcgagccaaaaaaaacaaaagaagctcgagcatcgaactgttccccatcacccctagacccgtcaccccgagaccatcgatccgaaacaaaatcacactgtcaccatcgattcatccaagcatatccctcgaagcaaatcacagaagtttcacacaaatcacagatgaaggaatcacaaatcaatccatccaacacatatccctcaacaatttcatagaaagaatcaccattgccgctacgtcgccggatccgtcgcgggagtcgccgctaccactgctccgcccgccgacaactgacgccggatgtggctctgcccgccgtcaccaccccagccgccgtcgaggccggatccgtcgtggggccgccatcgctccacccgtcgacaccgaccccggccgctgacgccgccaccactgctctgcccgccgtcgccacccaggccgccgccgaggccggatccatcgtggggccgccaccgctccggccgccgacgccgaccccggtcaccaccgccaccactccgcccgccgacgccgaccccggtcaccaccaccaccgccaccgctccgtccgccatcgccaccccggccgctgccgaggccgcctcgcccaccgccgcatccgccgcgggagaagctgccgacgacgacgccatatgcggggaggaggaggggaaactgagagagagagagagaggcgagagagagatcgagaagccactagctcgtccttatccttatctcgtcctgtggggcccgccggtcggctcgatttgggtgccggtctttttaaaaaatccagcacaaaatgtaataggtgtcagtttttatttggaaccgacacctattattgcttaaaggtgccggctttttgcgatttcaacccacggaggtgggaaaaggcctataggtgtctgttttagcactaccggcacctatagtggcgacacatatttgatgttttgtagtagtgagggggtcgggctggtggtggaagaagtcggggacggtggtgacgccagcatcgacgagtctcttgacgccggccttggtgtcgtcgaaggcctggaggtcgcggaggcggtcgctgctgccggtgatggtggccatagctaagcctgcagaaacaaggcttggaacgacggtaagttggtgtctgagagctccaacacttgtatatccctcaatgaccagaaaaccattccgtttaaaaaaaaataggggctttctacatatctagtgacagaaaatcccacctcctaatattcaaattttggaccattgaatatgcttcaagattcatgcagacccctttaaccctaactcctctcctcctcccgcgttcagatcacaccgccaccactcctcccgtcctcgcgcgatcccccgccaccaccgccctaccgcccacctctccaacggctccccgctaacggatctggaaccaccacctgtgacctcctaaccacacgcttgctttgcccctaccgccgacgccggctcaccaccctcctccatccctgcggcttcggcggcggcgccgccgcctcgccacctgccaaagtccaccgcccactgccggtcctccgtcgtccacggtcatccctctaagccccgaggaaacccccctcttccccttccccaacccccctcctaccttgaccccaaccccaaaccctaacccgtatgctccctgccggagttggagtgtcaccggcactggagaagaaggagagccctccagagttggaggagagaagccggtggcacgaatcttggcatggatccaatggtccaaaatctgtaagatttcatccctaaatttcattcgaatgacagatagcaatcccgaaaataataatcacaaacatagcatttttctttattctatatccgtaactgttttcaaagtgctgcatgtattttttaatatttagtcacagtttgtggtttacaacatatagttaaatattttctacccttttgataggcacacaatctaccaccgggatacatcgtcgttctcgattttgaacttttaaatggatgttacctcgttgtttatatgtaactcaaataattatgacaaaaattaaaaaaagaaaaagatatattaccatgtgatatatcagtttataaatatgaaagttcaaattcaactcctaaatattgtaacgagataaaacaaattcaactacagctagttaacgtggtgcttagtggcaagacccgacaacgacaataatgtgtcgccgaacagtcagtaccggaatattataagacccgacactaatgtcttatcatcagtaccgggtgaattagcatgtgtataacctgaacttgtttttttttttgtttttggtgtcaagtttattcaaaccggcattgatgagggacacccctcttacgtggtagtagggctgtcaacgagccgagctcaagcgatctcgtctgcctaggctcgagctcgatacaagctcgagccgaacctataaaatattcgagctttaaggcaggcttggtttgaactcgagctcgtttttagacaggctcagttcgagttctaccgaacttgatttttaagtaaaacaatatatatttcaaggataatctttaaaaaaataattaatttcctgatcaatataagaggaaataaaataaaataaatatatgacgtcaatataaggcatacaaataatatatttgatcttctaatttattgaatagcaacaaaaaaacacatattattaggcccgttaaaagctcaacatcagcccgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60506 - DNA, 24122 bp, Oryza sativa
atagaaattcatatatattttaaggaattagaagagcgtatatattttagtccctcaaccatggctagggtcttattgtgatttcttaactacaaaactatttacttttggccccacatatctcaaatcatccacattacatccctagccttatgtccaaagtagggtggttttcaatgacttaaaaggtttattagggtctatatgtgctaatagtagaagacatgcatcatcatactaataaataacaaaaaaagcaaaataaataaaaaatgaagacaatatacatcatacataacctgtttctcctatatcttagatatggtttagctttaattcacaaactagaatgactcgtggtcacgacaaaccaccaataagctcagggatgaaatatggatggtttcatgagtcaagagaccaatagtgatcactttcatagttgagggaccaaatttcaatacagtctactctgcgttggaactatatccaaggtaaaacagtagagttcttttattaagttcaatctgttttcttcattaattggttcaaattaaactaacatattataagcataaaatatatagtgatcttgtaagctcatacaaattaaaagctaaacataacagcatgaaaagaaaatgaatgaaactaaacaggtaagaaaactccactaaaatgtgcttgaagtatgactacatattctatgacttaggctatgcatatgtaagttcagactctcggtgagtgaaaataagaaattttcataagaataatcagtaaatattaataaaaagaaaacaattgttgatgtattatgtaaaagtattacctccgtctcaaaataagtagatatcttgctatatataagcctatatattttgggacagagaaaacacttactacaatcaactacacgtactatgtattgatacttcctatcttggttcccgcttcaatttataaccttataagatagacacatttttttccctccaatccatgatttgtatatctacttcatacgatccgttgcagcaaaccgactatcatgccctccaatcaagctgggtttgctttctcctatcgtaaaatctaattcgagagccctttcgttttagcgctattgcgcgacactggcagagccgtccgatcacttgcgtcatcatggagtccatctgcgtgggccttgcagtcgcaggcgtggctttctggataaggatcgagatgaaaccaccccaaccacacatcacacgcaattcctgcttcatagagagtcacagagagagagggggtacagtttctcccccatgtcctttttctcttcaacaaagttttctctcaaattacttatccgatctacaatccgattacaccattgtatttgttacaattaaatcttcacaacaagatcttacatgattatattacgatgaaaaaatatttctatttgtaaattacttttattatatacataagttacttttatcatatatataagttacttttagatttgactaaattacttcttagacatataacagtaaattcaataaagtctaaaagtaatttacatatattataaaagtaacttaaaacaaaactgaagtaactttgtcatgacattagaagtaaattcgttgtagggataaaataggactttatctagaaattaaatttaatcaaaataaatcaacacacgtaagtttaacaatttttaaaagtaacttcaatgttaattggaagtaacttttgcatggttcaagttgaaaggagatactagatggagtacaaactagctaccactagctgtgtagtcacgtccgatgaaaaaaggcattaattaaagttactttctttttgttaaaagttacttctagaatacatgtaaattacttttaggctttattgaatttacttttatatgtctaagaagtaatttagtgaaatctaaaagtaatttagatttattataaaagtaatttattattttttatcaaaatataatcatgtgagatcttgttataaatatttaattgttatgaacacaatagtgtaatcggatcgtagatcggatgagtagtttaagagaaaaatgtatttgaagtataagtggatagtgtctctcatagatggagtggtagctgatttagacaaactagctaccactagccgtgtagtcacatccttctcctatgtctacctatctgtctgccagataaaatcaaaacatgcaacctttctatttggcattgttcctttttgcacgcaaaatctaaaccgagagcgctctcgatttaatgttaatgagcgacgcactcattcgtgagagaaggttcagtgctactagtacgtgagagaagggtcctgtgctgctagtacagctatgtgagaaaatgtcccgttgttacctgtgcacataatgcatatctatttgttttctttttatagaattttctctcaaattatttatccaatctacaatcagattacaccattatgtttgttgcaattaaatctttacaacaagatcttacatgattatattatgatgaaaaaatatttatatttttaaattacttttattatcggaaacgctatatttgtgatgccacaaatttgtttgttttgcagtcagatattttgactgttgatgttgctttaagatctgtgttatatattgccgtggcaacttacgttgcggctgtgattaattaaaacttagcatcttcattagttcaagctttaaagctattctttatataaatttataatgtagttacacaccacttatatcctacttacacgccacttacacatgtaattactatataattttgagacttacatatgtatttttgaaacttacattataaatacactaaatttacatatgtaatttatggacttacaatgtaaataaatgctgactattttttaataaaaaatatggtgctataaatatagctattccctttattatatatgtaagttacttttatcatatatataagttacttttagatttgactaaattacttctattcattcataatgcttttagttgattatttttattattgtttttagttaattctatattttgtggactttataaatcttatctacactttacttgcgaatttactctacatagttcttatttcagctcactcacaatataattatttctactacagagagttactccccccgttttataatgtaagtcattttagcattgtccacattcatatagatgttaatgaatctagatatagttctaaattaaagttactttccttttgttataagttacttctataatatatgtaaattacttttaagctttactgatcttaacttagtgaaatctagaagtaatttagacatatcataaaagtaatttatgatttttcaatgtaatatcttgttgtaaagatttaattgttacgaacacaacggtgtaatcggattataaatcggatgagtaatttaagagaaacttctctaagaagaaaaaaatacatagatatttagggtactagtagctttttttttttggaaagaagggtatctctctttagcagtatccagctacatgttaacccgtactacacacatcgtagataagttcgctggtgggagtgggtggcattggaatatatagaaacacaccggcatatttccctctaaagtagattagccaaaccaatgtctctgcccgggcaaattggctgggctagctactgccagtcttgtcagggcatctctttagcttagacttgccataccaacaaagctagatagttgctgctacaactagcaataaaaacggagcggatagtttccgtccactctagataaaaacggatacgtatacctttcagatcggataattcttggatagttcggatatgtatatgaatacggtattttctcccgaatacaaatatggatatggtatcgaggttttcatcggatacggataataattcggatattcggtgaatagtgttattcgggtatccgcagaagccttgaggtataccccatttctttctaactctataaccttcaatatacctttataaattttaatagtagtttatctcttaacacaagaccatactattaatattgtttaaattttaaaaaatatttataaattatatttcattttatataaaatgagctaattatatatgttgatatttgtttctattagaagttgagttggttttcgtgttccgaaaaaaaattgttttcgtatttgtgtccgatcatattcgattcttattcgtattcaatataatccgtatttgtttccgtattcaagctatccgtattcgttttcgtatctggtaaaaaatatgaaagcgaatatggtatgagcattatccgtctgtatccgctccgttttcatccctagctaaaacagcacctggccagcaaagctaattgatatggtgtggcaaaaagggcccttctgtagcgttcttttgtctttacagagcaaagccacaactctgtttgtgatttttaacaaggcagaagttgggcacgggacgccaccagagtcacactagcaatcactacttgaattaacagaccggtagcaagggcacggtcagagcagaggaatcacgctggtccggccgatctccatcgttttcgaggataacttttcactgtgctaaaagtttcttttttttttttttgtccttcaacctttcacccctgggttagtttttactatacaatcctacatttataatggtatttcattaccaccaatagatatgatgtattgatttacgatgctcttactttatttcacaatttctgtcacttcattctactatcagtaattacataaaagcttttcgtaagtgacatgacaaatgtaagttgttgttgctttaattagatggcgaggggtcctaatagatatgccagttctgcaaatgtcgtataactgtccaatgccaaattgcttatctgtattataaatgaccatttttccacgacatgatccattggaggtggtcaactacaagtccttgcatacccataaaaaataaaatatggcaaaggtttttgaaaaccacaaattcacatatttctagcactatacttggatataaaaaattgacacgatacaattatctttgatattaactttcataagcaacaaacatatatttatgatcaaaattacagagaatatgttgcctcaaactcactgatggcaccaattgtttaacatagagtacgaaagaaatgcagcatgtgtgtacatatctggaaacaaaatgcatcacatcctgttcacttagagcaaaatggtattgtataatgtatttgtcggtgtctactcctaccgcgcgtgcacactcgatcaacttggaaacactgaaagcaaaagatcgaacacctcacagagctaacacacacgaacagaggttattggcgctgcttgataagccacagattatcttgtttctctaaatttattcatagcaagaacatgtaaacgcgcagcgactggactcctaaaatggagaacacgatcagacgtgcgcttagcacgacgcaaggacacgaccacacgatcacacataaacagagaaattgctaaagactctgcaaaataatgagctatgctatgtacaacgatacaaccatggggttaactaacagtattctcgggcacataaggaacaaacaacaaatatcagtatagaggggcaatacagggagagagaattttacgaggacaaacaaaataagctataaactcctaggagcaaataaagagtttactcgttaagttttttttattgtactactttttcatgaatagttatatacattattttgttactgacaatactgcagccatcgactctggggctgtttagaacccaccccaaaattttaaaccctgtcacatagaacgtttgaatacctgcataaagtattaaatgtaggctaaaaaatgactaattacacagatatatatggattcttttttcacttctgtaacaagtaccctacacataacatgcaagaagattttattttgagaatgagcggcatctgaaaagaagcacatcgcagcatgcactagcgttgcgaccatcctgcaactctgagaggtttgggacaccttgctcattgacaatcggccatggacagtctaaattgtgatcgaggtcaaatccaagcaagagggagcggggctgcacgtatctgtgctaccaacctgtccaatgctcttgccccaaatttggcctattccacagcagagggtagcatttcgcaccctaattaaggtgagacatgaatcccatacaaagctagtggcacgccaagttcagatttgtgcagacacgagttttgccagataattcacgtagtccctctctggatttgggccaagacttcggccgggggttcctttcgtacatggagttttacatgttatttttatgacttgtggtttgattcctgccaattcctttaagtcctaaatataaatcatactgtggaggaattatatccaacaaagaatggctgatttctttcatcgaaaagcgaattattttcaacaatcatatcaacattcaacaattcacgtattactttctaagagtgaacccaccactaggagagagattatttctgattgtagcaaccaagatgaagaaaactccactgaaatttgcttcaagtacagactaactattatgcgagttacgttaggcatgtgtaagttcagtgattgataaatagcaaaaatctagaacagtgataaataatctaccctataattgaacaaatggttttacttatttactcattcatcatgtcacacatctaacggtgtaaaatcatcttatgagctagatcgaacgtgccagatgcacacgcgtgtcgctcctaatgccgcaatcacgggctcaccgcgcctcctccgcatcggcctctctcgagcagcacctcgcgcgcccctctcccgcaaccgccggacaccctcattggctccacaaatcacactgccatcgcggcgtcgccgtcccgctgctcgcacccctccgcccatcgcgccgaaccgcgccggagtcgccctccccagccctcagcgcatctcaccgatccacgccgccaggccagagtcgccgtctccgcccctgatctacgcctgggcgctcgcctccgcgcccccagatcatcttcggtcggagtcgccgggcttgtcgccaagccaatcccctccgccaccgataggaggtacagaaacctctgtccacccctgcctggcctctgtcaccgactctgccgtgtgggctctctgctcgcgcgtgctcctccacacatcccagcaccccgccgcggctcttgcccccgtcgcgtcggcgcactcctccggttattcccctccgccaccactgcctcctccgtcgggcctgacctctccgacgtgttgaggcactacataaggtgtccgatttgcttcctttttcatgtttgctatggttatctagatgctaattttgcagtagacatggggttgagctcacctctgttggcacggtatataagtcaatggaatgtccaatgacttatgaatcttcacttgtaattctggattgctttgggttttgggacttgcatttgccaaccaatgcataaatgcttcttccagcgttaaaatcagaccttagatgcaaatccactgtatccatactatcgagtacattatggttgcctataacccaatttggttcaccgatatatttctcaatgtcaatcctgtttgcatttttgggttcagcactctgtacttttcagttttcactactgctcgatggaaagaagccttcaactgcctgttagctgttagtttttacattctacggtgcaaggatccttggacacttaattagagcagcgtaaagaaattggattttgaagttcttttttgtgatgacaaatactaacatcttctctgaacttttgatttttgtattgcccttaatacaggcaggtaaaaaaacaaggagaagaactagcttttgtatagatatgttcatcacaattagctaacacatctgttaatcaaaatattttaactcttgccggtttaaccttacctcttgcatggagtccatggcataattcacatgattctaatatgtttgattcgaaaccatggcatggtgatttcagatatcaaagaaaactttaccatgttcatcgcttgctttgattccaatatgtttgattcaaaactgtggcatggcgatttcagacatcaaagtaaactttaccatgttatatccagctctggaatgacctgtgttcttatctcaaacagaagcataatatgtcgttacagctcagacctatatactatggttcatcggcagtgactcaatgtcatggatgtgaaaattgagaaagcttgacacgtgcttacaagaagaagatcccagttaaataagacattaccattgatctccggtgggcattttgtagaattgtgtccttactactatgatttgtaatgatgaagcgtgtacgatttgaaattaacttgttataaataagataaatgaggcgcaaaaagcaaggttgttttttctgcagaagccatttcaaaaggacttggattctgcagaaggacaatttgttgcccaacttagggagttatctgaggaaaaccagctctacagaattgattgctatctttttttttagtgcaagctaagaaaatggcttacacccaggtaagaactacaactaatatttgagctgattcttttttgttggtactcatgggggtaagtggataatatggacttcaggctcactatggtttggcatttttcaacacgagcaatttggaaaggattttatcagcatattttttattcaatccaatatatgttgttgatatatagttggagaagcatcgaatgactgatcatgaactgtaggaggtactaaaatggccttagaagaatagtttgttgtgccactgccatccaattttttatcatgagctgtaggaggtatactaaaatagccttagaagaatagtttgttgtgccactgccatccaattttttttttaccatgacaaattttagatatccgtacagatttaataaaggcatgcttcatgaacctgcactggaagcaattgtagcgcacaaacgaaagtgcttgttcaagaaaactaatttcatattctctatgtgggttctgccgatatgtgtgccgaaaccatgataagatggcaaaataaaggtggcaagaaatgaagtatgaactaaaaatttgaacttggattcctatatgcagtaacgcttcttcaagcagaacttctaggggaggctcttagatctaccgtatgttcctactgcaaatgggggagcaaagagatgaagcaccggcaaagctagctttgatttattattgtttattgagccgctttgtgaagtagctccttgcgttctaattgtgcttatgcccttcacaaattccatgataaggaaaatctcagtttcatgtaatttggcacatgtgcgtggatatagctaaaactgatgatttagatgacaaatcaagatgtattatggtaaacctttttgtgaagtttgttttccttgagtaaataggaaactttttttaaaatttgatgtatgttgttttgaaatttaagtcagaaatgtaattcaagtctgactccatttgcactaagaatatatgctcttaatcatcttattcttttacatcttgaatataattatttttctaatatgtatttgtacataatgtgcgttgcacgtgcatggttagtataatttttgtaattattttatctcattctatgcttgacaaaacatatatcttattttcgttgtttgatttgtattaccaaatatttccgttgcgttagcacgggcagaatactagttaatattagttgaaaagaaagaaaacatttgctgaggcatgaaatagacagataatctccttatttagattccattcaagcctcgttattattagtattagtgttgacaaccaaattatgcaatacaacaaattataacaatgtttagccagatttggaaaggacctcagcatactatcatgggtcggtcagacggtaggtatacgatcgtttagaccggcggccctcaatccgagtacgattaaggcagtttgtacgtttctttgcttgggcatgaggtttcttgagttctaattgatctataaacttaataggacatagagaaatatgcctatggaagaaagaccaatccctttatacgagctatgcctggttcgattctaacccctaaccacaatcccagctacacaatcgaatcgttattttgccttcaccattacttttaagtcatgtttctaccttatcttcaacctagcattagtctgcctatctttatcgatttgcaccacaaatcatccaccttgccacaaatcattcgccttagctacgagcagtgttgcattggggctgggtctgctattttgattttttatactcggttttataccaggagggatgggtctcactgcacagaatgggtgggaggggaggacaaaggaaactctgcttttccatccaatcggtactttgttggctggtccttgattggcgtgtacaattattttgtatctatagctacgagagtctgctaccgtttgtatatatgtttgccccgtaaatcttccgattacctacgaggcaggtggttatttccgtatcgatctaaatcagcctagagactagttttatgtctaaatcggttccgctagccggtttaatctgttaaacccatcttggtttagagttttctagattaagatgattggcgactctattaacacagtaaatctttaggtgagtccgtgttattagctagaaaggatgccaaccgttagtctattactttcttgaattaaaaggaaggcgctactcccttgattcatttatatatagtgtattttaatttaaaaagtgccccttaaaagattttcaccagtgattagtttgaatacaagtatgtgtaagattttcaccagtgattagtttgaatacaagtatgtgtattgcacaaaagttatacggttaaatttagtactttcacacaatgtaggttttagtgtttttatatggagatttactccggtccttatggtaccaaatcgttagatcaaactatcggaaacgatttggtactgtgaggtataccggtacctcggctcgagatacttttatatgtattaggaatgtactttaatttgtgaaaaaatagtggtcaaattttagttttcaaaactttcttaaaaaataaaatacgccatataaaagtaaacagaggaaatacttattaccaccacgacttaccatgcattgattcttgtatgctgtctcttgtaatatttataagctgcctggactgattttcctttctgtgcacgtccggtttgtcttactacctcatgatcttcatccatacctggaaaccaactatcacgtcatccaaagtaaagcaaggatatgcttagcttccaatcccccgtctgtgagtgaatctatcttccaaatgaaacaatgcatgctttgtatgtggcattgttcgccccgttcttttcttcaacaagagttatattaagattaagattttcgtagcacgtttttcaaactactaaacggtatgttttgtgcgaaaattttctatattaaagttgctctaaaatatcatattaatctatttttcaagtttgcaataattaaaactcaaccaatcatacgttaatatcacattgttttgcgtaaaaaacttaatctttatcttcatcttcagaagaaaaagaaaaagaacaccaagaatggttggcattggaaaacaaatacactgcacattcagaatctctcttactgttgtccagtcagcgtcggaggtatgggccgatgaccctgcgctgcaggccgtatgtcacccatatttttgggttctcgtatggaatctgcggtcagtagttgatttccgtggcctgggcttatgtaggaaagaagtagtagactgagctagaacctacgggcatgtgtaggacctagcagaggttccctgcagtttggaccgtcggccgtcttctatatctgtagcttgagatatgtatcgccgtgttcagttccaaaatatttcactaaacttttaactttttcatcacatcaaaattttttcacacatataaatttttaactttttcgtcacatcgttttaatttcaattaaacttctaattttggcgtgaacaaaacacagcctatgtatgtggctaggacaagagcgctagttgttgtcactacatgtcacgttaatttagaaaacaaaaaaaaattgggaatggaccgcatgtcatgtgtgatagtatctcattttacgtggttcatattgtggatttgttcaccatcctcattggaaacgattgttattcagatgagtttagattagtttccatgtggatgcatcactttaaatcttatatcttatagtttctaaatatgtagttctctgatcgataatagacaacctcaaaactgtagttttacgtacaacagtttgatatatgtagttgagtaaaatacacggccggtccctaaatttgtgtggtgttgtcacttagatccgtgaacttgaaaattgcacgtttaggttcataaacttggtttaatataccaccccggtccaaacgtcctttgattgcgtttgaccgccaacgtggcatgccacgtagataacacttttgctctcagcccctccgtatcacaacacgtcgcaaatatctccttgtagctatgtactgacaccagaataaaaaaaaatcctcaaattgttcttccatcttatttttctccttgcatgtatagagactgtggtcccaattatcaattgccattgctctgcgctccaaaatgaccttatccttgcacaacgggcacttgatcaacaacacctttttccggtgacttcaagatggggacgagcttggagaatccatggggatgcctagcgtgcaagacgcattgtgctgccttccgctgctaatccgaccgcactgtgccactgctaaccccgctgcaatgcgctgcctcctgttgctaatctcattgccgaggccgccacaaccgctacctctcggcctccttccgctaacctcactgtcgaaacactagccgatctaggaatattttggaggatttgggttgaaatacactggtcaagacaagttatgtgtgaaggtatatgtggagctgtggagggggctgcgcacaaaaatgttgccaacgtggcatgccacgttgacggtcaaatgtggtcaaaggatgataggaccggggtgcaggtacattaaactaagttcacataccaaaacatgcaattttcaagttcgcggacctaagtgacaccacaccacaagtttaaggaccggtcatgtatttcactctacgtagttttactaaatttacacatgtttgatttttcttcctctgtccaaaggttagttttgagtgatgtaccttctttatttacttccgaactgactttctatttaaaacatcttgtgacaaccaccaacccctattattatacttgtatatattattcatttttctcactttcccacctatatatactgatcgatcacagtgcaaggcctgcttcctctttccatttatctgccaaatgaaataattaaccactgctatctcttcattttattcaatttaattcctaacatgcacactacacagatcatgcaagagttttttatcttgggagtgggtggcattagggtcttgcatattgatgtgtatgttgctacaaccaacattacagtcattatgcgcgccaaaccggtgcggtcgcccagggccctgggcacatcggcagcaggccaagctaggcagcattgcattttcgtcgagttcaatggaggctacacggagtattggaggctcagaacactggtggagaaaccctttttcctcttggttcgtaaccccctttagtcccggttatccaaccgggactacgaatccgggactaaagacaccaaccgggactaaagatcgatctactaattttttttatttgcatggccctgttcgttgctgcatggttaattttatatatatatatatatatatatatatatatatatatgtattccatatatatatatatatatatacatatgtatatgtataaatacatatattataaattacacatgtataatttaaagcacttaacattttatgtgcatatatattaccaaaatatatatttacactaaagtaaatgtgtacatctataaacatatacatgcatgtatagtacaattcatttgctcgctagctagctagctatgacttcgacgccggcgttatgtcagaagaagaaggaccgatgttatgaattgtcgatccgtcgtagtagaattcacccttgggattatggacttcttcgttgatgaatcccatcagttgttcttgaacagccgtgataaaatccttgtgtgggagattgtctcttatgtgaatacgctatcattcgaaaaataatgacatatcaatatatgaaattaataaagagcaaatcgatacacaatgaaattttgaatggtttatatatacgtacatcgagctctcgtgtggtgtagatttgggttgataggcagtgggcatactcgcatacgtagtagctgcacaagttagttccttggtcctgctttgcacactacatgagaaacgacgagagatttaatataatatacacttatattaattgtaattagagattcaattcaatataattttggagcatgcatgtacttactggaaaattaaacctccgtccaagtttttctttccaagtcccgcggaccaattgacggaaccgatcccaagccctacatgcagtttcaagctatgattaattattatccgagatccgcataatagcaacaggaaaaatccccgtgacttagcaatagatggcattatattacctgtctatcagttgaaaaaacttgtcaaaagtcttgtcctctttattcattgagtcatacacattgactttgcatgcgtccaagtcgaaaagtaacaggacccagtggaatctgcaatatgcgagagatgatatatgaaaatgtacatgttatatgtatgggaaagaaatttgttcgaacgacagtaaaaactcactctgtgttgtacggcagtagtatgaatgtcttgaaatgctgctgcgtcaggagatggacgagattgtcctctgtgtctttctcatacttgtcgatcatttcgacgttgattttccgacggtcgatgaacccagtatcgtacaccccccaccatcaggccctttgaatctccattctacaatgataaaaggaaattattattgtttacatatatgcaaggagctaattattgaacgaaacaaattaatcgaactcaacgatacttacaaaatccatgcgctcagaagagagacgtcgagggcgtccagatggtatagttcgaagacatccttgaattcgatccagagaacatcttctctttgcaagaagtcggagtttctgatccttgctctttaacatctctctacccttggcgctcatttccatgtaccgttcatggaacttgtacatctatatcggtagggactgaagctgctcaggcgtgacaagcggtttaccgagttcaaacttgtatgccacttctgccttcaggattggtgcgcctctaatcaactgatccacagttagaccagtgtcagaaatgaattatgttatgccaatttcttcgccggtcaccaatggctcgagctcttggtttggttgttctccaagctgagggactggtttggacttcttgtaataggctttctcaagtgttcggtaatagtccaatagctttaaggcctccttgtttgttgtggacattttaatgaacaagttcttcacgcttgggtcaacaggtatcttcttttcaggtctccgaggcttgagttgcctcttcactttggaagccacgtaagcgtcaagctcctcttgactgcaatcgtgaggcggctccttgtttttggtggcgtcaactttcgccttcttcgttgcccttgtgtgggcaggtggtggagcttggtgagaccttgtcttgggaggtgtaggcggacacgatggaggcgaaggaggcggaggagccggaggtgatggtgcaggaggaggtggcggaggagatggcggagccggaggtgatggtgcaggagacgctgcttgttgcctaggaaggatgatgtagcgcttgcgccatagtataatggtgtggcttgtgtctcgtagatgcgtctcaccgtctcctctagggtagtccaactcgaggtcctcgtacgctcttcctgacgacgggaaaatcgggacggtcgtagcactaggtccgttatccgcaaatcgttagagacaatttaatttaaatacaataaataaataaaaatcagaaattgttagtccattacttccagaattcatacatttacatagaaattctgttaattacatctccgtagagaaaacccctgattaggaattccaacataaaagaaaataaaattacatgaccgctaaaaggctaaaaaggaaaatctatctaaagctccagatgtcgcagccgtagaatcttctgtagattttcatttatatgtttcattttgggcgtccaattattttagatgcccactaatttgttggtttttgatatcactgcgtgtatggtggcagatttgcatatagcttaccttttttggcattgtgacggtaccttttttttatatgtagcacgcatatataaattgataaattttcttgagcactcgcggggcgtagccaaacgagtatttattttagtgccattattatcaacgtgtcatgggattttgatgcggcgcattgcattgcctattttaattttcaccacacctgtattactactagcatggccctgtaccatgaagcataaccgaagtgggcatttgtttgatttatggtcgactatcacgatgtcaccacttgttgtgcgtacatggattaatttgcaattggaaggaaaatgcacggccagagtatatggatgcatgcatgtgcgaacatcagattattttttatactgcactttatatatggtgcagcgagtatacactgttttaagcaaatatatgtatgcagatgattttgagattataattttcactccacttgtattactactagtatggctcgaagccgtgaagcgtaaccgaagcgagtgttggttaattttatagccggctgtcatgactcagcgtagttcgtgatttatccatcattttgtagataaacagatggaaggagaaaatatatgcatccgtacatctatttcctatctctgaccatggaaagaaaataaacgccattttattttaattcttgttagggaaatatggctgaacatatgtcaaaactagcaaatatgcgtgctaattaattagtatgttcaattaatttgtttatcactatgcctgtatcactactagcacggctcgaagtcatggagcatgaccgaagcgagtgcttatttaatttatggtgaagtatgcaaaatttatgtttagtttatgaaagtgctcaggggaattaaacgaatgcaaccatgcatctatttcttgttcctgatcatggaaaagtgaatggcgccctattttaatttaaagaaatatggccgaacacatgtcagaattagcaaatatgcatgctaattaatatgctcaattgattttatgcatcactattcctgtatcactactaacacggctcgaagccgtgagcgtgaccgaagcaagtgcttgtttaatttatggtgaattatgcaaaatttatgtttatatctgtgatttgtatccgctcgtagaggaccgaacctgagagcaagaatctcgcctaggcttgtatgcgctaacgggaccaaaacaaagggtatggtagaatgacatgaaaagagtatgcatgaaaaccactcctaggcccgtactcatctggccggaccataggaaaaagtgtgaaatcatgttaaaagccatcaaatgaaacgaacttccttgtctcatacgcattggctaagacgaaggacacaacaaagagaaaaaatttctttggttgtactcatgatggccaagcctaggaacatggcaagaacataattccttggttcgtactcattggccgaaccgaaggacacagcaaaagaatacattaacacgagcagagaaaggagaattgagagattcctcgactcgtacacaatggccgagcctaagaattaggaaggagcatgattcccaccttgcagcactcgtgttcttccagcgccgcaaagcgaatttcctggtgaagcagaagaactagtgctagcaaatttgccgtagcagactaacagcacttgggcgtagcgaactagcaatctcacagcctcaccaacctttctggaacctctcccccgcgaactctgcctctagccttgatcctctatttatagaggaggattagaaggggttaatttgctttatgtgattttgaacaggatcccgcgcgcccgcagagagatcgtggggtgtggttgtgggcaatggcttgactgcatgcacatccctttggctgacatgtgggcccgttcagtttgacgggacgaatgtgctggtatttgctgcatgcttgcatgattagtggtgatcgtgggtaggctaagggcttgaccacttgtctctttgctttcactgccgtgtgggccctttggacttgactgatttgttttctttagatttcagttgttagtaaatacatgcgtgtctctttttttatttcaaattttattttattattattttttttgcatgcatgactattctgtatgtcctatatttttactgcatatactcccatttaattgggcacctcaatttatttacttttatacacaccttggatatgagtcttttctttttttaaagaggcacacatatatattctagtgcaccattttctatcgagtggactgtcgctgccgcaaatttattttatacgacactcatcgcgtcctgacgtgcatattatcacggtggcttcctcgagccaacatctagacgtcgagataaaaatattggataatgtcatacacgaccccccctttaattgggcgcacatgtaacatgcatttttattgtaagtcgcgactatttggagtataattttttcactagctagctaaacatctattttggcttacattttaatttttttttgctattttatatggtgggtacgccttttctgaaaatattcggggcgtgactatttcgggtcagtgagaaaatcccacttcatggccatatgttttaggccaaatttcgtatgcggatatgatgagaaagctaagtattagcgttcgccggtccgacgaaaagcgcatgaaaaatatttgttcacgctacttatatggaacgcgcatatgcattcctattttaagccgaaaattattttagtccaatataagtgaattatattttatttcctggccatttattttgtggccgcaatttaattaaattacttcaccatctgtctcccaataaaattcttatttattattatatattttttgtaagcactatatttgagataatatattagtttataatttaacaaattatatttaggacacaagccaaaatccatgtcaacacttccaccaactcaacttcgactgctggaatcggcctgcagtggtaagtccctaaagggtccattgggatggccattcacgacgccaccttcacgtgatgagaggttggacgttagtaatcaacgtaagcaacaactggcggaatgtacatgtcaaaaatcataaaactacaagcataccttgattgataatttcttaaagggaatatgcagctcacatggtgtccgctgcgtgatttcatcgacggggcaagtggtttggtcctgagtttgcatggcgtccatgctctatgatcctacctgcctcgttgaggtgcagctgctacgattgcctgaggggctgactattacatgaggaatgtacagctggggatcctagcaccgatgtgcggccatgtgttcatccaccttccttgccacctcctcctgcatgcttagctcgtaactcgataccctgtacttaagatctgcaatcttcacctcagtatctctcttgttcctcatccgactcctgtacgtgtggatgtcctccttgaatccaatcttccaaggaaccacgcctttccctcgtgttcgtcttggatgctcgggagtctgcagggcgagtgacagctcatccttctctctatcgagtcggaacgtgccctgagaagatgcttccactgcgtctgttagtcgactggcagcttcgcgtatctgatcgctgaacgccagggagccatcaacggggttaagcgttccaccatgagcatagtaccagaacttcgatcgatccggctatttagtggtggccggttcgatacccctctcaatcaagctggcttccatctcctcccacttcggcatcgcgacgctataccggcctgaccccaggtggtgatggtactttttctttgcagcattttctttgtttcggtccatcatcgcttgcccttgttgccctgtcttgtaagcaacaaactcgtcccagtgatcccttagcttcgggaatgtgttgaagttcggtgtcagccccttcaggatgtatttcttgtagagttcttccttgaagcactagaactgttctaccattttcttaagagtccactgtttcactatgttctccgtacccgcagggagtgtgaacgtctcgagcattgtggtccacaacatctctttctctgattccgggacaaagctgtcataatccccacgtgcccttgttctaagccagtacaccttgctgataggcacgttatccctcacaacccaaccgctgtgtcgtacgtaattcttggctgcttctgctggggcactaggtcggccgtcttcgtccacttcagttttaatgtgccgaccctctatcttctttgcggcacctcgttgtctgcgtcccctcttctgtgcagacgagggttcatttccactagcctcctccccgttcccctcctcgttcccctctacgttcccctcctcattcccctcctccacgttcccctcctcattaacttcctcgttcaagtattggtttggatcctcgttcccctcttcttcgttccagtactggctgcttccctctgcgattgtatcatacagtatctgttcgttatcgcgatcagccatctgttcatacaagaaatatttccatatataatattaaatctctagtaatcatatgctaactctagtaatcatatattaaaactctaataatcttatattaaaactataataatctcatatggtaactctaaataatcatattctagctctaataatcatatatgaaaactctaataatcatatgctaactctaacaatcatattatatctctagtaatcatatgctaactctagtaatcatatattacatcacttgcatgcgcaaattcctctgagggctagctaccatttagtcttgagagacgacgacgacctcttttctgcaacatgcaaaaaaaatgtattagtctaaatgcaaaggaacatactttgattagtgcaagatagattaaactaggtcggaggggagtagaagtttaggttcatggattcattcgcgttcgttcccgtttgttcgcgttcgttcacgttcgttcacgttcgttcccgttcgtttacgtttcgttcacatttagttcacgttcgttcggcgttcgttcgtgttcggtcccgtttcgttcacgttcgttcgcgttcgttcccatttcgttcacgttcgttcgcgttcgttcccgtttcattcccgttcgttcccgttcgttcgcgtttcgttcacgttcgttcgcgacggcgtgggcaaaggtagtagcggcttcggcctcggcaaaggcggcggcggcggcgacagcgagacgacggcggtggcgtggcgcggcggcggtggcataggcgtcgtgcggcggcggcggcggtggcggcgtggctgtcggtagtggcggcggcatcgtggcgcagcggcggtggcgtggcctcggtcaactccaaccttgttaaggtcaaccgttgtcatcccactgtcatcaatcgttacgcctccaccagtcagcctaacccattggcaccgaacagagggaccttgagaggtccatagtcaagttcccatatgtcctcgatggcaccgtaatacgtgctagttgtaccatcgtgtcccatatcatctatacgaacaacactattctggttcgtgctcttcatatcttaggctctcgtgtagaatgtgtaccattgatctcatatccttgcatgtcgcgatcgagctagatggtcccctcgccaggaaggccagttgttggttaatcgtctcgttacccatgagaagtcgcagccacgcggggaaagtatcaatgtgatgccgtgtaatccatgcatcggacttaccgatgtttctggcgcgaactagagccaagttctcctcgatgtaaggagccaccaatgaagattgttgcagaaccgtgaaatgggctttatggaataaattgttgtctaccatcattattgctttccttccgagagtcccttttccccgtagtctcccttcatagcgtgattcgggcaccccaattgggcgaaggtcttcaataaattctacgcagaattcaatgacctcctctgttccataccccttggcgatgcttgcctctggacgagcacggttatgaacatacttcttcagagcgcccatgtacctctcgaaaggaaacatgttatgtaggtacacaggaacgagaaagcagatgcgtcattatattgaaaaataaaggtggaaatatcaactcaaagctaacaagacattgcaccatatcattttgaaggtgttctaatttatctggatcgatgaccttctgcgaaattgcgttcatgaaagcacagagctttgttattgttgcccgaacattgtctggaaggataccccgaattataactggtagcagctgtgtcatcaacacgtgacagtcatgagactttaggtttgtgaacttcttctccttcgtgcttattattcgctttatattcgtgaagtatccagacggaaccttgatgctctccaagcattcgaacatactttccttctctgccttgctaagagtgtagctggctggactcaagtaatggctacctttctcctttggttcagggtgaagatcgctgtgttgttccatatgcttcagatcattacgtgattccagtgtatctttctactttccatatacacctaggaagccaagcaggtttacgcaaaggttcttagtgaggtgcatcacgtcgattgcgtggcggacgtccaagaattcccaatagggtaactcccaaaaaatagagttctttttccacatcgccgtgtgaccatcttcgctctcaataggctggctgccaggcccctttccaaacattactttaagatctttcaccatagcaaacactgttttcctgctgcaatgtttaggcttcgtacggtggtccgccttatgttcgaagtgcttgcttttcttccgtacaggatggtttgcagcaaggaatcaatgatgacctatgtacacaaccttcctgaaatgcttaagatacgtaccttcagtttcatccatacagtgagtgcaagccttgtaccccttgttagactgcccagataggttgttaagtgcaggtcaatcgttgatggttatgaacagcagcgctcgtaggttaaactcctcctatttgtcctcgtcccacacggggacaccttctttcttacacaacagttacagatcttcgaccagtggt

SEQ ID NO: 60507 - DNA, 910 bp, Oryza sativa
tgctgctcatctctccaaaaggattcatgctatccgtacttaaaccaaaccgtatgtttcgtgcgtcctttccaaagtctttaaatgttctgtcgatgtttcgccactgcgaaccatcggcaggtgtctcagcatcccgtcctgttgacgttcttcagcgtgccaacgcatcattctagcattccccttgttcctgaacaaacgccttagccgcggtcctccttggcgtcctgcaacatctaaccaagatcatccgtagcgtcgttatcgtcagcatccctgtccacctcgcccgtttgatttccttcaaatccagcgtactgagcccagtccggaatgttctcgtcttccacttcatcttcttccatttcaacccctttctcaccgtggaatgtctaacaattatagcttggcatgaaccccgactcaaacaagtggaaatgaatagtcctggatgcataatactccttctggttcttacacatattgcatggacgacaaataaaacccttatgcttattagcttcggccactctcaaaaaataatgcacgccatcaataaactctttcgaccgccggtcagcgtacatccattgccgatccatctacatgaaatgaaaaaaaatcatacataaataaatattcgtacaataatgaaagtggtacaataatgataaaataattaaaaactctttcaacggttatacaataatgacgtatcattattcatacaataattataacataatccaacaaacaattcttatttattttttttgaagttttaaactaatattaatgttgtgcttcttttaattttcaatttagtttcttttctattatttaagattaattttcattatattttaaactatgagaataaaactttttaagtaaacaaacaaaattc

SEQ ID NO: 60508 - DNA, 40900 bp, Oryza sativa
acatgttcttattcttattcttcctaatatttcctccgtccaaattataaggcctatatttttttatatagtcttcagtgatatactttgaccattaatttattccatattttgtttccaacaaatatgaaattagcatcatatgaaagtactttagaatatgaaactaatgatatagcatgcataacacttacagatatatagatatgattggtatgattattagtcaaaagttatcaagtttattcttaaaaaaagttatcaagtttaacttttcagaaaaaagaggacatcctataaattggaacggaaggagtatgttggctccactttccttatgaatgttaacaattgtagttagttgcatggggtgaggattgtgcataaactttatgggaactttcttcttggtaaatctctcaatctcttataaagaaacatgcgcatggatttggtctctgttgttctcacttctcagtatgttcgcttttgtgatcatatcatgcacaaattatcctgctttccagttagttgaagccacttttttaacacttcacacattacttagatgaacagtgttagtagttcgatattgggaagttgttaatgtgaactgttcttcagaagtacatctctatatatgttatcacttacggtggttgttgatgttaactggacctcgatgcatacatgctattgagctgcttctttatactttttccttgagcagaaagctatacgtgttttttctgtgattctgttcttgagaatatagtaaaggaacttctttttcaaagactgattaaaaaaacatgacctttgaatcaagcttgtgacctctcagataacaaactttttctgccacctagttatgagtataatatggcttacatttacgcaggcgaaaaatggaaacgagaaaagaaaaggcacaatgagaaacaacggctgatgtatctattatgttctgcccttctttcactgctgcaaaatcgattttcccaaacggtaaaaaatcaattttcgcatgtggttggtcgaccagcatgtgtgaaaagatccgtgaaaatcatcattttctcatacaggtagcgcaaccacatgtaaaaacgggattttcgcatgcggtcaccttagccaaccgcatgcgaaaatattttcggcgaaaaaaaataaaaattcaaaaaaaaaagccgaaaccctagctggccaccagccacgccagatgacctcatttttgcatgtgaaaatcgattttttcatgcgagccagcctcttaaaaaaccgtatacgaaaatatcctctcgatttttcaggtccatttataatctacggagggtctcgtacaaacatttttaatagtgtttgttgtgacgaaatgtcttaatcacatggatggcggggtagctggctgttgcagtagcattaactgccaactgtgcgctgctaatctgatttgatccaaattatatggttattaatcaaatcgtgcccggagaaagcttctataagatatgctcaaacttgtatattttggtgcttctgatgctgcgacagtgtgatgctctcgcacatcgattggtggaacagagtatcccggtcaaagccattagccaccatcccgacgtcttcctccatctcgcatatctctgcaatggcagggaatgcgtcagtgatgcggaggctctacctctctttctacaactggattgtcttcatcggatggtcagttctactgcctgctgtttgttgacttgtgtatgaatatcgatctcacttctagcatctttctttgctggccaattcttggattgtacacagggtgttgttttgatcgaggatctttgatttggatcatgcagggttcaggtgtcgtggtccatgatattggcattgttggagaacggatatgaggccgtctatgctgccgtagagcagcatctgctgttcgcgcagactgctgccatcatggaggtttgtttttttttttctcttgttgcctttgttgtagtaaaactgtaaatttgaatgcagctgtacaacttttttttgtttcattgctcatggagattgagaggcgctaaactttttatgttttgctgtttgcctggtgatggtgatgctggtagtgcagattcttcactccattgtaggtgagatatcctctttctttataaagaaaataataagtaataagggttggtgaggtctccagtgtcttctactattccacaaatcactggaaggttgttcatgatctggggcatcttgtggagcttccctgaggtaatatcaggaccttactccaagttataagaaggtttatatcttaaaaaacaagttttggattagaaagcacttcttagaatgatgaaacatagatgttaggtaatgttgcagctattagaacatatcccatactttcatttatgatcaaaatgactctaagtaggcattggacaaaccgaagctacagaaattgcttaagtaatgaagcggatgcaattacatcatggagaaggacaaaatagtgttcttttcctagattcctatttcatgtatttaacttctaatcaagtaattgttttatttataaacaatatcggtgaatcactgtccacatgttttgcagacacacactcatatttttgttacctccttgctcataagctggtgcatcactgaggtatatgttacttcctaaaacttctcaccaaattactcacttggaagatcatggatttcggatgcaattttattatagttctgcttcttgaaatgacagtagttgttgaagttcctgaaagaaaatcccaagctttgaaagttcctgtgttgagcttagttgaacaaatattatgaaattttcttcacttcagagcatgactttgtagacaaaaaattactaattccttgcaggttaccagatattgtttctatggcatgaaggagtcatttggatttacaccttcctggctcttatggcttaggttggctctagtcgtaaacaaatcataatatgtagcataaacttcagcgaattctcttaaaaatatgctgctgttacttccatactaattactttgcaggtacagcaccttcatagtatgccttcctgttggtacggttagtgaggttggcctaatctacattgttcttcctttcatgaaggtaacttaaataacttagaaaggaagatctctgcctccatttcataacaaatcttgtttaaatgctcttcttttgcatgagcaatatcaggcatctgggaaatactgccttaggatgcccaacaaatggaatttctccttcaactacttctatgcctctatctttttcatggttttgtatgccccaggtagtgtttccatgggattgtacttcatttagtaattgatgctacaacctagtactccctcggtcctttaatatatgacgccgttgatttttgttacaagttttgatcattcgttttattcaaaaattttgtgtaaatcttaaaaatataaataatgcttaaatttcatttagtgttaaatcaagaaaaatatttacttaaattttttgaataagacaaatgaccaaatataatgtaaaaagtcaatgacgtcatatattaaaggacggagggagtattttttttaaggtagttgtaggaatttctgaaatgaaaacaattaggatttgataacacactgcgttgttgtttcatttggatgagtgcagtatatccacgcttgtttcgctacttgatcgcccagcggaagaaggccttggcaaaagcaaaaaccacataactatactcaagagctatctactctgatttctgctcgcggctacagctcaggttgctaccgtttcttgagcaaataagtaaaagtgtattagaatggaaatgccgaaatacagactatcttttcccttggtaaataaaaatgtacacgagtaccattttcatgatttgctaatggtgtgtcctaccaaagatcggcttttccttctgtaaataaaattgtactccatatctgtgcccaaaaatgatgtgtagattttctgctttttaaggatgaagaaggtaactatcaccatttgattcatactagatgggctggcgcggctcacgccgcgctgcacttgtggtatcattgaacacaatagacataaaacagactattggtaatgacaataaaaacacaagaacatttaaataagttcacatgctaacaaagtcttttgtctgtttcaaattacttgttgttttaactttttctaaataaaacacttgtatattctatcatcaattcctaaaaatcaacttaattaaaaatcgtaagatctatgttttagattcaccatgaacaatacttttacaatatataattcacatcttacttaaattaaacaaggtttttaaaaaattaatgatcaaagcgtttgacttagttaacagagggagtagctaagttaccgcagttataggctttatcaagcctgtagaaatcaagaaaccgctcagcaaaataaccaggtttgagaaaaaaaatgctgaattcaatttttaggcaaaatctgtaagaattcgccccatgtttttgtcaataatagagtgaaaccatgattactggaagagcaaaatcacttacgaagttatgattccctgcagacaccacatattacaaatgtagatgatgcttgtccgtctgtattcccattgcccaaacccctcaagttaaatcagagacaacggaaaagataagaagatacaaaacgacacttcttacatgacacataaaacaaaaaaaaaagaaaagaggaataaacaccacacacatctacaaaccatctctgaatcttgttcagttttctgctcctaataacagctacagtgaagagtgacatgatccatgccccctcttctgccaaaatcacaacagccttgcaggcaatgccggtgacgggcggcgttggtcaggcgaagcggttgcgacggcaggcgacggtggcgaggaggctagcgatgccctttggttcacatgtcaatgctctctatggatgctgcactcgaactcgatcacccggtgctcttcatttgctacatcattttcttcaacaaaatcaggacatatcacagatatctctttattttttctagggtaatatcacagatatatcaggggtacaccgtatacactcgtgggtatctaaaaatttatagacatgcagtaaaaaaaaataccacgtacatatcgtcagaaaggccatatacgagcaaaattcgttcagatgggctgaagggaagagtttggcgtttcagtaaaaaaaaacaattgattgattctcatataaccatcctgcaaataatacttgaaaagattgctactcttatatggcaaaaacaaaatcaacacaagaaaacatttgagttgccctgtcgaaccagaaattttcaaaaacctgctactccatcaaatgtttctgacaaaacttactaatatggtataaatgacggagggaatgagaagcaacaagcacaccaacattttttcagaacaacatagtggaaatctagagccccaaaattcctaggatggattcattatgaatagagcagcacatttttagttgctttgttgaacagagcaggatatcaaagctcctgaacggaaaactcactaaaaagattatcatggacagatttgtgctactttactgcataagaagactcaagtggtcaagaacaagaatatgactgaacacaaatttatagaacttgcaggttgcagcaaatagcaaaaaggcggttcaaacctccctaaataattcagagcttcgagtccgaataacagaagctcgatggggctcatcacccacgcatagatcagagcttggaccacgggatgcagatcgcttttgagctgctgtgtgctagattcagttcgggtcaggggcgccgagatccattgctccatccatccgccatcccatgaaaaaaaatgcaaaaggagtaaatcggtcactcccgatgtgtacctgctcctggccgcacaaactttgcagctcgagatctaggggcaagcagacaggattcgaaacaacaaattccacaaaacaaaatgaaaaccttcgaatgggaaacaaaaatggaaatgaaacaaaatcatgagccaatcgaacagagtgaaaaccttcgaatgtggcatgttgaccaagcgcttcggctgactcgaaatgattttgttgaatcgaatagcaaatgatcaatggtgtttgggtaggttacctttgcgggtgcgcttgaggagtcggtgccacgggcgaggagttcttggctgcagatggtgaggaagttgttgtcgtcgtcgtcgtcgccgaagctgttgctcgtgttgctgccgttgccacggtggcggtggtgatgctgctgcttctgggcgttgtgtttgtagtgttggtgatggttgatggcagcgatggcgttcttctcgacggggatcacagcggccacgttccacacgtccctgaacgccctcgccttgaccgtcgccacgcctctcaatgctgcgttcagatatcaagaacaagatcaatcacggtgcctcgatggagatgatgtgaatgggtggaacagcgagggcgaaccgttgccccattggcagcggcggcggtgatggtgacgatgtcgccgggaggcggacgctgacagtgaaggcgacggcggcggtgaggtggtcgcgctcggcaccgagggactcggcggcctcgacgcactgggcggggaacagcttcgccgcggacggaatggtcatgttggtgcgcgcagtgcggtcgtccctgccactgctggaggacgcggtggtggtggccaccgctgccaccgacacggcggcgtggacctgcgcgttgtgcgcacgcgtctcctcccgtcttcttctcattccctccttcagccacctccccaccgtcttcccaccgctgccgccgccgcatcgatacggctgcagcttcggcgtgctcaccgctctgcaaaacaacacattttttttcaaaaaaaaaatttgttaaattagcaaataactaaggaagaggggtaccagctccggcgccgccggcagccaccgccgcgaggtgaggaagaagaagacggagagggacatcgacgtcgaatccgacgcgccacgcgtcccgacgacaccgtaaggggaaggggagggggacaacggcaccggcctcgacgccgtcgcaaggggaagaagaagaatgttagttgcgatccaaattcatttgtacttaataaaggccagcttctgccgtagcggagtggatcatcatcccttttagggttccaccacatatatatatatacctgttgtaagccgccgtgcggcgatataacctcacctcacatatagtgaagataattttgctggctggcgcctgtggttttttctctcctgttctgagagggttttccacattaaatctcgtgtcttctgtgattgatctattgttcttcatcgtttgttcgcctatcgttccctaacaagtggtatcaaagcttgttctcatattagggtttcgcgatggcgtcgatgaagtatgatctatcgctgctagactacaagatgagattctcgctgtggcaagtcaagatgcgggctgttctggcgcaaacttcggatctagatgaggcgctggagagcttcgggaagaagaaaacgactgagtggaccgctgaggagaagcggaaatatcgtaaggctccgtcgctgatccaacttcatctatctaatgatattttgcaaaaagtgttgcaggaaaagactgctgcagaactttggctcaaactggaatcgatctgcatgtctaaaaatctaaccagtaagatgcatatcaagatgaagttgttctcgcacaagttgcaggagatcgttgccgacctagtgtcgatggaggtacagtttgatgatgaagatttaggtcttttactgttatgctcactgcctattccatatgcaaattttcgtgacaccatacttttaagtcgtgatgaactaaccctagcggaagtttatgaagcgctccaaaacagggagaagatgaaaggtatggttcagtctgatgcgtcgtcctctgagggcgaagcattgcaggtcagaggcagatctgagcagagaacctacaacgtgtcacgtcctaataaattcatcccgaaataaaaatcattttctaaaaggaataatagaattaattaaaattctaaaagaaattggcaaacactaaaatacgtacaagaaaaattcaaatgtagcccggagaatttttgttaaattctccttggtctaaaaagagccctcaaattttacttaaattttcagagcaccggaaatatttattaagcaacaacaactatgatcaaagtttacttaaaaagaaaaacctaaaattaatccccctcctccctttgggccaagtttggcccaaagtcctctctctctttctctccctctccgtctctccctccttctcttcggcctccccttcccctcccggcctactccctcctcttctcctcctgggccgcctcggcttcgcccggcccaagccgagccgcgcctcccacccgtgccgcgcacgtgcgcgcgcgtgcgcgccgttgccgcacgttgaccgcgcgcctcccgcgtgggtcccgcctgtcaggccgtccccgacctccagctgccggcctccttcctctctctcccgtgaaccttagcgttgttcctcctccaaatccaccccattcaagccggctctttccaaattaaatagggggaattaatctccattgattcctctttgatttcccccgttttcccccttgaatcgtgcccccaatcgccgggaacggacgcgccaaccccggccgccattcccgcctctgttccggcctctctcgttgccggctccctccccgcgcctataaaatggaaccccctccttccgttctccagttttagccccctcccgcgctctcccgtggccgccccacctctccccgtcttctccttctctctctctccggcgtatggccatcggggaacagaccagctgcacgttcatggaggttgctgtgcccaactcctcaaacagagactgcagccggcagtatcactttcagtcttgctgatgctcgcaagaagtttgcagattgatgatgttggattttagtactagatgtacggtaggtaactggacgctgtgatttaatttagctccatgaataaatcggacaaataagatgggagcaggggttttggtagtttgtgcatgtgagaatcgtacaaattaattaaaatagttccaagaaagctcccatgaagtgtactgtaactttatattgcattttattacaagttaggtgggccatgcatttgtaagttcaggggagtgaaaagaatttagaagaccaataattagtaatacctgaaagaaaataatccctaagagttgggacgtgtaaaacaaatatcatcgtcttgatgaagttatggagttatagttgtgggactcgttttttttacataatggattaaaccggcctctacatccaaacggatgtacacagccaaagttgtgggactcattttagtcgagataaattcaaatgacacctaaaattaaagatggccttgtgaattcttactctggaatactcggtgcagagactgagaattatttatatcaatatctttaacatcacttattaccaccgacaatatcccatatattgatgcttcctatgtctccttcctctcttccatttctgtgtttccagatagcctctgttttttttttttggtcaatacatggtctatctcgtctcttactgaatgtctatctgataaatgaaacagtacctactgcttaacaggagtacccttcatttgggaataggtggcatgaggaaataagcacattgcttttttgaggatatcatgttaggaagccaatgaaaaaggacagggacactgcctgcttttcctgggagccggccagggatattaatcgtcggagatatcaagaacacaaagttgaacacaaagttgaacaggcgtcgaatctcgcaagaggcaaagaagcaacgactagccaacctgggcacgaccacactgtaccatatctgtgactttggatcctttatatcagacaaatttgtaactaaagatgcatggcctgcatgcatgatccacatgtccaatttactaaaaactaagtagttaattttgaaaaatttcatatatgttttatcgaagttgcagaaaatttacaattggcacttttaccacagtgttggtaaatgcattttcccacgaaaacacaaccatgtgtgtgaaaacatatgtagacatcaaaataaaaatgatagatagtcaagcatctcaacaactccatcaccacagtctgcttaaccagagtgaatttttatggccccttagtgagcaatttcatgactttctgtgtgtaatcgaggacgattgagaagtaagtaaatttgaccttaagaaagatttcggacatgcgacaaacactaaaagctattaaggccattcccaacccaataactggatggtgtctatagcattaaataagctgccaccgagaataaaaaatgatgtggcaagtgaataaatgagtaaagagaagaaaccatgtcttgcatgaaacatggtttctacgtaacatccaagacatcatgtgagataaatagcattaaattgaagtatggaatagtggtgtttgcattggaaaagtagtgtctagtactagtttcttgatgatgtggagtttatcgaaactatgtatagtatcatgggtaagtaatggcctaagaagatcatacaaaaaggtgtgaaaaacaactgactactcctagttatgttttctccttgacctacgtgcatacctacgtgcatacttattatgtacatccttttcacctctccacttttttttctttcaaaaaaattaactgtatggccacctacgcaattttgacacttccaccatccattcctcctccagtttacattattcttcactagataagggttacttcccctatttgtctgcaaagtgtgcggcgacgcgggaggcgcggctagatcggcggcgcggtgtggtcgagggcgtggcacggtgcggccaaaaaatcgcgaaggcagcggaagacactactacagaagatgtaaagggtgccaggtgggaaagccccttcggtgccggtttttccaaccagcacccgtatggcagcactgattagctagggtgaaaggtgtcggttccaaaaacagcacctttgaggcgcccatgagccaaaaataaatcggctagatgcatcgagccgatgcattgagccgtcaagccaatcccatctaatacctaaatctcaaaatttcctcaaatcctcaaaaatcacattcatcaagaacactcgtcaacatcatcacattcattaaaaacactcatcaagaacacatcaacatcatattcaaacacattcatccagaacactcatcgagaatcaagaacactcatcatattgccttcaccaccaccgccactaccgccactaacgtctccaccgctgccaccgtcatcggatggagaggagggcgccgctgccgcagcaccgctgtcgctgtcgccgggccgccgctgccgtatccccttctgccgccgggccgccaccgccatctccctcccgctagatctggtggaggggagggacccgccgccgggccgtcggaccgccgtcgcctcccctcacgccgccgacctgtcgccgccgcacccccttttgccgtcgcgccgccgacgccacctcccctcccaccagatctggcggaggggagggcgccgccgctgggccacagtatcccctcccaccaccgaccggccgccgacccaccgccgccgcagcatcccctcccaccgtgcacgccgattcagctgagggagagagagagagagagccgattcgatcggtggagaaagagagagttgagagagagagagagagggagggaatgcataaggaaaggagaggagaggagatgaatggataagattgatgtgcaggccgggggtcgggtcggctcagctctgctcgatttatttggttgtcggttctttctttaaaaaaccggcacgtataatatattatatgtgtcggtttttaatcaaccgacacctataatatattaaaggtgctggtttttattaaaaaaactggcacctatagaatatatattctatataggtgtcggtttggttttatacgatttcaacccgcggaggtgggaaaaatcttataggtgccggttttagtactttcggcacctatagtggcgacacctaattaatgttttgtagtagtgagaggacgtgagatcacgacgcatgcgcggaagaagcggcgaatttgggtaggagaaggaaaccagtatttgataccatgtagagaattatgagacaccacataacccaacatgaggggattgtatttatatagccaatgcattagagattacaacaaactcttaaataagagatctatacagatagaatagatatctaggctatacaaatctaatataactctagtattgttcaagtcatttcggaatgtgtggcatccggaaagaagcatattggaccatccagttgtgatgtatgttagtgaagctaaggtctgaaccacggtccaaagactgggaagagtcccagagacacggcctcaccacctgttgatcatggaccagcgaagtatacgtggactacttgttcctaggtcgtagcatttgttgtaatatgaagtgaattactccgtattttcttattagttaagttgataggttgagctagtcgatgcatataactttgtatggaactagagttagacgcctcgagttcaaatccttgctagtgggcaattaaataaaaaaactacagagcacttctattctacgctagatacttgaggcgacctcgcatgcggaggactgtttgaggggggcttgcgtaaggagggatctcctaccaatatgtgaggattaatctgtagccagggatttttatataatttttgtaacaattaaattgcttcgtgtgaaattcatacaaaatttctacatttctgttttcaaaggagtactaaatctatgccctgttgcatgcatgacccacttgtcatttcaaccaagtccataaaaatgatttattcgccaatgcgcattggaaatgattcttatttacatcaagctatatttttatctagtcgtgatagttatgtaaaaggcctgtttgcggcacacaatctgaagtgtgttcaacaaattcttggatccattggaagtacgaaagtaaagtacacagatatatctttgtaccccacatctcccttcaattccaatctactaggatatgcctcttttttaatccacatgctcttctcgtccatggcttgaaaccaaccatcgtggtttccaatagggtttctgcctcctctttctgcttgcctaccagatgaacactatttcctccgtttcatattataagacttttagcattacccacattcatatatatgttaatgaatctagacatatatatgtacctagattcatgaacatctatatgaatgtgggtaatgatagaaagtcttataacctgaaacggaggtagtacatactttttctttgagagatatttatatttgtatgtcaaaatatgcacgaagtgcacaacacacataatagaatattttatttgagaatgagcgacatcagataaagaacatacatgatattcttgatatcaagtacactgttatcagggccggccctgggtctaggccggttgtgcgaccgcctagggcccaggccggtgaggggcccatcaccactcccccgggagcccagcccagccatcagcccacgcgcaagacaggagggagggatacagaaggccacaatgccggttcgttaatcgctactacctccgtcgtcccggaatataagcattttttagagttggacatggttattaagaacgttggtataagtaaatgatgaaggattgtgattggctgagtagtggaggtaggtgggaagagaatgttggtggagaagttgttttattttgagacaaatcttgagagctaagagttgttgtattttaggacagagggagtagttcgcttcgttttctccttttctcctcgcgaatcgcgattccgtttccgcgagtaactctccaactccgcgaccgcgacgcgtctcatctccggctctccgcgctgacggcgccagattgccgggcgcctggccgagtggccgactggccgccggcacgccgccatgccagggccgcttctatcctctaatcgccaacacctgagcgcccgagcctctgagcctcacgcctcttcccgactccccatctccagtctagtagtctcctgttgtggtgttgccggccataagccctcggcaaactgaggttagttaggtactccctccgtttcaactttctagcattacctacatatagatgttaatgtatctaaacacatacatatgtctagatttattaacatctaaatgaatgtgagcaatactaaaaagtcttacattatgaaacggaggaagtaattaggttaattagacaaacaataaaccgaggtttgttgcttgcatcattgtacgatatttccactcgaaaaattagattaattaggctataattttcatgattattgctgtataatttactttacaatatatttactatttcaggtgttacaatgttatccaaaaacatttgttgggtgcttagaaaagaaaaaaaaacatgaagatcaattaataggttcacaaaagaaatgatttcgcttcaagaaatgtgcgaagaagcccttttttataagggagataggatatttgtggtctcctattaagtattcatattactttgtttctatggtgtttttttcttgccaattatactatcaatattatttatcaataataaattacaatattgcaacttgtaaactattattatttaccatgttagaaatgtttatttgtgtcactatatagtgacgtatatgtgctttatatagtatatatattaaaaataaaaatatttagcctcaacttcttaaagacctattgtgtcaagttcatctaggacctctcaaatgtcaggaccgaccatgactataagtcatctgaacctagggccgatcctggggcagggcgagcagtgcaaccgccctttgttcccgttacctcaagcaaacaccagccttgcacaatatgtctgcctagcttgcacggccattacacgtaaagtagtaaatcactgattatgtgctagcacaagcacgttaacgttatcaaaaacccggaagctcatcggtacttgcgcccctactcaggaatcgcccgccgttgaaaccatctcgttcctctcgaaggcatctactctctcctctcgatacaaacatctatcagtactagttggcattcctaagcaattggtctctcttggcaaccatgaactaatcttatcatatctttagcctatggtctatgattaataacatcttgaacataaaaatcagatagaattttgctgatttcctattgttttatagctagagataggagcttgaatgaacaggtttgggcccgggtttattacttctctcgattggttgattcatttctcttgtagctctgcactaacagatagtatttttttatggagacataatataaacttgaataattttaatttgatgtctttttatagtatttaggtatgctattcaactatcacctaacaatagtttgtgcttaatgatgtctaaaagttaaacattactttctatttgaaatataaattatttgtcatacatacatatgtactaatgttacaaggctctttatttttgcctcgtcctgggctaccaaaatttcaggaccagctccgactgacactgtatctactctcgcgtccttctactcggacatgagacattaagggcccctttgacttggattcaatggggccctaataggttaattaggtcctgtttcgattttaacttttttcttcaaacttttaacttttttatcacatcgaactttcctacacataaacttctaattttttcgtcacatcgttctaatttctttaaacttttaatttttaattttgacgtgaaacaacatagcgttaattggaagatctagccggcaatctcgctcgtgtccttctctcttttgtttcggcttcactgcgcgatcacacgtctcctcttttctgttcggcttctgcgcgatcgttgcggctgcacccacctgtaggaatgttgggcgctgctgttagtagttctgggcgaggggtgccaccaagagccaacgccagctgagaattttgcatggacacttttttatttttgcaattagtcacttgacaacttcttgaatagtatgaatttgttaattactccctccttccctaaatgtttgacgccgttgacttttttaaacatgtttgaccattcgtcttattgaaaaacttttgtgaaatgtataaaactatatgtatacataaaagtatatttaacaataaatcaaatgatagaaaaagaattaataattacttaaattttttgaataaaacgaacagtcaaacattttttaaaaagtcaacggcgtcaaatattttgagatggagggagtatatgcgttgtttgagtaaatttcagttgtgtcagttttaggacgaagaataacactcatcttccctctatagcattcatatttcattatcactacttcttaatggtctttatttatgcccactattatgtaatagattttcctggacgacgccttattttatttctatgcggttcgtaaatgcaaccatatagaaaaatagagaaaccagtgttaggctgtcactcacacgagaaaatatattgtcccgtgtgggcggcttaactcactcgcacgaaaaaaaaacttcccctatccctttctctctctcctggcctctccctctcgaaatttcaaaaaaaatttcatcctctcaactctctctctcctccccttcgtccttatccttatcaccacctcatccttattcttctcaccacccacccctctctctctcctctcctgcaggatgtgcttgccgagcgaggggggcacggcggaggcgaggccgatcccggcggcggcggagaagggggcggcgagccctagctctggacgcggcagcgagccctagctccggacgcgccggcctccgcctggacgacgatgacgacgacatcgccgacgcggcggagacggaggcggcgagccctagcagcaccggcacgcgcggcggcaggcgcacgggcgcgctcctcagcatggctcgatggccggcgcgcacggagtcgcgggcggtgcggagcgaggcggccggcgcccggatccggcggcggcgcccctctcccgccctcccccgctcgacggtgacgacgacgacgttgccggctccgacgatgacgacgatacgttgccacagcagggcggcagcgagcgggttggcgcgcgagtagggcggcggcgcccggtcctgattttcgttttttttattttcgctttttttgggttccgtgcgggcggtataatttgaccgattattccgtgtggtccacttaatccgaccgcctgcccgcccggttgggtcgtccgcccgcgaaaatattaattttcccatacgattggctggagacgggccggacaatcgcacgaaaaaatcgaaatacctgtatggaaaaatgttgtccgtagtagtggctactgatttaactatgtggttatcgataattatatccagttgaaagtaatatgagttaatcgtataagtcgatatggattattaatcattccatcaggtaaaaaaatcaaataggtttgattttcgtttcataagcttccctggtaggcctgtcaactttttatccacgataacttatatatctacttcatgcagtccaagaaatagatagttatcgtggataaaaaaaagagtatgaataccctcttgaactatcacagtcgatcgaattacccccacccccaagctaaaaaagagatattttacaccctaaagtatataaacaggacaaataaccccctaacttaatctgaagtggtttcaatcctatatggtagtccaatcagcaattattttattaaaaaattggtgggccctgcatgtcatactctccctctctctacctctttcccctctcacctctctctctactcttatcatcctctctctctcaccgagcatagcaaggaggaggcgacatctgctgctctagcaattaatcccggtgtatgcattatattgaatgagaaaaggtcgctcgtgcaacaaatggacgtagtggtgtaagtgggctaacccacgaattcccttatagactaatggaataagttcatctgagatcccttaatttgtcaacgaatccgattttcgtccttcaaccggaaaatcagatacaacgggtccttgaactatcaaaaccagtgcagatgaagtccctcagcggtttagatggcggttttggctgatgtggcgcctatgtggctaatttgactcggtcttcaactgacgtggcattcacgtagcgcttacgtgacaattcgatctggaaaaataataaaacccgcgggacccacatgtcagtttcacacataaaataatttcaaaatggtggggcccacgtgggccccacatgttagcctcactccaccctttatccctctccctcggcttcctcgccatcgtcgacctcgacggtcgccgcgtcgtcttcctcggcacctccaacatctacggcttcctcgccaccgtcgacgtcgacggccaccgcgccgtctccctcagcacctccaacatcatgctccgcaactgcgagctcaagataacgacctgggccatcggcgtcgcggtctacaccgtgcgggacaccaaggtcaagtgcagccgcctggagacccacacgaaccgcgagaccatcgtgctcactctcctctgcaccctcgtctccctcctcgccggcatctggctgagcgaccacagcaacgagctaggcgtcatcccctacttccgcaagaaggacttctccaatcccaacgagatcgagaactacaaatggtacagcacaactcccaggtggtgggcaccgtggcaggggccggggtggtggggctggtcggaacgctcaaccgcgggctccgacgacgaggacgaccactccggtgccatcgccaccgcgtgcgccaagaaggcaccgccctccatcgccgtcaggctcgagaaggagatggcattctacggcgacggcggtggtactgagggcggggatgtggccagcgcaggaccccgcggcagcgctattgacagtcgttatcgatcagtttcgaccgtcaatattattaaaacaggcgagaactagtgatgcttgcgatgcatatatctgttagaataataatattccactagttttagatatactaaccttttgcagagaatgacaataaagtagaggagaatcgacatcaacacagacgataaatcaatcggacgatgtcgagaaccagacttgtgtatgatgggccaagaacgcagacttgacacgatgaatcaggccaaaattcacaagtctacgaagtgaagcaacagaggaggccgctagccgaaattgggctggattgggccagccccaggttcggccgaacctccctcgcctccgttggatccaggttttggatggacggtggagatgaagccgcaatgacggttggaggtattaccgactattccaaccgtcatagctgagctataaaaggacttcactctcttcacttcaacacacacctcaagcaagagctctctcattcctctcaagtttagtttagtagtatctagctggtagaatagaattagaataggaatcaggagtccggaagcgttcggaagagttcgggtatggctctagtagctttcctttcctcttttgtaagctttgtacttttattagaatactcttctatatacatttctggtattgaaatactttccgagtatatgagtacctactttacattatgttcatgttatgctgaatatactgctagcttatctgtgagatgctttggtgcgggtatagtctttgcctatgcaattactctatgtcatgacgatgatattagagtagtatctggcagtttagacgtggtgtctagattacgggataccattatttggggttatatattgcggatgataggtgggccgctgatggtgacagctcagtacgggtattcctccgtatttagccccggttggatggtcatgacgggctgtcgtaaggaactcgacagtcaggggtggcttctcgaagtatcaggagggcatcggatagagggtattagctagtataccagttaactagaatgtatgtatactatgtatattagaagtataggaatagattctctttctcttttctttctacctagcttagattatttattatgaggatgagtagtaatggttgtgtgtcactctacccttggattatcttaacccctacttagaatatgattatcacaagtgatatataaattattagttgagttctctctacatgatcttcccacaggataaaataaatacgatacccttggaatactctcgggtgatatgctacaatagtatatccgtgcgcttgcaaatgaactctgtaaccataatataccagaagtatttatgcgccattgttgggaattatatttctaggaatgtcgttaagaaataccaacaagcgccgaccaccacgccgccagtctcctccaacaagacgcctgcacccaccgctgcgccgaccacccccgccactcggccgtggggcccaacaccccgcgcccgccgttgcacttaccaccaccttacccgctgcagtgccgaccacccccgccacctcggcccccaccacggcgcccaccgcctcagctccggccactgcggcgcctcctctccgccggtcgaggctcctgtcgctggtgccattgtccaccatcttggggatccctgttgcggcgcacggcgagcagccgccgccactggagctcggacagccctcctcgctcgcctgctccgccgtccacccgcctgtccgctccggcgctcaacaggaagaagagagagagaggggagacggaagaagagaggagtgaggatgaggaagaaatgagtgatgaaagggagatggaagggagtgaggggagatggaatggagagggatgaaagggagaggaagaaataagtgatgaaagggagtgaggggagatggaaaggagagggatgaaatgagtgaggctgacatgtcgggccacgtgggccccaccattttaaataatttttttgtaactgacatgtgggcccatggtttttattatttttccgcgatagaattgccacataagcgccacgtcaatgccacatggaacgaagacctagtcaaacaagccacgtaggtgttgacggtcattatcgatcagtttcaaccgtcaatattaccaaaatagaggagaactagtgatgcttgcaatgcatatatatcttagaataataaaattccactagtattaggtatactaacctcttgcagggaatgacactaaagtggaggagaatcgacatcaactcagacgataaatcaatcggacgatgtcgagaaccagacttgtgtgtgaataggccaagaactcagaactaaaacgatgaattgggccaaaatttacaagtctgcagagtggagcaatagaggaggccaccagccaaaattgggctggattgggccagccccaggttcggtcgaacctggtggttcggccgaaccaatcctggcgtcgttggatccaggttttggcgtggacgtccaggattgcatcccaatgacggttggaggacacttcggacaattccccttccacaaccgtcataactacctctatataaggagctcactctcttcacttcaacacacacctcaagcaatagctctctcatttctctcaagtttagtttagtagtatctagctggtggaatagaaatagaataggagtccggaagtcttcggaagagttcagatatggctctagcaactttcctttcctcttttgtaagctttgtacttttattagaatactcttctatatatatttatggtattgaaatactttccgagtatatgagtacctactttacattatgttcatgttatactgaatatacggctagcttatctgggagatgctttggtgcgggtataatgtttgcttatgcaattactctatgtcatgacgatgatattagagtaatatctggtagtttaggcgtggtatctagattacgggatatcattatttggggttatatattgcggatgagtggtgggccgctgatggtgacagttcagtacgggtattcctccgcgcctatatataatcctaagttaatttcctggggagggtatttctccgtatttagccccggttgtatggtcatgacggactgtcgtaaggaacttggcagtcaggggtggcttctcgaagtaccaggagggcatcggatagagggtattagctagtatattaggtaactagaatatatgtatactatgtatattagaagtataggaatatattctttctcttttctttccatttagtttagataatttattatgagaatgagtagtaatgcttgtgtgtcactctacccttggattatcttaacccctacttacaatataattatcacaagtaatatataaattattagttgagttctccctacatgatcttcccacgggataaaataaatacgatacccttggaatactctcaggtgaaatgctacaatggtatatctgtgcgcttgcggatgaactctgtaaccataatataccagaagtatttctgcgccattgctgggaattatatttctagtaatgtcgttaagaaataccaataagcatttctggcgctgttgccagggattatatttctagtaatgtctttaagaaataccaacaagtatttctggcattgttgccggggaagattcataatagagattgcttgaactaatactttatatttacctctatgtaatcatttcctttgcaggctaaccttggttgttttcacttgttgttgtgaaaacagggtagtgcgtgactggtttcaacctaccagaaagcttcaaagaaaatccagaagctttcttccggaccgtcaggccgtgagtcgttgctctgcagaaaattctaccgacagagaaaccagtcgtaccagcgccaccgaccttcaagacaatggccagcaagactcttcgcgagttcgctgctccctctgctgacaatgtggccattgggccgcaggtcaacataggagacgtggatttcgacttgaaatccaacctcatcacgatggcgcaggctagcccgttctgtggcaagcctaatgaggatgccaacgctcatctgcaacaattcctagagatatgtagcacatacaccatcgagggagtcagacccgacaccgtcaggctgcgactgtttccgttctccctccttgggagagcgaagcagtggttttatgccaaccgtgctgttgtcaacacctaggataaatactctacagcattcctctcaaagttcttcccgatgggcaaaaccaatgccctccgtggaaggatttccagtttccagcagacaagggatgagtctattccggaagcatgggagcgtctgcaggagcatgtggccgcctgtcctcatcatgggatggtcgactggctgatcctgcagaacttctacaatggactcaccccaatgtcccgcgatcacctagacgcggcagctggaggtgctttcttctctaaaacggttcaaggagccgttgaattaatagagaagatggtctccaatatgggttggagcgaggaacgactccagacccgtcagcgaggcatgcttaccgtcacggagacggagttacttgctgccaagctggacctcgtcatgaaacgcttggacgaccacgagaaagggccacagggcaccgtcaaggccatggattcacacgtcacgtgtgaggtctgcggcggcacgggtcattctcggaatgactgcccggaaacccgtgaggagacgatgtatatgggcaacaacaacgggtaccgtccacaagaaggttaggggtggaacgaaccacgcccatattatcaagcaggtaacaataatgataacttgtctaaccagccctccttgaaggatctcatttttgcacaagctaaaaccactgatgcactaagcaaaaatcttgctgctaacgataagatcctagagaacattaatgtcaaactagatggctttgcttctgcttttcaaaatcagtcgagctttaataaaatgatagaaacccagttagctcagttagcatctttagtccctgcaaatgaaactgggaggattccggggcaacccgactcttctattgaaaatgtcaaagcgatcacaacgagaggaggtaagtccactcgtgatccgccatatcctaaccctgcaggaactaatgggatgtcaaaagaagcgccatctaatgactcggcttacaaggagattcagcccaacaagaccgtgccgctggaatactacaacacacggttgctgccattccctcaacggagtaggaaaccgtcagtggacgagcagttcgctcgttttgttgaagtaatccagaagattcacatcaacgtgccgttgttggacgctatgcaagtgccgacatatgcccgttatctcaaggacatactcaacaataagagaccgctcccaacaacggaggtggttaagctgacggaacaatgcagcaacgtcatactccacatgctcctggagaagaagaaagatccggggtgtgccacgatcacctgcttgatcggggcacaacaattcgaccaggccttgtgcgaccttggagctagcgtcagcgtcatgccaaaagacgtctttgacaagctcaacttcacgatgttggaaccgacgccgatgcgcctccaactagttgactcgtcagtccgttacccggcagggatagcggaggatgtgccagacaagatacgggattccttcatcccggttgattttgtggtgctagacatggacacggggaagaagacgccgctcatcctggggcgtccattccttagcaccgcaggagccaacattgacgtgggaatggggagtatctgtttccatatcaacgggaaggaggaaaagtttgagtttcaaccgaggacggaacaatgctccatggtcagaatcaaatacgggccaaacccgcagaatattcaagaggtcaaagtggagccgcccaagacggacagcctagtgaaattcatgcaaaacttcctggagaaggaaacaacaatacccaggaaccgttattggaggacgccggtaaaatcacctgtatcggccaagaagttagagcagccggctcagaagaagccgccctctgcaccaaaaccaaagaaggtgtggaaggaaaagccaaagatgcccgctccatcacctccggagacgggtagaaaatccgcgcactaaattggaaggaggtacggtcttgcacgtcggactttaaatgacgcgaccttcaccaacaggcaaattggtatgtatccacatatttgctttcaacaatttgaatttttgcatcatcacatgtttgaatttcaaaattgcatttagtatttttgaattttgagggaattcttcaaataaatttttcaaagcaaaccaaaataaattcattgtgcaccgaccacactgatcgttggaatcaaacggccgaaagtggggccggttgggcccaccaggggttcggccgaaccggccaggccaacggtcggctgcctcttcctttgaggcaatggctagtgggccacacaggtcggttttgaccgttgtgggtgcactacttaagccaaccaaccgggagagggaactccacctcatttcaacacattttcattccctctccaaagtttgctctcaagttcattcaagctttgatagtttccctcaaattcaaatctttagttgcatatatacaagttgctttggtgaaattaaccggcgggtgaaattcttgtcatttctaacccccgccgagttagtccgttcttgcttcattgtgcagaatgaggaggcgattgtctcgtccattcaaggggaccggctcttcatcaagtcgtcatgacgagtctagtacttgttcatcagccgatgtctcaatagaagatgccgaagctacgtgacaactcctgagcgacactgaccttgaccttgtcagtgatcgggagaggcaagcctactacatgctgaatgaccgggagtatgctcacacgcgagaatactcaccggatttgctgaaaaagataggtatggatgttgaatttcgctctatttggaaagctattggttggtagagatttgctgtggtagatgagcctggttctcgtttgcttactttgcaatttctgtgcactttgaaagaaatagaagatggtatttcttttcgctttttccatgaagagtttacatttacatggaaaggcttaagtacatttcttggttttcacgattcctgcaaaatcgatctccagaaaggaatttctgggttcgagaaaaataggttttgggaagacatttctggtgctccaatttgcaagaaaccaagaacgaatgatatccttaatcctacacttaggctcatgcacaaatggattgctatgactttgtttcctagaggtgatctgagacccattaagggagatgaattaattatcatgtttgccatggttagaaaaatcaaaattgctactgtgaaatgtatgataaggcaatggttagaaagtataaggttctctgctcctgttgagtgcacttctctgattacttgaatagcaaaagggctaggggtcgttagcgaccaaattgcttttatcttagccgctcgtccgcgtattgatgaggcttatctagtgctagcgcatattttgaaacatggagcagatggatctttgatatactttttccctggttgtacaaatgaaatcccgttgccaaatgcggggtatcatttgtacaactgccacgaactaaccattcccctacagaccatagaagaatctcgtgcaggtggaacattcagggagatgcacaacatgacaaggaacgaacgagaaatttcattatcctcgacacccgtgcagatgtatgaggcaggttggacaccaactggggatgcacccggatggacccaagctccacgccgcagcatcggagtctcaacctgggcaagcgccagtgaggaccggtggcatgcgcctcatgacatccaaaggggggacaatcaacctcccagatcaagtgatgtgtcttcatctccaagtgaatggcgctcaagttcctctcgttgggacttgggtgaaatcactaggagaatggacacccttgatgtgcagacgggggagatccagtacaacctcacggaacacatggctcaaacgcaagaatggcaacaatctgctgatgctcagttcgccaacatcaacaacatgatgcagcaacagcatgataacctttaggcgtactttcgatttcagggcttcaatccttatcaaggaccctgagcgaaagccaagcttggggggagacatcgctccccccactgaggtaacttgtatcacattgcatatttccctttctaattgcatatttgctttcaaattgcaccctataaaaaatgaaaacaacataaaaatttgcaaaatagaaaatacccaaaaaaaagataggataggtgtgagtcatgctaggtaagacaagctagttctctttgttgaaatgatgaatagttgatttgttttatatcttcgatatatgggttcttggtaagtgctctcacgaagattaaatataagtagccaacaattatccgggaacttgaggtaaatgggctgcacttgctgatctaagtctaagttgttgcgagatatgagatagtaaatatgagttgctacgatcctgatactagtttgacttgaattccggatgatttgtttttcaaaatgataaattgaaagttcctcatttgatataaattcctaccagagccaaaaatatgctatcatgatttaaccatttacatttttgttgcttttcattccattgaactttgtcaaactcttgtgacttgtgtagatatttgtcatgctctatgatcaagatcatacacccacatatatgcacatgctaaactcctacactgggagctaagcaatattctattccatttccatattaccaccaaaataaattctccatgctttcatgtgctttcttctcctaaaaaggaaaagtccttttgaaaaaaaaagagaaaagaaggagggaaaggcatggttatggaaaaaataaaaaaaaataaagttatgctccatcaagcatgagcatgatgttaaaaaaaatgtagccatgccctctcctaatcaataaaagaaggattttgggagaagaaagtacacacaaaggagaagcatttttcttttatttttcctcatataccgtttccactatataccacacacacattatacacgaccttgatcttgagtatgtttagttatctgctttagtctaagattttgacttagtaataaatgtgaatgcaattatgtatgtttgatccctatcgagctccacatatcaaaaccttagagtaggaattaaaaaggcatcatttggtgaggaattcaaattgatacacttagagagacagagtgaattatttgaggaacttggctttatttttcaaaatcatttgaaaactttcggaataagagttgaataaagatcaggtgattggtgctctaattgctgttctgtctttcaaccgcccgaggcaaggagaagcagtgtctcgtggaatcaggggtaagagcaagccaccgtgccaaagattatttaatctgagagagagtacatataccttgcacctgtatctttgagatatgcagcatagtagcaacttctgatcattgtttcctttcgtccttcactcgggacaagcaaaggttcaagcttggggggttttgctgacggtcgttatcgatcagtttcgaccatcaatattaccaaaatagaggagaactagtgatgcttgcaatgcatatatctgttagaataataaaactccactagtattaggtatactaacctcttgcggggaatgacactaaagtggaggagaatcgacatcaactcagacgatacatcaatcgaacgatgtcaagaaccagacttgtgtgtgaataggccaagaactcagaactaacatgatgaattaggccaaaattctcaagtctgcggagtggagcaatagaggaggccaccaggttttggcgtggacgtccaggattgcatcccaatgacggttggagggcacttcggacaattccccttccacaaccgtcataactacctctatataaggagctcactctcttcacttcaacacacacctcaagcaatagctctctcatttctctcaagtttagtttagtagtatctagctggtggaatagaaatagaataggagtccggaagtcttcggaagagttcaggtatggctctagcaactttcctttcctcttttgtaagctttgtacttttattagaatactcttctatatatatttatggtattgaaatactttccgagtatatgagtacctactttacattatgttcatgttatactgaatatacagctagcttatctgggagatactttggtgcgggtataatgtttgcttatgcaattactctatgtcatgacgatgatattacagtagtatctgatagtttaggcgtgatgtctagattacgggatatcattatttggggttatatattgcggatgagaggtgggccgctgatggtaacagctcagtacgggtattccttcgcgcctatatataatcctaagttaatttcctggggagggtattcctccgtatttagccccggttgtatggtcatgacggactgtcataaggaactcggcattcaggggtggcttctcgaagtaccaggagggcgttggatagagagtattagctagtctatcagttaactagaatatatgtatactatgtatattagaagtataggaatatattctttctcttttctttccatttagtttagataatttattatgagaatgagtagtaatgcttgtgtgtcactctaccctgggattatcttaacccctgcttacaatataattatcacaagtaatatataaattattagttgagttctctctacatgatcttcccacgggataaaataaatacgatacccttggaatactctcgggtgacatgctacgatagtatatccgtgcgcttgcggatgaactctataaccataatataccagaagtatttctgcgctattactgggaattatatttctagtaatgtcgttaagaaataccaacagtaggcgccacgtcagccaaaaccgccttctaaaccgtagagggaccttgtttgcaccggttttgatagttcagggaccggttatatctggttttggtgttgaaggatgaaaatcggattcggtgtaaagttaaggggactcagatgtacttattcctatactaatttataggctgaccaacgaattacctgcttatttagcccataattggctttgtgagacagcccacttacacccctaagttacgaattgctttgaatctttgcttgcaccggcacgcgttcaattatttttaaagaaatacaaaatatagcaccgctcaacgtgtggttcatgggcacagcataagttggttcaacatgagctctcctagctagtaacgtccaacacacaccaacactgaatggacgaacacctataggcgagaaaacagtgcaagaaacagaaaccgatcgagttggtgctgccaaaacttggtagcttttgtgtggttctttcattgcttaaaaaaaataaactgaaacacaatatcgtggtggttataagccgccctaaacgcacgccatgacgaccattagtccattaacatcgaccatatatcctatggaccaggttacaacgcatgtaacaacgcgccagaagcagaaaaacacagaaccccgcatcaacagagcatatgtgtcgagcacaaacagatgagcccgcacgacgctcacgcgaattcaaggggcaaggccgcaagcatccttcaggaaaacaacattgcatgctttcagttcaggctggacagacaaacataaccgaacacgcccgatcgattattgacttccatcgtccacccgagcacaaaacaaataatagcccataaattctacccctacatttctacaacagagtaaagtgaaatgttactacttccgtccctattgcctttttccgttatgaacctagagagtgatgcagggatggagctaatttggtgagctaatttggagagtgatgtaggggaggggtcggagacgagtggttttttttctctctttagcctggtcacatacacaattttcacatagaggccgtttggtttatgaaagatattttttagtgggatgacttttatgtggatggattaatatgctaccggcaaaagtgtggatggtgtggagattatgggtaccccatacccacacggcatggttatccgactgttataagggatagcttatatctatggaatttgtaacagatcataacttgggtattacgtttccatgtatattatggaacggcctaaagtcctggtttgataaaattgtaaagtagatttaggaaaccgataccgtattgattaagatttctatcttgtaatcctggcccccatcctatataaggtgggcaggaggccctctagggggcatgagatacaatcagatcataatatctataatacacccggcggattcaaatccccaaacaggagtagggtattacctctcattgagagggcctgaacctgtctaaatcctttgtctccgtatccatccacttttagatcttgtgcgctatccccttttattattgccgaattcatgtttcgacagttggcgcgccaggtaggggctgcgtcgagctttccatcgagaagtgcgatggaatcaatttctggagatgtgctgagatcgatctcaaagagtcgtcggcttcgtcttcacttcgcttcgggatttttgctttgtcatcgccgctgacaactttaacaagttttcactctctgacttggatccaaaccagtcaggagagattcaatctaagtaagaaggagatggctaaaccctgagaccaatcgccgttgcagtcctccgcctgatcctgttcgtatcggcacgagggcagcgacgatccgatggatcagatggtcatccactaccaagcctactgaaccaatcaatctaccccaacgaagatgctatgatgctgcaagatggatctacagacacgaggcatgacgaaaccgatctaatcggcatgcataggagacggttgcagctgatggacaccgacgacgccggggccgcgcacgcagctacgccgcctgcgcgcggctgcgacctccgcctcctccgctccgacgactacgtcgcctccctccccgccgtcctcctggagtcgcggatctgttcctccgccgcttcaaagtcggcgaggactgcccggctgctgccgcgccgtcatcgtcaactagtcgggcaggttgcatcacgcgaaggagtccgagacgtcgacagatccctgctacgaccgcgacatcgctctcgccatcctcaagctcctcgtcttcgccaccggcgacatcatcaacaaccaaattcaacaaggctgtgaatggcaacatggccaacaaatgatatgatgacacgtcaccagcatgcacaggaccatgcatcggcaacatgcatgcccatcaagccagcaaccaatcacacctcacgtgatatttgtgcatttatctttaattaattccttgctgctgctgatcaatttaattatttgtttgattgcatgtgctactgagacgccgtggtggtcaggccgtcgccgtgccgcggagtatcgacttgatttgtcggcgtgttagcccgcactcactattgccgggcatcttcgcctacatggttggctacatccgctgacactgtcgaccgtctcaacaagttcgcgattggctgcttccacgctgccgagcccgactatcgcccctgcatggctcacgctgacccggctgcgcctctcatagctcacgctgacccggctgcgcctctccattggccgttgctgatgggaatcgtcatcttcaccgccggcctgcctctgtcgccgccgactagtgtcctcgtctatacagttggttggtcacactaccgttcatgggcgtccacgtcttcaccgaccggtctgcctttgccgccgcctactggtgtctctgcctacacggctggcctattatgccgctgttggtgggcatcttcgctttcaccgtcgaccgccttcgtcgccgccgactggtgtcttcattgttattgatggacgactttattcccacattggccacctctgctatcaccaaggggaatattacaaagctaagtcatcatttattccttatatgatattttccttttcctctgcctcactacatcaattggttctccattgagtagtgagtcgggggctacagatgttataacatatttttcaataattttcataatatttatcttgattgcttgtgacataatctgagtacaaaagtgtctatcgagttatggagttctatcttcctatgctttccgtttggtttgtcatggatagttgcctttgggccgattcctagcacccgggggctcgttggatagaccgagtaacgcaaggtgctaagtattattcggaataaatcaaaagcatagagataagataatttatttttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcgtggaaatcaaaattaacaagagaagaaatacatatttataaacattttaaaatgcttgaatttttctcgagtattatatttacatcagatactactcatcctatatgtttgttctgcaggatccaaatccagatatgcataaaagggattcatggctttaagcttatctcttacgctccacgaatggatcagtcagaacatcaccactggctcgccgtcgtcgccgccgactggtgtcttcgcctatacagttggttggtcacaacaccgttgttaggcgtctacatcttcaccgccggtttgctttcgccgccgccgactggtgtcaccgcctgcacagctggcctattatgccgctgttgttgggcgtctacatcttcacttactggccgcctcgtccgccgccgactggtgtttccgcctgcacggctggcctattatgccgctgttgttgggcgtctacctcttcaccgactggctgcctcgtccgccgccgactggtgtttccgcctgcacggctggcctattatgcagctattgttgggcgtctacctcttcaccgactggccgcctcgtccgccgccgactggtgtttccgcctatacggttggcctattatgaagccgttgttgggcgtctacctcttcactgactgaccgcctcgtccgctgccggctggtatttccgcctgcactgttggcctattatgccgccgttgttgggcgtctacgtcttcactgaccgaccgcctcgtccgctgccgcctggtgtttccgcctgcacgattggcctattatgccgttgttgttgggcgtctatgtcttcaccgaccggccgcctcgtccgccgccgactggtgtttccgcctgcacggctggcctattatgccgccgttgttgggcgtctacctcttcaccggccgtctcgtccgccgccaactggtgtttccgcctgtatggttggcctattatgccgccgttgttgggcgtctacatcttcatcgaccggccgtctcgtccgccaccgactggtatttccgcctgcacagttggcctattatgccgccgttgttgggcgtctacgtcttcaccgaccggccgcctcgtccgccgccgacaggtgtttccgcctgcacggttggcctattatgccgccgttgttgggcgtctacgtgttcaccgactggccgcctcgtccgccgccgactggtgtttccgcctacacggttggcctattatgctgctattgttgggagtctacgtcttctccgaccggccgcctcatccgccgccgactggtgtttccgcctgcacggttggcctattatgccgccgttgttgagcgtctacatcttcaccgaccggctgcctcgtccgccaccgactggtgtttccgcctgcacgggtggcctattatgccgcagttgttgggcgtctacgtcttctccgaccggccgcctcgtccgccgccgactggtgtttccgcctgcacggctggcctttatgccgccgttgttgggcgtctacgtcttcaccgactggccgcctcgaccgccgccgactggtgtttccgcctgcacggctggcctattatgccgccgttgttgggcgtctacctcttcaccggccgtctcgtccgccgccgactggtgtttccgcctgcacggttggcgtattatgccgccgttgttgggcgtctacatcttcaccgaccggccgtctcgtccgccgccgactggtgtttccacctgcacggttggcctattatgccgccgttgttgggcgtctacatcttcaccgaccggccgccacgtccgccgccgactggtgtttcctcctgcacgggtcgcctattatgccgttgttgttgggcgtctacgtcttctccgaccggccgcctcgtccgccgcagactggtgtttccgcctgcacggctggcctttatgccgacgttgttgggcgtctacgtcttcaccgactggccgccttgaccgccgccgactagtgtttccgcctgcacggctggcctattatgccgctgttgttgggcatctatgtgttcaccgaccggccgcctcgtccgccgtcgactggtgtttccgcctgcacggctggcttattatgccgccattgtaggacgtctgcatcttctccgaccggccacctcgtatgacgccaactggtgctatcgtcttcacggctggctatgtcgccgccaccgcaaataggcatcatcaccttcaatgcaagctgtctacgtgttctaccgactggtttcttcactaccatggctgcatgattttgccagtgttgattggccttatcgtcttcatcgctagtcgtctcttctgctgctgactagtgccctcgcctctacggctaatttataccgctaccactactgatggacgtcatctccttcattgctggtcaccttatctgacgctgactggcttgttcgcctccacggctgcgcgtcttcggtaccggtttgtttctgttgccgccgacttgtgttcgcttcatcacggctatgcaactttgtcgccatggtggagcggcttcatcttcattgtcttcagcaccagcaaactctattgcctttactttgcaagctttcctacttcaccaaccacgacgtctacaggagcttcgacatctcggcatgcgtcaccaaatatgatgccgtgttatattattacagcaagtggtgttccaatcttcaatatttctactcggacatcttcaacatatatcttcactgaagcaatgactactcgacgacaagaagctacagttcttgactctatgttcagttgtttctcaactaaccaaagagtcgggggctacacaaatacaagactctcaaaattcgacaagctttatgtcaagatgaagcaatcaatcaatcaacgagtcaactcggggagttattatcttcgtcttcgcttcagagccgacatctaatttcagcgactccgattattacaccagcaattttggcttcttcacgccgccacaatctattccaaatttctcaagtttgagatttaatttacatgtctgggagtttggagtcatcaaccaatcaactcagatcagattcaatgagttgaacaatagcatatactttcctctaagtggagcatctgcaacaactataacaccaagttctactgacgtctttataaatcaaggggcattgcatcagtcttcgttatgcacacgctcgcatcaaggaaactactcgagcttcaatatcttctcaacagtttgatggattattgtcactgacatcatcaccagcacctatatttcatcagccttgatgtctccgttgttgctaatgggtgactacgtcttcgcctctggttgctttcgtcattgccgacttgttatttcgccttcatggttggcctactacgcaactaccgatagaggatctcatcattatcgtcggctgctacaacgctattgactggatcaccgacatcgtcatcttcatcaacatcctgtcaaacctcttcaacatagcctattctactgttgtttgatgcgcaacttcgttatcatatttgatcatctctattgctgccaatcgtcattaccatcggttgcatttgtcgtcgccgactattttcttcatcttcatgattggtggacttcgtcatcgtctttgatgcgtgtctatatcttcaccgtcggcttgctttcgtcaccaccgactggtatcgtcgccttcacggatggcttattatgtcgccactagtaggcatcttcatcttcttcaccagctgccttgtctgtcaccgactaattatttcgctgccatggctacacaactttattgctgggcgccttcatcttcattgctggctgacctgactgctgccgactggtttctttgccttcacggttgtgcaacttcatcacttttgattggtatcactattttcactaccaccaatatttttgccacctctagtgggcaatattctctctatattggttgtcttgtctctatgccaactgcgtcagctaccatcaatggacaattgtgactacgacaaaaggacacgctatatgctcaggggcctactagctcaaacacaagtatcataccttcaatttggacttgttccggatacattcaacatggattcatggtcatgagttgatttatcctgctcaactactggaccactcattattccccgtaagggctatcaactgaatacttgcaccaatcaggatttaattgttatatctattttggagtatcccataaaggataatcactcagatcagaagctattcatatgagctacacttggtctatatcacccggaagatttattactcgggagcatgttacatgcgtcaccctttaaagggtgtcgaaggcatattttttgccctaggcctaatatgtctgcagcccatattatcaggtgtggcctgtcacgttcttttagggacttaggcactttttgcttaggccaaagtgcgcgtgatcaagtgcccaatacctcaaaatccttttataccgcagttactcaactttttaggagttggtacaatgcatcttaaaaggtgtcaaacagtaaagctttatatagctgctccgctgacttttttatatatagtcaaggcactgtttgggtttatcaagcaatttattggatacaatatcattgctttttgccacgtaactgtgcatttttattgaccaatattatggcttaggctgattatatatcttggtcatttttcaggcggttggtaaattctttatgagtttatttactcggattttacaccacgtatgccgtatatttctgggtgtggtgaaaccatgtgtcttttagggacttaagcacatctgttaaagcagtgtgcacatggcgtatgtccaatactttggaaatttctttattcacagcattcaagcttttttatagctgttttgctatatgacttttcaatgatgttgtcagctttaggttgcacgcattatattttacaaagctgtcggtatatcactcggatcatgttatttggagattcacaccgcatatgctgtatattgatatcaagtcacttggttgactataattatcgaaaaccactctgttggttggattatttattccttgactatatgcttggtttgttcaactaaccacatagtcgggagctacacctattaggtgcatctagtcgatgcacctaagtctacattcaatttttgttcagccctccgtagtcttcagatttggtaaaagtactcgggggaccatgaagaagatgattgaagcactcggctttggagtaatctagttcgagagaagattatcttttcaactgcgaaggtctcaggggctactgtggagattatgggtaccccatacccacacggcatggttatccgactgttataagggatagcttatatctatagaatttgtaacagatcatgacttggttattacgtttccatgtatattatggaacggcctaaagtcctgggttgataaaattataaagtagatttaggaaaccgatatcgtattggttaaggtttctatcttgtaatcctggcccccatcctatataaggtgggcaggaggccctctagggggcatgagacacaatcagatcgtcagatctataatacacccggcggattcaaatccccaaacaggagtagggtattacctctcattgagagggcctaaacctgtcgaaatcttttgtctccgtatccatccacttttaggtctcgtgcgctacccccttttattattgccgaattcatgtttcgacagatggcttttatatttttagtattagttttgaaccgctgagaacagacatatagtaatcgtagcttttttttttatttatgttgcatgcctttaacttataagtataagttagaaaatgaaaaaacttacaaggattcttcgtacccttttcctccagcctcccttatttatatgctgtgttctttcatttttgtctaccaaggccatgatcagtcattcgtcaattgcatgaaaccatgtaactgtcctccctatccaagcaatctgtcagcgtccatctgcttgccaaataaaatataaaacaatatcttctttctatctcttcccctcttgcattttcatgtttattaacttctacaggtactctctccgttcttaaaaaaaaaaaagctaatctaggattggatgacacaagattcgtcgttttttttataaagggaggatgtagcatcacatgttactagagttcattcatttgagaaatgagaataggcaataccggaaaagaaacgtggttcacctccatgctatccagcggattacgcgagaattccaggcaacccaaaggtagaggcatggaccgacgaccctggggtgccgccaagcagcgcgtactcactacatcactgcagatcg

SEQ ID NO: 60509 - DNA, 6961 bp, Oryza sativa
caaatagatataatacaattgagctgaaaatcatgagtaaagtgctactccttaaatgagccaggcctgcatataattgggcttagcccataaacaagttgctcactatagggaccttgataggccataagccattttgggatattctttgtcttagataatgatgaaactagatgacaccccgcgcgttgctgcgggatattcatgtacatattactatatattttaatatatagcagttgtaagtcttagtaaaaaaataactaagtaaatagaaaggaaaaaaaagactcaagtagggttggtcagatgtccagtgcactgccactcaggtagcaagacccacagcgctgaaccttaggcacaatatcttgtaatgtaatggaaaatgatgctagtgatcattgttcttttaccgaatacacgcatatttccatgcctggtcttacattctttaataataaaattcctctgacattgtaaaagataaactaaacagcaaaaaaaaaaagagagcggaggaacttaatttttgcagtccattcgatttctatagacatgtttcgtagacagttatttggaagcacgaatatcaaatcaaacaattaaagcaataagatttttctaaaaagaagtaaggatagactaactgtgctgatatatcgagaacacactccgctagagacttgtatatgtcaagaagccagagttatgtgataccctgaatatgaattgaaaaaacaaaatcatttctaccaataatattttcctgcgtgctgtaaggttaaatcaaccatatatttcgccatcaaaaacaaaaataagccaaacattaattccaagacagaaattcatatttcagcgatgtaccgtggattgaatagaatgagtctacaatctataaagcttgcattcagtccctagaaccgccacagctgcgaccaattaggcaaaagtcataaagaaaaaagattgatcaatctctctattacttactgtgttgctgcaacagcagctccgtcagttcctgaagccaagacatgttcgctgaggtttcgccatagccagcggtgtgtatgcatccgccgcgggctgcttcagctcccatcgtggtgtttagcaaaaggtgatgtaacagatggaaagttaattagcgtgaaaaagaatgagcgatttactcagcatacaaatagctattgccgtcgattcgtatgccgtgttagatggcagccgttcctctaatacggagatgacgcagcagacgattggaagggttccgcatgacttggtgacgtctgcaggggaaggttgaaggtctccatgcctcattgcctggtgggctgagaagaatttccaatgctcctaatcaagtgaatgggccacggaaaggagcatattggagatgatcagatggttgagaataactccctcgaatgatctaacggttgatttttagtggatgacgtagcttcacagaatttgagctttatagcactaaatgatctttaatggataccaattatattggaagaaaagatgagcatcataaagttaataacgaaagaaggatcatcactaaattaatgatgagaaaaatacattttcggtacaaaacatgattagggacgcattttaggtgataaacgaatttccgttacatgaacttcatagattttgaaatgtgacataattctcagtttattgaagtaatgaaccatttcttatcataagaataacgctgatcctcattatatgacatacatattttattatcactactttataatatggtcttatatacactaccggtaagaatgattttgtaacaactttttgtaggaccgaatcacaagaactaagctaaccagagggggggtgaatggttggtatacccaaagacccaaaaacttttagcggaaaataaaagttaccctcgaatcgatggatcgcggtttgaccgaagatgttgtaccggtctgaccgtcgagatgcctccggtctgaccgaggtagaagctccagtcgaaccgccgagattgcctgccgcgcctgcctgacgccgccagtctgaccgttgtcgctccgccggtctgaccgccgccttgccgatgaaacacaaatcgaagaactctcgaagtagatgacaactttattacttctctctttgtttacaaagtgcaacaacagcactccttacaaaatctcgactaaactcgaaaccctaaaacacagcgctatgaaaagcaacacaaaagagataccaggaagcctcacgctccccctctatttatacatgaggtaagcagcccaaagccacgaaccaaactcatactagatgtcctaatccacctaggaaaccttctagtacaaaaaacaaacttaacataaccaatcataccaaatttggactccatccaaattcgactccgcatcccatacgcacacaatacctccatcgtatgccatatggaatcttcaccaaccacatgcatcaactctagcctgagtatcccgcatgatctctaaccaccacggacatcgtcttaccaccaagccgactcccggtccatcaccgcaaaatactatcccgaggcgtcgagtcacctacacatgaaccaaaaaagaaatcatattccgagaccaagctatcaccaacttgactcattgttagcaaacaacagtatcacatacgtatagtatccatctagaagtcataaatatgaaacaaactcggatatccaaagaaacaacccgaaaccgaaaccgaaaccgacacagcgtcggccggtctgactgcacggataccgccggtctgaccggaccacatatccagcaacacttgtaaatccaaacatctccaaaaccacttcgaagattaattccaaatatcaaaactaataatcaccgatgctaattgttcatcacagaataagaatcaaaacaccttgatctaacactttctaccttattagacaactgtactcccttcgttctattataagtaattgatttggtagtgtaaatagatatggttaattaaaaaataggaactctacatttactattactaaataccaccataaaagctattattccatatcggtgttagtacgcaagacgtaggagcggttgcattttacttgacaaatttcatcttctagttaattttgttttctttctaggatctactttgtctggtctagttatctgtgtccattttatacctctgtatatactttactacaaccaccaaaccttgttttcatatacttcacctctcttctcatcttatatatatttatgttgatcaataagcaggggttgattcctatatctctctaccatataaaacaatacaactatctctacgattcttacagttatgtagcatgtctgcatgtacgctacacagagcatgttagaagatttttattttaagaatgggtggcgtcggaaaagtagcacagcagatatacacactatcatgcacatcaattcaccaatccacggaacaactgacccactatctgtgaacccgatcagtggctcgagacaatgagctcatcagaatgcagccatggaatgattgagttgcaattgaggtcaagggatggaaaggggctagggcatgtctttgacactgacatttcgcatggtctagcaccaaatttggcccagtgtgcagccactagcattttgtgcctgaagctggtgtgtggagaaagcgatctacggaatgatccttgaccatgatcagtcgaaagcataatcccaaacttgggcatgtgcggatgacacgaatgcccgcagaatttcgctagcttgcctgagtgcaagggcaattgtgcggacaatgatgccgttgcatgccttggaacaaatctggctattcgtacgtgaaggaacatactgcttcgattcgacaatccttcctctcttttttttgtttgctccatgggtcatagttagctaaatatacatcggtcacgcccagatgcactgctagaacttagattattcacgaccaaccttaacaaacatctgatcgttgatagtcaaagaagccgcggtaggccctccgacggccatgtaatcgctggtcgttactacgtgcgtgtatgtggtcgctaataaggcgtcagttcagaattttctatagataacgaaattggtggaccgatccccttccccgccggcttagatccgctgcactggtgcaccagcaccgacgccccctacatggtcaccactgccgctgcacccagcggtcgccggccatccctgcgcgcctgctcccgctccaggcttttcccgaggacaagatttggccgccaataagccccaagccctagcgcctgcccagttggggcagctctgactcgccgaaaacggcggcttagcagttgggcatggaacagcggcgaggcgtgaacggcagaactaggtcagatgatatcccttgtaactttttctctgccttgttttagcgttgtggcttgaggattatgatatgttcgttccatgatatcccttgtcgtcctgtaattctattttccaaattacggctgggtttaattgtttaacttgaggattatgatatgttccttccatgagatgaaggaatatataagacctgtagtacatagccattttttcttgctgatctgtcaggctagtttttcaaaggaacaatttgtaactatgcccaattgcccattgcagtttaatttaccagttatactgagtgagcttgtgatttgtactactcttgtagatttgaacttagaatttgttatagatggcagtgtgacctccattcatgctctcatgtccattcatccatgaagtctcaacaaggtatattttttttcaacatggcgcataacttcttttttctttctgaatgattttgagtttgatcataatacttgagaggaaagtcaatttttcttgcaggataatctagtcaatatacaatgattggtttatttatctaaaattacgggattcttcttctgtgaacacgcaaatttgtggaggcatcttggcatattgtttaatgtttacagttcagtaacaagatatagcatggccctgataccgctgacaaaacgataatttcattttcaatcaatcatttatcttcccgtactgcaattcatggcttcttgcaggcagttgatagtttatttaacatattctacttattggtatgaatttgccctgctctatgttatcagtagcagagcacacttgcttccatttggatttattaaaatgtgtttagtttctcatattacagctcccttctcttcatggacagattccagtgtgacatagctaaagtgcaaagaaacttattttgtgtgcccagatgttattatttccaatggttcctgcaggatgatttatatatgttgatcaacattcttggatttgatcaacatcaatatgatatgcactgatagtctggtatatggcttgccacttcctttttttttccaagttcaataagatagcatacatccccaacttgtaatgctttggagaaatcaataagaataatcaacagactaatggactattaatgttgaccctaacttagatattgttaggtttacacttaccatagcttggtgtaaaagtagtatctagttcataacataagcattcagactgctctattatacaggctgaattatatgttctcctataactccacatatcgctattacaattcatttgtgtattgattggtttaaaccttggattttgcagtgttcacaacatggatgaaacaagccaagagttctacgactgggttgaagacctttcatgtagttgtagatgtatagtacattatggacgtacatttccaaattatatgtaatgaacgaattaaattatttgcatttgattaataaagagtggtcaataatttcgtttattggtctattaacatctcgttaatctaaatacattaccattactagtaaaaaatgtgatatcgtcattaataaaataaagaccacacagtgttgtcatcgttaaaaaaaaataacgacacaaatcatggtcgttaatgaatataacgatgtcacaatgtcacagtcgttaaagaaatgacgatggcagagaaactccgtcgttagtacaataacgacagaaaaaaagttagcgtgctcgttaatattattaacgacggagcctttaacgaccactgacgatcacaaaaaatatggtcgttaatgacctttaacgaccacatttggactttcaacgaccatattttctgtcgttaataatgatttctctagtagtgatgtcacacaagctagattatgtgaggcggagaacagggggggatccaggatttttgatcgatggtgtgtcatcatcaactctactaagaagcttggtttctaagtacagtcaataatacatatgaaaagtttaaaattaatggtaaacaatagagaaatgagatgaacccacctattaatctagaaatcaagcaatagagagataatttagcaatcatatgtctacatgcaattcaaagttgacgtcaaacatgagaagtagtagcctaaaaatagataaatgaatattttatatcaatttatatctaaataccatgtttaaaaaaatattttcaacaacagtttctatatataccgcatgtccaattggtgaaattaaattatactactatgaactaaatttattagatacacatgtaaataatagcaccgccactaatttgttttactgaacctgatgcatggaagaaaattagaagctcagggccttggctggcagttgcaaacagtagaactgctagctgcggccgcctccgatgtgggcatgtggccaactaaattagtaagggtaatttatgggcagaacaaatggtgctcaattagtggttactgctgttttcgtgtgagtatggcgttaat

SEQ ID NO: 60510 - DNA, 2768 bp, Oryza sativa
cgataatttttttattgcaacgaatttgttgatcgtggcaacaaaaaatagtgaaaagtaccatgtactatgtaaattgccacaaaaattaaaattgtggcgatagaacatgtttttttttgcaacagtaagactttttgtggcgatatctcattttttattgcaacaaaaatactaaataaaacaacgattgtagattgttgcaaaaaaatataattatttgccacagaaaaattatcattgcaatagtataatatattgctacgaattattttttgttgtaataatttggggggaatagctcaattatcttgtagtgatgggatggaccaaaaggtattggtgtcagctgacaccatagctaacatgatggatccgcccctggtggagaagagaagggaggagaggaaaaaggagcgccaacctgtatataactccaaaagagttaaaatcaacatagtagtggattagatggaaatgaataaatgaagatttattatattttggagcttgtgtattagaggtagtctattgtatatgttaccttttattggataagtagatgatgtacactaaattagagatagcaatcatctttacttttaaacatgcacttaatttcctttcatttgtgaatgatgggagtgtcaacctctgttttagctttcatagttggttaagagagtactagataataatactagtgcacctactatgtccgctccccgccccgcgtcttccctttgtttaagaagatccctttacctctcctaaatgtaagattctcatccataaatattgatccacgatctatttacttatttcatacattgcaacacagtttttagaggcaaggtattaaaaaaacattcattgtatcttaggacacaaatgccatctcttccttttagctttaattctccgaagacctagattgccataatatttttcaatctcgcataacctcaccctatttatatacttcgtagataggtcttctatgataggtcatctagttcatccatcacatgaaaccagagacagatgacgaaaagataatgaggtgtggccaaatggcccatggccatgcttgcaaatttaaaatgagttatctttaatggcattgatattgatattatagtttagtaattagactcaacaagtcaatatttaacaacccatttgtaaacatgcataagaagaagcaagcattcaaaaaatatcactatctaccactggaccatggctaaatttggtcttcaaatactatgcagttctgcacccacaaaacaagagcaaaaggtacaatattttcttagtaaatgcttgtctaaattgattaatgaggatggtgtttggcagtaaatgctctgaaggaaataactacataattagacaattactcaagtggttaaaaaaacaggtgactctcatttctagccgggtctaataaaagttaaaaataaatttctaggttttgaatcttttgtcctcaatgtagattttgggaggacaagtggattggaaactcttcttttaaagggtggtatctatctttatataatattgtgcgtcggaaaagtgcgtcagttgcaactatcatgaatacagttcctttgaatgtttctttccatagggaactagtgggccagaatatagttaattggcaaaattttgttgctcgaattgtacgtattaaccttaatgataataaatatatgtttaggtggaaccttcatcaaaatggtatcttttctgtttgatccatgtatcttgctatgatcaacagtgggtatattgataggaataaagtgttacggaaattgaagattcctatcaaacttaagattttcatgtgttatctagctaaagggtagttctaattaatcaatgataatttagtaagaagaaattagaatggtagtactagatgttgttttttatgtccaacatctattctttgattgtcaaatggctaatttttttagaaccatttttatgtcttttaatttggtttacaatactcatatgttttataattggctgattgggatttactcaaagaccaaaaaacatatttcaattagagcatctgccttttatgttggctatatggttaaataggaatgatatggtttttaataaaataccaactaaagtttatatgcatgtactcatcagagcaatatactggttcggttttgacccaactacaaaggtgtgaagaggacattggtgttattcacgctgtatgtcgaaaattggagacaaccgctatgcaaatttttgttaactttggatggagatttaacaataggattgttcttgaataagtgtctctctttttttaccgtggcatttattattgtatcgtttctttatcctttattaaaaattattatacttggttttcagctaagaactatatatgtggttgtagcttccgttaaagtaaagctcagatattatccattatctaaaagaaacttagcacttagcaataagccagtgaaaaaactgtagatattgacatttattcaaactagctaattaaatgtccataccttgcaatcgtacgtaagttaaagaaagataacttaattatatattgtaaagcgtatattataatatacacgaagaatggatcaaaattatccatattatactactatcctattctctcatttctttcattctaatttgttgtactaacatatattatattaaactataagtggtggaggcagacactaccatcaccgctggct

SEQ ID NO: 60511 - DNA, 2888 bp, Oryza sativa
caccgccgcttcctgctcctttgctcagctagctagggcaagtaatataatacttcatatattgcctctaagagtgtcacattggattgaatgatgagatggaggagagaagtgaggagagagatgatgagccacccctaaatcaagaggtaacctctacacaaatttcaagaagagtgtgagagtattagatatattggtatttttagtactagaggtgatacattgtataggttgtctcttattttatgagtgaataaaatagataaatttagaggtggtagtcacatctattatagcacttgcccttacctgatggatcgagttgaatcatcatttcagaatgtgtggcatcgggaaaggagcataatgcacccttcaagtcattatgtactttcaggtcattatgtgcactagtactgaagccagtatcagagcgatgatcaaatccatggagtggaggtgcctgcgtccgagcatgagcacaatactggataaggtttaatttgcgtgagttctgcatatggcaaataagcataactttgtttaagggtgtgcttttttgaattgtgctctgtatgtgatggctgccacaagagccacgcagtaacgatcggcagttgaaaatttgcagacacaccccatatatacattttggttaattattcacatgagctctccatgaagaatacgggttcgtcaatagctcgactttaagtaggttgtcagtatgactataaaagaaaaatatgttgatttctattttgaatccatatgtattccattatggccacttttataatggtctttaccgcaagtagaaacgattcgtggcattggttatgaggctcttgctttattgcacaactatatcctgttcactataatatttgttattaaattgatatggtttactaaataaaagagagatcaattgtcaatcatttctactactagtaaacaccaccataaaagtatagtaggcaggaagtaaaagcagctattgtattttactgacaattcttaatgcatctatgtagttctcctgtatatcgagaaaataaatttgttgacagattccatcttccagtttagttttctttctaggacatactttatcatttcaaataaatcaaaccggcccatgattgttggttccttagaacagtcactgatactactctgaaccagcagtgatacttgaatatcactcttggttcttgttatgaaccattactattgtatcactgctagttgttcttgttataaatcggcagtgataggaaacaagcatcactggttcttcataacatgaaccagcatttatactcaattgaccggacagttcggacctatccattgaatattggaaaaggccgacatattcaaatgatagttttttccttttatgaaaaactttatggcaaaatcgtagagttcgacgagttctacaacttccttggatccatttgtgtcagggttcaaaatttccgaacgaaatttcaaaagatttggtcatatcggaccccacccccaccgatacgattttattttttaaaaaaaattctcatgaattttagcaatatttgtttaaatttaactaaattttgtttgaaatttcggaccaaaatttcggaaatatcaccatatcggcacccctaatacaaataccgaaaacgaaagattgaaccatgtattttttttatttagatgttcaaagtgttgggatctattccacggaagaatgtttaaaattttcaaatgacgtcgtatggggaaaagctatatatgaaatttggactgcccggcaatatctacaacattatagttaatgctttttttttcatttgaagttatatctacaatgccaaatatgaattacctgttttttatagtgagacatcagaataatattattttcatacagaaaggatgttacacgtcgacagatgggtcccaggtacgaatcatatatatacaacagaagcgtcgcatgaaaaattgcataatatatttttcaccaggttaacatcttacaaaaatgatactcccgaaatgatatatatatgctaccatgttttacagttcatcaaacatattaaggaaaaacatctcaagcaattaaacatataaaattaatagggcaaccatataaaatacaagaaataaaaaaaacacataaacaagatgttttacatttgaaaaaatatagtataaaggaaacatcatgcgaggtatattttgttagcaccttaatgtaactgccctaggattcgtgcaaggtgtatatatacatggtgtaactgtgggtacatgctctcgcgtgcaaaaaaaaaaaaatcaactcatatatatcagtctgccatataaaacaactcatgctatttacatgtaattttttagttctgaaacatgtaccttgtaaagagcttgctaaaagatttcattttaagaacgggtagcattggagaagaagaggactggatgttcactttaggatgcatgacagttcatgcaccagcagaaccaccagctggcgatcccgggcggtggctcgggagtcgggacactgagctcattgagttggaattaaggcaaaaggatgaaatatcgtggacctctctcttgatctcagtgactgaatttggctcagtgtgtagctggcagtacaattttgtccccgaagctggtagatagccaagtccctaacttgggcatgcgttgatgacaagaatgcgctgggattctcttacgagcttgcgagtgaagggcaactgtgcatgcaaacagtgatacaattccgatctgccgtaacgatcgtacttttttttttgggactagtaaacatgagaaatgattagtatcttctcaaaatgaaggtacttgac

SEQ ID NO: 60512 - DNA, 9417 bp, Oryza sativa
atttgcaaaattgtgcgaagatcctgaatcatgtgaaaaattcgaacacttgaaacttcttctgccaagaattgcatgtctaacgctgcgcggaaaagtttgcagtctgtagttctgtttctgcaaagagttgagcttcacatggaatggatgttgatcgaatgcaattctcatctcaccagttactgaaccgtatgtactttccattttgaactgtaagcaggctatatacaagcatcaatcgataattttttcaccggtcgagaataggttccagaccaaagtcccaaccagatacagcacaacagatactttgaagacatcatcccaagaacctgcgtttattaaacagagcaacaaaaaatcatgtaaaagattgtaaaattgatgtgcattatgtcactagggagatggggatttcaggccaaaccatgctgcaagatgtatcctgttgccgctgtgccaaacacaccagctaaaaccccagccgtgttagaaagaccaagcagtacaccctgcaagacaacatgtgagttcacctgaagctataatgtttcagacagaactccgaaaatgcgtcatttgaagaaatgttttgtgctaaagagagttgattacagcgtatcgaggaccgatatcttggtgatttgagtatagaccggactgtgagaatgcatcagttccctgagaataagaaatgcaacatgttatgctggaaatactgagatagatctcaaaatggccattcagatacaaatcacagttgttctaaaaagaggtacataatatatggctgttctatgacagaataaaggaaaatgacaagaagccaaactgccatttacctggctacaagccatgcacaacactgccattgctggtgaatcgatatggctcagttgagtcagaaaaaatgcgggccctaagaatccaattgactgcatgatctgcacgaagtagatagaaagtcatgcacaatgaattaggtttagctcttcattctcacttctaagcattatgttgattaattatgccgcacacaaattcacatattcaagcatggtttgccaatggtagaacaatgattcatattgaatattccgttggagtttgatagcacctcattgcatgggtaaatttcacgactgaagggattaatttaccttccgaactgttgtcactgataatcctctactgacaagcgtatctgctatccaaccaccaaaatttgcagaaactgccattgttaaccaggggagaacacagaaaaggccggattctgtgaggttgaatttcagaacctgtttttaaatattattatacacaagggattgcggttcaagatcctcaggtagaaaactatgatgctgatcatacctggttgtagtatgttggcatccatgtgagcaagatgaaagttccccagttatggcagaaatgagacactataagagcccaaacagggggtttcgataatattagtccccatggaatttctttaacaggctctcctcctgtggtttgactggttataagcttcttctcttcagcactaattcctggatcctcaagtggactactatacgcctttatagaagcagatcacaaatttaagagataactaaaaaaaaattagaaaagtaatacagtaattcaccaattccgagtgaaatggtgaacagaacaccgagaaataccttgctcgcccatgtcgaaaaccaaaatacacccagagacccaaaggagtagaagaccgatggccagccaaagttatgtatcagcaatggggaaaatgcaagccctgtcactgacccaaggtacattccactatacacgagagccaatgatctgctcctctctgatacaggaacccatttcgaaagaatattattcatcgcaggcatggcaactccctggggaaagattttatatgtttaccgtatcaataagaggtgcatagaaaatatcaaataccaccaaaacaaccatgactaagaatgcataaaaaaaagttaatattctttttgtgaattacaagcgaagtgatttagtcaggcatgttctgctaccccttgtattacaaatgaaatccactctttgaaacactgaagaagtctgaacaacagaaatgatgaaaggtgcaatactgtggaaacgatcaaagggaattttagggcaccccagatttttcaacttcaacataaattcattttttttctcttaaaatgttctgtcacttgactatagttcaatagaagctagacatcatctgataagggctctacattagcatttgcacaaaacttgtatgacataacaaatgaatataatatgaattagaaatgctcacctcaccaactcccatgaaagcacgggtcacaaggaggaatggtaaccccagcttcgccgcaaaaggcgtaagagctgtggctatcgaccaccaaatgacgccgaagccaaggacagtcttccctccaactgtatctgcccagattcctcctgctatctgcaatggcaatacatcagaatcatggggtaccaaatgaactcaaactgctcttgcatgaatcctagttacagatttccctggattagtactgcacacagacctgagttagcaggtagccccagaagaaagatgactgaatgaggccaacagtttgtgggttccatccgaattctgcagacattggcagaatggcaatgctcatgtttacctgcaaaatgttgaaagcatgaatctcccaagaaagaattgaagcttttaacatatactactaccaatcatcattaggaatcggcatttgacaagtttatgtttttggatccgatcaagaaactgcatctttggttcatttgggcattagtgcattttacaatatcaacgaaatggaattattgaggaggggggggggggggaatctagggttcatcagggcgttagagaagggaggaggaatttttacgcggtccatgttgcagaggaggaatgcggagaagcagaggaagacgatggcccatcgcttggggaactgaccctgctcgtcctcctccgcctccccctccgccgcgtcgtcctgcgccgacccggagagcagcagcctcctcaccgacgccagcagcgccccagcgtcgccgtcgtcgccgtatcccccgtcgtgtcgcgcgtcgtcgtggcggcccttccgcgacgacgacgacgaggtgttcgaccggacgtcggtccctcgcagcgcccgcctccggaacaccctgacgccgcctaacccatccccaactccccggccgccgccggggtcgaggaagcgccgcgagcgcggcgccggcggcgagccggggacccggcaggagacggagagcggcagcaggtagagcatcgcctcgcctcgcctccgcccgtcagcgcgcgcgcgcgcagcgcaggtcttcttgctcggttgcttgcttgcttgcgtgcgcgggtgcgctggccgagcacggaagcgagctcagctcagctcggcctcggcctcggctccacagaggacaagacgggggggcgcgaagatcttttctcctcctcctcgcgctctcccccccgcgcgcgcgcgtgacaggtcagtcagtgcgaacgcgggcggaggcgtggcgtggcgcggcgcggcgaggcccggggacgaatggctgtggtgagcggggagaagatatatgcgcgcgcgcgcatctggacgcgacgcgagcgtggcagctcggcgtgccatggaatggccggaagtcatcggcccaaagctctctcgatcgaaacggcgggaattggaagttcccgggcctaaccgtatggtggtaggaggccctttatcaatgtgctacggcccggtgcccaatgacaatctaacattactttttttttaacactccctccgtcccaaaataaatcaactcctagagtttaaaatttgtcccaaaataaaccaactccttccaccaatccgcaaatccagaaagtttattacttcaatacacatcaaccaatacaattttggcaaactttgctacatgacataaaaaaagtgtaattagctaggagacaccgtaagaatgcgtatttgttgtaaggcatcgaaaaaaagataattagctgctggccccgtgatattactttattattttcgaaggaataggagagagaaataatcatttaaaaccagtttttccttggcttaaattagtccaacgtgggccccacactgagcaggtcctcatctcgctctagcagtggcacgccatcgtggtcgcggatgcggcgggcgagcttaggaggagcggtggcagcgggcgagtctgggaggagcaacaagcgatgggcgaacgaagcggcggctacactgccctggcagccgccgccaccttctcacctgcgatgcagcactgcctcgttgagctcgtgcagggactttgtcctagtggtcggatcgcgcaccgaacgatgcgcgcaccacggagacggagcagaaggagagcataccttgcagagtcctcctgctctggcgctacctccgccgcgtagcaccgcaccgacccgcacgccgttgccggcgctctccctcttcctcgggcttggttgaagaaagagaagaaaagaaagagagaaagaatgaaagagggagaaaagaataaggaagaataaagaaaaaggaaaaaattaaagggtagaatcatacttacacatctgtttctctctccaattcgtccggatataataaaataatcccgcgggtattcaacagctaattactagttttttgcaatgccctacagcaaatacgcgttcttacggtgtcccctaactaattacactttttttcgatgtcctgaagcaaattttgcctacaatttttgcattagttaagggttatttgatcttttgtttctttccttaatagcttcttggatgctaaggtttgattttattagggacggagggagtatagatctagatgccccgctcattctgatcccttctgcgacgtgacaacgtcacagatatatgacgatttcgaccaacgtcttttaccatatgatagacaacttccgactatctaccgtctgcacggggcttaccatttttttcaatttcatatgaatttcaaaaaagatatgatccaatcccaaatttcaatgcccttatgagttttttctatagcaatacgatcatttaatttttttctaatcaaaggggctaaaatattggggtcgtaagttgcacacgtttgcttctcttcaaatacgtatttttcaagtgcaactgtgcaagtacgttgttgagttttggatttttggttgattcagttggttaattagggaaaataaaactaaccacggtccgtaggtggtgttggggacgcgatgcacatagcacgagaggtatgcaacaccggccggtgaagggggctttttgtgttgcacggcggcacggcgccgcgttgtcttgactgatctcagagctatatatcacaagctagcttattatacattttatatatctcatgtttgcgagaaaatcaacgatttgccaattgattcactgaaaccctctatattgcaattgattaccatctatttgactatttctttgtcacctcgatgattcatcacctttatagactgttttgcagttgttgaaaccctctattatattgcaattgaccattttgcctctgtccgcggatctctctctctctctctcccctgtacgagatcgttgagagtgcgtgacacgcgccactaatggtcaattggattaaaacactgcgattacgtacgtccgaatccaatataatggcgtagttagcacgattaggaaggcatgagccatgaggttctcgatgtatcaccgggcgcattacattcatcaagataagattttccctcgttttcaatatcacgttttttaaactactaaacaatgtattttatacgaaaactttctatgcggtagttgctttaaaacatcatattaatctatttttcaagtttgtaataattaaaatttagggcctatttagcacagctccagctccacccctcctggagctggaactcagccaaacagtttcagctccacaaaaaatgggagtggagctggatggagctctctcacaaaatgaactagagttgtggagctaggtttaggcagctccacaactccactccagactcaactcctggagctaaatttaagagttggagctgtaccaaacaggcccttaattaatcaagtattaatgacttttttgtttgacatgtctgcttttaatcttcatccttagcagattcgaatggggctaggcgtggtcagatataatcactcagactcagttgtttaaaggtaagttttataatagagatggtggtcaccttcaattttatccacatcatccatctataaaattaaaactaacttatataaatgaattgcatttaatacactagtactaatgcacttgccaccaatcaacctcttttattttctcttgatttttaaagtttgtgtggaggttacccgttgcataagaggtggatcttcctctctcttctcttctcttctctcctccacatcattatttaaacatacacataacactttggagtttatacttataaccttaagagcaggtacaatagatgactataaatcagctataaacatatgttgagaagataaaaaaagagaaaaaagagcagcttcagcatggacttcaagacacaatgtgttgacagatgggactagatattaatagtatactatatgtttataggtaactattgtatgaattagttattaaattgactataaatgatttgaagctaatagttatctatacattatattaaacttggtcttatatagtaaaaagacagtaatgatagctagccctggcatttgcaaagctcggagactgtgtgagtacgttatacgtactgtacatctcacgggatcatcggaacgtgcaaactaatcgaacgtgccacacacctaataagcacgcggccccagcaggtccatcctcccagcacgtgcgacctaccaatttcctcacggacctcaccgctccgtacgtttgtgtttgacgacgtctagggctgtaaaagaaaaaaaaagctgggcactcagtagccactcacaagctgctcaatcgccacgagaggtgcagtagtaagtggctaatccataaactcacttatatattaaaataaaacaagtttataaataagtttcactagttaatcaattacacctttaaccgactcatcgtaggcttaatagttctagcttggctcgagcttctgacaagtcaagtccgagcctataccaaaatctcgtgagctttgtcgagctgagctcaagctattatcgagcctgacaatatatgtattttattttttactttacaaattagtagatcaaagtatatattatattatttatatataagtattcaacacaacgaagtagtttgtatcggtgccacatatttatattgttttgttttctccttatttatgtatgtatatgattaaatagaaattagttgcttttatttattgagagattcgatccttaaaatatatgtatagtggtactccctccattccagaatataaagatttttagggttgaatgtgagtactaagaaaatatttagaattaaatggaagaaaatgatgattggtcgagaaatagagttaggcgagaaaattgaatggtgaagtgttgtgattttggctgagaaaagaatgttatgaagaaattatcatattttgaacaaaatacaacaacatcttactctctcagggatactttacaacagaggtgacttcttcatgagttatgagccagctcggctgaagcttatatcgagctcgaacctgcacaggtgagctccgctcgttgacagccctagcgacagtccccgtgggcgccatcgccaataaaacgcgcgcgcgccatatatagccaagctcctgtactccgtgtagctgctcctgtacagtacacctctttcctcctctctgctcgccggagacagactagctaagctagctagtaggagatcgaggagggattgaccgattgagctagtaataatggccgccggagacaaggccggcggcgacgacgctgcggcggcggcgccattgctggtaccggcggcggcggggaggcggcggcggtgccccgggtgccggacgaaaggagagggtgcgaggcccaccccggcatcccttacctcaacttcttctacatctggatcgtctgcatatgcgcctgtaagagctacagctatagctaattaattaagctacctcttctttcctttttgttttccttttattaaatttgtttttcatccattttgccatgcgtacgatcagatacgctcttaattatttactccttaatcttctgttgttatatttcaataacctttttagtctactcttgcgttttcttattttttttctctattattagttcttggagagcacgtacgttcaaagtggtaccttataggtgcacgcgccttctcccgaggtttcccatagctaagggcatctttagttggtgaaatgaaaatctttgggtgtcatatcggacgtttgaccggatgtcgaaagggatttttggacacgattaaaaaaaactgatttcacagctcgcctggaaaccgcgagacgaatcttttgagcctaattaattcgtcattagcacatgtgggttactgtagcacttaattatgactaattatggcctaattagactcaaaagattcgtctcgcgatttacatccaaactgtgcaattagtttttctttttatccatatttaatgcttcatatatatgtccaaagattcgatgtgatgtttttgggaaaagtttttgggaactaaacatggcctaagctgatattatctccatttcaacataagtaagaaataaattaaaatactttaattttatcaaatatcgatataattatttttctactttatctacattcaacacatttatcttttactttcataatcgatcttcaatataattttgtaaaagtaaatttattttgtgataaacaacagaagacaattaaataaatttattcagaggcggagggagtaatacaccccttgctatcttcatttgggaaatatcaagtactagtactttccattagtataacttcctgatgttctccctcacattgggtttttaactatttgcctatcttacggagtggcactattgagatgtcacttttctaaaattttttacacaaacaccgtatgagactgagagagatattttttactgagaaatttgaaatgacatttttactcctattttaaaaaatatgagagattatatataaacatatt

SEQ ID NO: 60513 - DNA, 1909 bp, Oryza sativa
cgccccgccctgttgccatccctaatcaaaactcttatgaatgcaaactcttatgaccagtttgcagttgaccgctactacgtacctcctgcagccgctgtgaaccgcgtcgaagccacggaggtcatgccaacgagcacatccgttagttgaagtttactaccgtagatgttggtatattattttaatataaactcgaccaaaatgtgagaagtttatatacagaagatttttcccggcgaggacccatgtagattgcagacggaccgtaaaggcaggcctcttaacatgttcgcttgtgaaaataagactattttcacatgcgggcctcttaaataatccgcatacgaaaatattcatctgttcccactctttttttatttctcacctcctttctcccttcactaaggcccgttcgatccctaccaatgttgtcaggacacccgaaaatcatattgtccagtgtttattgtgatcaccacataatttcgggagagtgggatccatacatgtataatagccactcaagcctcaatgtgcccgatgatcacaattaaacaccattcaatataatctgcagagtgtcgaatattgaacaaaagagagactgctgggacttagcgtgccagtcaacttcagcatgagatatgtccgtcaaaccacacgaaggcggtgaccggatgtttacacatcccagaagacttgacaaattgctaagctctacagcatctcgtttgttcaacactcatactcatgtctagctagtcctcaacaaaagactaactaaacactttcattaaagcattggcatagagtaataaggcactcaaaagattaactttagattacaactaaaattggatatacgtaggccaaccggctaaataaatagtggtttgcacggaagcttatctacccaaaacccttaagcaatccgactaagggtagactcttattgaaccatcctgagaagaacaacggaactcgtggcacacaactaatcctgcaaaacaacacgcgaaacaagaaaaatcattagtacatgattaattaaggattaactagtataaaattgaaaaatagaattatttgattctttaaacaacttttacataaaaactttttaccaaaaatatatcatttagcagtttgaaaagcgtgctaacgaaaaacgaggaagttgaagtttgaagttgagaaaaggaactaggcctaagtcctcatctcccctctcctccctcgctctcccggtccccactgctctcccatctcctctactcctctgccctctcctccgacggcgggttttggcgacgggggtagcggcgaagggtggaagcgttaggcgagggctcgggcgacggtggtggagcatgagggcagcgggcgtggactctggcagtggcggacgagtgggacggcgacgacgggtgagggccacggcggggcgagcgtgggcgacagcagtgacgatggccctcccccgcacgggatctgtcagtcgccgccctccttcatcctcatccggcggaagccgcccttcccacccctatccggtggcggcagcacctcccgcgtggacccgtcggcggtggcaatggcgatggtaggacgacactgacggcgacggcggcggcggttggagaacgaggaggatggcagcggtgactggaggacgaggatgacagtggcggcggcgacaagatgattctagggatagggtttcagttattcaatttttgaaatttttatttttttcgtgttattttcttcacatgcggttgcgctagctaaatataaaaatctgattttcgtatacctttggatgcatgtgagccacctgtccgtatgtaaaattcgcttttaaccatatggaaaaattgaatctgtatatatatgtggtaggtag

SEQ ID NO: 60514 - DNA, 1895 bp, Oryza sativa
gacaggatggaatattttttttacgaatctggatagttagctcgtccagattcgtggtagtagaaaatgttccatctgattataaattattatattttgggacggatagagtattttaattgggagattatattcttaaaatgttagtatactatttatgagtcagctcgagcatgtgtcaacctcgtcggcacaccctaacaaacgtccctggtgcatgcgcgccatcgctctatataagccaagctcctgtactagttcatcagtgtagttcagtcagttccacacctctccttcctttaatttctctctgctcgccggagacagactagcttagctagtaggagagggaggaactaatggccgccggagacaaggccggcggcgacgacgctgcggcggcggcggcggcgccattgctggtgtcggcggcggggaggcggcggcggtgccccgggtgcctgacggaggagaggtgcaaggccgacgccggcatcccctacctcaacttcttctacatctgggtcgtctgcctctgctcctgtaagaacccaagcttgagctagctactatacctcttctttctttttttattttttttgtcatggtttcatccattttgccatgcatacgatcagacacaactcttaattactccttaatccgctcttattatcttttgaaaaaaacattttgattaatttacttgcgttttgttttagatctattagttgttggagagtacgtacgttcaaagtggcaccttctaggcgcacgctcacttggccttcgatagggttcaatttttacccacatctcatatgtaatcaatacaaaatcaaaatctaaaatacttagactttatcaaatcctaaatttccttttttttacattttcaatatatttatcttatatttttataaacttcaatgtaatggttgtttaaagtaaatttactttaaggtaaataggatgagtcaaagttaaacttacttggagactccacgtgctatcttcacttggactaaaatatcaagtatactagtactttccactagtataactacctgatcttattcccttcactttgcctggctaaagcatctgtttattagtctcttgttcttcttctttcatgctgatgcaccatgcatccagaacgagcagttgaaaagtcatttaactggaggactaatttcttaagttaatcgcccaatttactgtgcagtaaaaacgtgccattgctttaaccatgggggttcaaagaagttaaagcagacgtaactacccagacgctcagtgaataaattaagtaattaaccgtggttaatcaggtcacaagaaaacgtactactagtagtagtgccactggccggaaaggaatcattttcacttgtcacggttccagacaacggggctcattttttcgcttatgttcctacttattagccaaaatttaaaattttaaccttaaatttagaattgattttagggttttttttaatcgaagtttatttttcaacctttatttttatttttagatcgctaagaacacgtatataaagttttattcacaaattattttttatttgcaaatataccgaaatgatgggtctatctaatggggccccatggtcagtacagtatacagtactccctctgtaagaaaaacccaatctaaagttgtgatctaaatctagataaatgctagcttatctagatttattattctaaaatatatctttaattttttttctggacgaagagaatagtcctaaaggacatgagaagagtatttattgcacggagatgtttcagcagatgtagaatgtcagcatgtgagggcagcaggtgcggtgttgagagtccattcaaacttaagccaccaaagcgta

SEQ ID NO: 60515 - DNA, 1811 bp, Oryza sativa
aaaaaatatagaaaattgcatggtttagaatcttgtgagatgcatatatacgtgataatctataatctgtaagagaaaaaatacagagatttggcttgtttgtttcataggaaatatggaagaaaaaccattcctacaggaaaaatcactgtttatccattcgttttgtaggattatagcaaaggaaaagcataggaagaattcctttgtatgtgattcctatggaattttgtaggaaaattaacatccacttggacctcttttttctattcctacgcataggatcaaggcaaatcactcgtttcattatgtatttgaatctaagttacacaaattagagtattcaaatcttggttgtggtaacttaatacaaagattcctgtatttttctatctaagagttattcctatgattttcctatcctaagttttgcacatacattcctatgttattcctacgtttttccttttcctgtgatttgaaaatatgaaccgaataggcccttaataagtccaccatgggaatggaacagttccacttggtcgctcattctcccacccttttccttggaccatggttgcgatgctagcataaaggttgaaagaaacacatctatatcaatatcagattgacgtgacattttgatatgatcagtttgctctactactctgtcgaaactctcttatgaccgtaaatccagtgttaaatttttagtgatattgcatctacttattttgcatcggtcatataataaacactacggagtatatgctagatacaaacacatcttttccatttgtaaaaatggaaaaaaaattgagtgccaaaactcaggcattgtacggaaatttgctagagcaatagagcatcactaaaaaaaaacagaaatatgctgctcttgggaagggggaaataacagaattttacacagtgctgtatatgtgctgcacaacacaaatacacaaattctatgcaagttgagataaggtgattccagtcgagggaaatgcaaagcattgcacctcatccacacgtgaatacgtacgttttctgggagctatatctggcacacagcagggctaagctttccctaccgtgcgaagcttcctggaagtttacctgcctgtggccctggcagtccctcgtcgctaccgccctgcaaaaaagatctgcgatttttcagtgaaagcgatggctcatggccatcgacggtagtactatttcgttgcatactcaacacccccccccctctctctctctctctcttaaaaaaaccaacctataacctaaaaccaagtatgacacattctattactacgaatctagacatacctctgtccagattcatcgtactagaatatgtcatattcggttctaaatttgttttttcgggatggagggagtttgcatgaaattctcgtaccagataacttgactacttgaggtctattccctcccttaaaaaaaacatattctgatatttctaacaatacatctgaaagcatagtacaccatgtcacatcgaacgtttgaataattacatgaagtattaaatatagtttaaaaaaataactatttgcacatattacgactaagttacgagacgaatcttttcaacctaattgctccataatttgaaaatgtggtgctacaataaacatgtgctaatgacgaattaattaggcttcgtcacgcggtttactgacggattctgtaattagttttttattagtgcccgaacactctatgcgacaccttatataatatccgatgtgatacgccaaaactttacacccctgaatctaaacacc

SEQ ID NO: 60516 - DNA, 4840 bp, Oryza sativa
acaaaaccacaagtaatattaaactggatgaagtatatttagtacggagcgtgcctcggatttaacatagacccacgtagttgctaactccgtcggtaaaggtccattactagtctattaggcaagagaaggcaagggaattgagagtttggacaagggaattggtggaagaattggtcacccaagttttttttttactctgtctcttgtttgatagtaaagatgatagttatgtgagtacggatgggaattgaattttaactaataatgtacaccttagatttatctgtcgtgcctagaagaaaattccccttccgattatcacttatccttattcagatactagtaatcgtgcacgtgcaatgcatgtttccaacatataaaaacactcaaaatttattgcattttcctgcaatatatgtcacccaaaacacacaaacatactaaaagtttaagaactatttctactataatgtaatttgacatactacgttaaacatccatttaaacacaaaaaatgcaaagcagctaacaatacaaaatatataatttgtcataccttaataaacacttgaaaaatatcaaagcaagatatttatctttatggcattgaaatgaactccaccatctacaatatggctatatgggatattgtttgaccatttttttttactccttgcctcttgtttggtagtaaagatgacagttatgtgagtattgatgggaattgaattttaagcaataatgtacatcttagatttatctgtcatacctagaagaaaattgccctttccgattatcacttatccttatttagatattgaaaatgtaaaagtttgctcctaaactcctctttccgaattccgatcctttttaaaactttcacgtctaccaactaaacaatatattttaacagccctatctctctttaacaatttccccaattaaacgtgcctttgattcaaaatacgttttacataaacggacacgtattcagcaagtacggtttttaattagcgagatcacgggaccaggtgcttgcagaaagtcccacaagtagacgtggctgtcagtgtgtcacccatgcggaggtccatggggtccctactccccaaggatggctcactgggctttaattaagagtgctcctagtcctatagcacattcgacacattatatggaaaaagaaattcactctaactacaatgcttgtaatgtaaatacaattacagtataagtatggtgtaaatttgttttgatatcaaaacttgtgctacctcagtggtccaaaaattgttttttttcttccaaaggctatattgtaagttttctagcaattccattaattaatagtagaatgaaataatatagctattagaaaatgtattatgtcccaaaaacataataagttttctagcaattccattaatcaatggtactataaactatataattagaaaatatattgtggatgatatatggtatgttgaggggtgcgttctcacaatatgatggagacttgacctcagagtttacaatacgtaccgttctgttgtcgtggtaaccacctgaggtaatcttcttagttttttaaaacatcagtttttaaactgttgtaaccataatattagggcccatttgatttggatgaaaaatatagaaattttagaggattttaatcctacaggaaaaattcctatgaatgcctttaaatcaaaggattgaatcctatccaatcctttaaaacttctatcgaatggacaatcctatagagattttagaggaaacttagcaaaagctcaaagctcttggaaaatttcctttgagtctatctctctcatcttattcctatgtttttcctacggtccaatcaaatggtcattcctgtgtttttgcagtcctctattttacacttccatcccttattagaatctggtgtttttcatatttctttattttctttttcattcatgcgattcaaaagagacttattggacaacgataacctcaccgaaacggtaagaaaaaccacgcatactatgagcggaggaagtaattgtctacagacatctatggctctaggcccacatgcacattactgtctgtgcagtacagctgcaggtgacagtcccgtccatcaacaggtcccgaacttctaaggccatgtacaacgcgtgaccttggcatgtggtttcaaacctccacgtcggacgcccgcacccatggcagtggggaccgtggctctgcaggccgaatccgcgcttgcagaggaaccactcgaagcgccgcgcctgggctcgggagccgcgaagccacaacccgaggccacgcgttggcggagccagagccccatgcgtcgcctcgtctggtcggtcaccgtggtagtcgtcgccgctcaccgtcgccaccgtcgccaccgccgctccccgtcaccgccagatgcgaagaggagcaccgccgacgccaccgttgctcctcgcttcctccccgccgccagatgcgaagaggagcaccgccaccggatccggcgagcccgtgcccggatctggcgaccttgggcgtggggcggcggtggaagaagtgggatgcggcggaggagggtgtgggcgtggcggaggaggaggagaggatggcgcggggaagagcgcggcagttgagaggaggaggaggcggcgttgtcgtggcgcacaagaggaggagcggcgcacgagaggaggagcggcgctgcggcggctttgagaggaggagcggaggcgacgagagaggaggcgttagagaggaagaggataaggcagagccggttggtagaagagaaaataaaggggagaggattggagagactgacggtgggtccatatatagattaggggtatctatacatttctttttgttgttagaaggactaaaatagttaattttataataacaaatattatagggactaacacatgaatagataggggctgaaacacaaaatatactctacagtggtctccattgtagacattgtggtttttgtgtggccttatcctatgtggcaacctgagaccacagttgcttgtggctaccattgtacatgccctaaggtgtctgcatccagcatcctatgtgatcttatttctttctcattatgctctcatgaaatgacattcattacgaagcgtgatatttgaccttagtgcccctttaaatcacaagactaagaaaacatagaaatagaaaaaaaaaatgtaaaattttgatataaatgtaagtgtaaaacagaggattgcaaaacacaggaaaaacacaggaaaaactgtttgattagaccgcaggaaaaatacaggcattaaaggagagataaagactcagcagaaagtttccatgaggtagatcatcatggtttacctccaaaccttgcatggcattagacatttcatagtaattgagacgttttctaatactactaatttggacatgctgcctgtctagattcgtagtactgggaaacgtctcatccagttctagattcttatatattgagatggagggagtaataaattaggccgaaaaaaataccgcaatgaccggctattttctttcttttttttagtccaaagtcgaaaacaaatcagagtcgaattggcagtcgtttaaatagcctaacggttcgtacataatttcacaaactacaaatatattgatcaaactaccttaaaactacatatttaaggtgatgtatcacaaaactacaaatttaacactaaatttttatagtgttcctcagccaattgttggtgttttttatttttaatatcattattaccatgtatgccacaagctagaataatcaagaataatatttttctctctttacgttcttaatataactataattgtgtgtgtgagagagagagagagaggagcaatatgcacacttgtacttggcagagaagccgtttcaaaggagagatttaagccgaccctctaatgccactgcctaaacttagccggacaaaattaattaagacaaaacacccaaaaaaagtgatctcaacgctttagcagatcaatgcttgcaattaaacccccattgcttacttcttggcgaaagagaggagaatgcccggacattctcacaaaccaagcatcatcttgatgtggattcagacaactaaacctgcaaggagaagaggagcaaacgtccttgcccgccattgcggcgatgaccggaggcggcgatgccgatcgcaatgcgccgttgctcgccggcggcaggaaggtgtaccatgaacgctgccccgggtgcaggcagcagaggaaggtgcaggccaatgacaggcttccctacctgggtttcctctacacttggatcgcttgcttgtgtgccggtatggtatgcaccatctttgagaggatagatgtttggttaggatgcaggtgttgatctgattttcatcttgtggatcagctatttggttgtcacttgtcacaagttgtggaatgtagaaatggcctttgcaattgttaagattgtgatagtggtgttttgatgatttatataatatttaggagtagacgatgaatcgatgatcttcatgatattgcgtgtttcgacaaactggtagatcttatcagattcagtagtctcattcttttgtcaaaaatagacatacttttatttgtttcggttcagttgtatcaaatattattttatctctattcctgaaaaaagaaatcccattttagctatagttgactaataccatggtcttttgcctttccagcgttgccaattcagtcgttgtttccgtatctgtacttcatggtaaggggatatgcttataaaactggggga

SEQ ID NO: 60517 - DNA, 6748 bp, Oryza sativa
ttcgcaggtgagcttaagtacactttgatgatgaaaccaagttaaactttgtatagttactaaaatgccgttcgccatgccttacttcatcagagctgacttcttgtgcgagtggaagagaaaaagaaacataaatctgacaatttttttcctaaaaactatttagtttcatccttttaatgaaaacagtgctaatggaatcaagtttaactaaattcgcaacctatgaagattgctctgaatctgttggctaatattgtgcattttctatcttgtatcagcctgcaaagaaatacccaaatcttttctctgaagaatcggtatttgggaggtaaattattaatcatcattcattctgttcctcagaaataaatctttgtttatatacttgaagaacagaagataagcctatccaatgtacttctaatttcaggtttccctactttctcccttgcttcgtcatatcggtactagcagcaggagcatgtgttgcgtgtatttggcttccggtacgccactctctccccctaccattctttctttgaaatgctgaaatgcatgtaaaaaaatatactacctcctttctcaaaaggtcgacatcctagaaagtgtgcaataaaatctcaaactcttaaatcactaatatattaaaaaaatattaagatttgatccgtgaaaatggcattaagatttggcattaaaaatatggttatatttttttaataatttttataagtttataattagaaaaaacaataatgaggcatgtgtattggagattatgttgatgaccaaaacgacaagtaaaaacaatagaggtagtattaataaagtatctactgtaatatgtggagaaaagttacttaacattagccccttgttcttaggaaaccctgcacatgcaccatgatgacaaagaagtcattgatgcactagaggcacaagatgcgacttcagacttaggagaaacaactaaagaatcaggatcagggagaatgggccatacaaagagtttgctgaagaactggcagctgatgtcagcaattaccctctactgtgtcttctctctccatgatacagcttatcttgaggtaatccctatattctgaattatagattatcgcagtaataagaagggcgaaggtaggaagtaaaatgagtggaggtcagggtgctaggcaaggccccaactcaataatactctagattcacccctgggttaatacattgagaaacagtctagtttgttaagatgttgatatgccattgtattcctcctatagagaagttacattagcacaaacagcgaacttaggatgttaatgtactatgtaacttatattttcagatattttcactctgggctgtgagcagcagaaaataccggggcctgagttttacatcccaggatgttggtatcgtgctagctatttccggtatgtgatgttttttcaagtttttatgcatgatcaatacatacaagaaaccatatctcaaaaacattttttttaaagtaatcttcaaaataaattaaatcagcagcatacttagtatacctgtttaccactaatgtgtagctatcattgccttcaaaattcctttagctaatgacaatttcgtctgaatttgcaggttttggtgttttggtgtaccaacttgcgatttatccgcttcttgctaaatatgttgggccaatcaagccattccgttatgcagcggtagggagatgcatgttttgtcttaagatgattcttctgaaaattgaatctttttttttagtaccaatgcatgtttgatttgcaggtcttgtctatacttctcctttcaacatatccattcatggctaacctgtatggtctggagctcaaagtactcatcaacattgcttcgcttttgaaaaatatgttcgctgtaagcaattcctctttgcgatatatatcctgccctataatagggaaaattgcatttttatttgtaccaacataaaaatccatgtttttgattcaagcttcccaaattcagtgatgttgggcttgtttagtttgcaaccataccaaaatattggtaacgccaaatcatgggcgagtttttgctaatgccaacattttaacattgccaaaattactattcaaaatgtcaatattttggtatggcaagttttggcttcaaaccaaaccagcatgttgttccttttttttttttgcctcctacagagaaaaggattacaaattaaaaagttaattgtattcttagataaaacgagcttaatcgttttacaggaatttatcgtttaaagatttgtaatgcttgttttgaatggtacaggctacaattactattgcatgcaacatcctgcaaaacactgcagtggtatgtatcagaatcaataggacatttcttttttacttcaatgcatttcctcgttgtcataatcatgttgttatgctcttttttcttaactgttggaacatgcaaagacgcaagaacaaagaggggttgcaaatggaatctctgtcactctgatgtcaatcttcaaagccgtagctccagcagcagctggaattttgtaagttccttttgtggttagaagttcatgtttcttctctctttttttttccctcttccaagaataaaaaggagatgaccaatcaatcaatctctttgcttgatgcaggttttcatgggcgcaaaagcacattactgggttgttcttaccaggtaaaacaacaaggctcttccaagccatgataatttgcattactgttgatatagtgtcatcatatcactctctctgtcctagaaaaaaccaacttctagatatgaatctgaacatagatagaaaaatcaactttttacatcaccgctgggtctttctgggagggagttcatattatcaggggtgattagttgcctgactcataatgggcactgatacatccaggtgagcagatcctgttcctgatgctgaacatggtgtcagtgattgggttcatcctgacattcaagccatttttcgccttgccggatatgcgatgatgtgtagttaggtaacaaaaaggccagaatttatcagacttcagcctggattctaacctgcaagaggaattcatgtactgtaccgcgtgtaatgttcagttgtgtaatcagtttggtggtatctttgatttctgtctgaactccgaaccattggatggtcgaggcatatgataaacagctaacgggatcttgtttcatctaattacctagctagcagaatcgttgttacattaatcgactgaagcaatatgactgccaaattaaacatgctcaaattccttccaagacttacggaatcaagaacattgtatttcatatatagtgacagtaaaatatgtaagaacatatttaaagatcatgaccaaaactcggggatactgatgagctcacagtaagacgagagaatcaagtgttcatcacattgtcaatatgagaatatgatcgtatatcacccaaattaatattggtagaatgaatatagcacaagcatggatggttttgattaacaacagaatggctacacccttgaaaagttgaaacaaacatagagtaattgaataaacaaaatcacaaagatcagagccatttttcacaaacagaaaaatcacaaacaaacagaaagcattgtctacagcataggatgtctctgaatatcaagaatttcggtttggaacatatctatccccacaaaattacatctgaacataaaattaataaagataattttagcctctgacagtatggctactggaactccccctgtgttgatccaaatgatgcttcaacttacttggccatcatgactttaacgaattcatcgtagttgatctgcccatcaccatcaacatcggcctcacggatcatctcttcaacctcctcatctgtcagcttctcaccaaggttagtcatgacgtgacgcaattcagcagcagagataaaaccattttggtccttgtcgaacacacggaacgcctccttgagctcttcctcagaatcagtatctttcatcttgcgggccatcaggttgagaaattcagggaaatcgattgttccattgccgtcagcatccacctcattgatcatgtcttgtagttctgcctcagttgggttctgccccagcgaacgcatgacagttcccaactccttagtagtaatacaacctggaagaaaataactttatctatgtcactcaaagtctaaaaatcgttcaactcgaggtgtcagtgtatcactacatagtattcacagtactgctttagatcatcaaggcttgtcgctgtttacaaactgataaaagaaagagaaacaagaccaaaagctgagcactacttgaaatgaacagaatcgaagtgttatctaaaattgcttaattattactccctgatcatatatgtaaagattatcgaaaacagtagtagctcatgttagtgctaattgtaaacttcttatcctctaccaccacagatcttctgtagaaaatccaagaaaaacaccaggacagtgtcgtcgtattatcatacgagatgactaacccaaattactacactattgcaatgggaatgaaaacgaggactcgtgagaattatcccatctaaacctaatcaagcacgaatcattacgaacaggcactagccagtgccccaaatctcaaaaaggccagaaaattacgctggatcacgcgattgaccgaccagcatctactcccaaaccgacgagcaacgcctatattatcaaaagatccggagatttcagagcagctaaacgcatcccaaccggatccctacagcaaaccaagaatcgggacacggagacgacggatcagggcgttcgatttaattaacccccaagaaaaagatcgccgatctcgcttcggacagcctatcgatctggttcccgcaacaaaattacgagagggagggagggaggtgaggcaggggttaccgtcgccgtccttgtcgaagaggctgaaggcctccttgaactcggcgatctggtcgtcggtgagctggtccgccattggcgacgcaggcgcgcgcgagcgagagagagaggaaggagaggggagtcgtgggggaggagagcttgcccgagttggagacttgcagtgtgggtaggcttacctccttttttattgcagagataactcacgatttctactgttttttctaagactagtgctaggttaggcttccaacttggcacgttcttccaatggtttaggttgagggaattgcctgtaggaggaacggttcggtactaccttctattctatagttatcgatccaagttatatagaaaaaataatgcttaaaaaaattactgtaatacctatatttaaggggtaggatagagaaaattttgaattgatgtgataaaaggtacttctaaactcctttttttttgaaaactttttaatccaaaagcggcctctattttggaatgggaatggacagagtacatgcactagctaggtctcaaatactatgtattatgtgtatgtggtctcaagtaggatcctaaacaatcatagtaaatccaaaacgaaaatgatctggtgtcccaaacataatagtatatcacaataaaactatctagtacttgacatatcaagcaatttatatttaatagtgatttgtagggtttgttattgtagagctaaatgttgccttagcaaaagtttggtagtacatgtttatcaagcttcaagcattcatcctccaaactctaccatttgtttatcaattgctttcaaatgaattgtcaaattagaaaccctatgttttgggggaaaactgattaaatgaaatccctaattaagaaactgagataaagatagctattataaataaattgaaactacattcaatttgaatgcttgaaacttgtttctctgcataagaaatagctagatgttgtcgtcgacataaaatatagtgtaaactgggtggccaaggtgggaggagggtgctaggggtctataggatccttcgctgagattgatcacgttgtcacttaaagtggtgtgttctctttgcaaattgagagcttgctggtcagtggtgtaggaaagaaaaggagactccttgccttcatcttcttgcctagacgaagaagaagagaactcgatcgagcaggcatcttttgttctttagtgcgtgtctggccattctaggctacttgatgggctttttcattctgcagtctgatagcacacgatttgctctaactattgggctagggggtgacgtcatttctcctatatgggctttagtaattaaaaacaaaaattagcatgtgtcatgtgcatcagacgaggtcaacaagtccatgtacacattgtctagagcaacttagggcaagaacaatgcaagatatgctttagctagacctcaacaagatgtagggccaatacactgatcgaacagacatatactccataatgtatgtggtctcaagtagggtccatgcacaagctacatagcaacttaaaacgagcagtgcaaagacatgctctagccaaacctcaagtgtcatgcaggagcaagacattaaatagacacatactccacagtccacactacatgtggtcttagatagggtccatacataggattcaaagcgaatcccacctaatgatctgccccgggtgagccatgaaacgtgtaggctccatagagatacacgactcctcactgagtgcgaacataggggt

SEQ ID NO: 60518 - DNA, 3509 bp, Oryza sativa
atgtaatgcacgcaccaaacactcgctgcatttacccaccacaacaaaacgtgcaagcaggtgccaagcgcagtgcagcccaggcatcctgctatctctctcacccaactctgttggacaccgtttggtagatgttcttcagctgagtattccacttgtctatggcttggtatttcctcattcccttcgacctgcgaaatgcgaatcggatcaccttcagaaaagcaatcgcatagatagaacaatgtgatggaaaaagcagggggaatacgcacctgtcaccacgttctagtaacttgttcacctgatctatgtggccctggattcggttatccagaatgagtgagaccaagagctgctcgacatccttttctgggaaatttagctcctacatgcaaaacattgacagaacaatcgatgacaaggcatcttgtacactgtacgaaagcaaatttcacaaaaaactagacctccgtgaggaacagcatagggtctgcacgattaagcgcacatgatttcaattgaactggaatcacctagtttgggcacacgacagaaaaagatcaagcttcaaactatatttcttgcaacttcctaaaatagcacgagtatataccaaagttccatgttactaataattttcatgcaccatttgttatcacaagatattgtcatattcttctggtattgagcaaatgcacattatctggtgttggacaaagaacagattatctagacaaaatactaatctttagctcacatcaatttctgtcagcaaagattatcatgaacatttaagagagcgagtattcacctgtgaaatgaatggaatcctgattctagtatatggcttaataagcttgagcagaacttgagttctgatgttcttcaataggtcctcaatataattacggatgaaaggatcgtccattattgttcttctgttgctctgaattttgtttgtaacaatcacatcagaaatccagaatcaattaacagaataactagcttagaattgctgcagaaaatagcaagatggataatgttcaataacactgacctttagaatcttttcaaattccatgatgtcattcttctgatatgctgcaatcaagtttgtcatggcgaggatctcaggatcatttttgtacctgaaagcatcaaggagttacagggtggcatgaaattaagatacaagatttatgagggaatcatcaaatgtcttacggcttagcctcttgcccatcaaagggattcacttcagattccatcaacatatttgcaagaacaagatatctaatatgcagtacaataaaaaaggatgaggaagttctaaatttatcaatatacgaaattaaaatggaaaagaaatgcagatgatttgattacttcaggcattgaattctccgcggattgccagcttcatcatagtttttgaatgcttcaaagaaatcagttgcagcatctgcccattgcctctcagccatgtgcatctttccaccacattcacgaattatacccatgattcttggatgaggtatcgctgatttgatggaaagagcttttgtatatagttcctgcagcagaggttcacttcagaaagtgcatttcatgctaactgcctaaggcaggagaaaggtttgaacccaatatgggtcaacatagtactataaatgaaataggctaaatatagtcaatgctcttataaacatattgtccaaaataggtacaaaagacaggcatcagctttgtaggttttattttataaagctgtagaaaatcaataatttagcaaggaagttgtgtgctcactataccacctgatttcaggcaagcatattatgcaaatgtataattgtatactcagtggcaaatatcctggtatcagtaacatatcaacctatacaaattattgtcaaaggaataaaccggcaaaacagcagaaggatgaaaagttatctttatatctgcgttctggctgcagtcaactgtgttttttaacaaatatacagctagagtactgcaatattgaacaagaaactgacacaaaatcttgaacagtagtaacctgtaatccaaaataatcacgtgtaaaaagactgacaatatgtcttaccttcaattttttgttgttctttgtttcagtgtacatttggatctcaatagcatagacttccaaaagttgtgtgcctttcttctgatcatcagaaccatcttctctttgacaagatttatgcagctccttcagtatctacaggaagaagttacgagcaaaataattagagtaatgactgcagaatatgtaaagaaaaccaattgactagagaaacttgtataagcaccttgctcatccggccatactcccccatgtcaaaccaaattttgcaaagcttcaggtttgtcttaaaccataatctctgcgcagcaaagaatagcaaggtataaagaacaatcttttggtacataaaattctaatttggataaggcaagaaactgaacctcattctttgcctcttcaagtgctttcagtgttgtctggtagaactcttgcagaagagagaagttttgactagctgatccggagacaaaatccataatgttgtttatacatttctcactgtagttacgtgtcacagcagatttgatgtatgtcaacatctccctataggcatccatcatttctttgtacttcccaagcttataatacagcttcactgtttgtttcagagctttgaaacccctataaagaaaagagttacagaactgacgtcagatctctaaaatatgagtggctgttggatacagatacacttgatttcactgacaacttataacacattaccattgaaaaaaaaggatgtccatcaaaatatgcagccctccaaaaaggccactaatacttcagttagaattctatttgtggctcaagcatatcctatattgggaatctggggggattcctggtcaacataatatgacctgaggttttaagatcttaggtctgaactttgagaaggctcgagctgatggtttgtgataaacaattttcatacatctttactgcacaaagagtaggtgctagtgatgtcatgttatatcttaaattgttaatcttctgtggatggatctacgtaaacaagaatttgttgtttgtaattttttttctaatactgcaccatgcacacattcattcaaatatataaaagaccggttcatgaaaccttatttatttttaaatttttagggcaattatcttggcatttgtaggatcagaatacagactatatctaattgaaagtcttaacagcatacaggcactgtgctaccataaaaaacatacaagtacatgaaggtatggagtccctgaagcttaacgataacaagtagctcatatgggcatgttgacagtcgaatgccaatagaatttagagttcatatgtccaggaactttatattgtagatggacctatacagcaactaaaatcgacatcattatagatacaattgat

SEQ ID NO: 60519 - DNA, 5088 bp, Oryza sativa
tgcacactcgttaacgccccctccctcacacagtcacgtgacactgccagctgaccccacccagatgctcgccatggacagctagcatatcctggatgaccacatatatggccaaggcaaggtaagcctctgccagcatcctcctcaggcctcctactctcctagatgccactgctatgacttttgataagtgagacccgtctttctaaaaaagaaggggcactcatggagtaaggtaagtgaatcatcggttttgggcataggcagccctctattatagatcccaattgccatctcagatacactactttacaagaatgaatcatcactattgcacttaatacatatccatggaaaagaaggatatcatagaaatttttgttttccttttttggatccccatgcattccattattcacgtaactatggattaattgtccctgcctatccaaatggtagttgtctaagagcgcaattactagagaaactctattttccgtattggtaaattggaacatagtgtgactcttcaatgttgcgagaactagtccttgggcctcctcttcagtttttcccttccctgatccaaaagatgggtgcaccacctaactggcactgtataggcatcggtaagatgtgcaggccagactctggacctaggttcttaactaccggagtgaagaaaaggccagatcaagaaaagggcattgtctaggcgatgccacaacaaccatgattgggtttgtacaaacatatcggcttttttccttcttttttttttttgaggaaagacactgcataattagtagtccgcctgttaagattatgtgcacaaatttgtaaagcccttatgtttataacaactggtggcattaatttaacctcctttataaggctagaaaattctacgttgatctttagaagcaaatgatgaattccaagaaattatcgatcctcaaattaatttagtcatgtaaaattatagcagtgaagattatctttcataaaagtagaaagtgaatcattaaaaaaaaatctttccaaatgttccatacacagaaaggtaaaggcagttcaatcagatgtattcaaagaaaacaatgcacatgcccaactaagtctttgtattttaatagtggcatgatttataagctcatgaagcaacaactatcaggtattcagttttcatacaaactaaatgtccctttttagttgggaagtgtttttttttcgcagaaccaaaatgttagttcttaattacaagggacacaataggactaaccacacagtcggtggaaataagcaatgtagtacttatcactttattaagattctgatggtgtaggatattcatggtcaggtttaaaaaaaaacgtcctaagaaattcaagaaaaatatacatacatgcccatcaacaaagtcacagttaaaccggcaattacacgcaaaagcaaagcaacatacatacatgcatcatagaagggaaccctaagagaacagctaaaaatcagggatttggctggcacacaatcatggtggcctctcctcgaatactacactaccacactacatacacagggtccgagaaaacgcaccgccgaggaaacacaagaatgaaagagattggaagcgaacctttggagttgtagtactggttctcgatgtcaacatcctgctcctccggctcgtcgtcggagtactcgaacccgtaatcctccatgtccgcatctggaaaaggaaccgatcacggggatgagagaagggggtgcggaaacgacaatcgagcgagggcgcgaatcgggatatcggggattaccggagcccatgtcagcggcggcggtggcggcggagaggaggaggcgacccgcgcggcgacgggcggagagggaggggagggggcgagagctagggtttccgagaccgcagcggtttgcagttgcggaggcggatgcggagagagaagagaggagaggacgaagggagggggcgacttttgcgtataagcccctgggaagttagggattttaagacggagacggaatacacctgaataataggatgctctctctctcccttttttttcacgaaaaaacaggcaaatgtttggatttctcaggggatttttcatgttgtgtttttttaggttgattgatttttcatgttgggttaataaagcagaaattgatgattttgatttaaaagcgagtaacgattgtagtagagaagagtggttgcgttggggttatgttaaaaatagggcatgcacactctcccggtatttatcactctaatttattgctttcaccatatgcatgtccatgcctcttcaccgatgcaggcgatgattaaggttattatttgttctaattgcgtagtatactccagcatttcattcctttcacagctcccaagtggctaactgttaacaataaaattcggtacagttctttagtgggcgcgtttgctttgtggacactctttctcgtctctccgttttccacctcgcacaccaccgtcgtcatcgttgacgcgttgcttgccatcactggccaccatgttagctcggtcaccgaccacctccggcgtgcccacgtgtccctaccgcctagcatcaaggcactccaagcaccttcccccaaccctccgcccgccgtgtggatcttcgtggacagcgtcatttccttggctcatctccgccaccatagaccttcattgtatcctccgccagctacaccgtcaagcctagttccaatggccccaccatcggccaatattctattcaagttgatgcaagcattgcatcgttgcttagagtcgtgtcggcttagttaggactttctcggttagatttgatattctaactaagtggtatatttctaatcataatgttgttttagattgatcgatatatccattacgtttgtgtagatctatcggctaaataggtttttcttattgtcttcaatcttatattgtctcgttaggtccgatctattagattgttgctataataagttaaattctagtaagctgatatgtttcatgcaaaatttcattggagttctaaccaatgagttattattattatgagctccaatgaaacattgcatgaaaacatacctgacgatgtatgctttaaccatcggacctgcatcttccacactatatcagtatcggttaattggttcatttctttctatcatccttgttagttgcaggatcaaaactaactaacacgctctgagccctaaatttaggacctgcactggagtaaaacacatttcccaggccttcatgcgtcacgacgtattttgcatcaacactaaaatacgctgtggtgatgccgttcttgctacaaactcttcaacatccgcaaagatttgtttgaattgctcagagtatcttttcaacttgttgaggcttcatagcaaaaactcatgaaagctactaatattacatcgaaactccctgcaattgcttgaaaaaatagtttgtctatcacttgaacgtgctatcacgtcaggaatgttcccggcaccatatcgcactgtaacggcattcttctccggtcgtgatagtaaagattaatactcttttcctttccgacaaaaatagagattgcggctcacgaactatggcaacaataggtgggtgcgtgtcatgttagatccaacatttacaacatcttccaacacttgcattgtccaggttttcagtagttggcgtcactattcaccttcaccaagaccaaacattatgccataatgcagagcacagctaagagatacttaggatgctaaggaacttaagtatgaagtatcaacaaccccaaaacatcatataattacccttctgttggaaaactgtaacccccactgtgatgcagttcactgccacttaaatggagatcataacaaaacctttgccaaatggtacattgttgaagtctcaatactttacaaaggaacacacgaggtgcagattctgctaaccacccatcatctcaccgttcgaagcccctcaggcagaaaatatcagcattcctttttgaaggaaaaaaaagctggagatggtcttcctacagaatcagtagacaagctggggctcgaattcagcgaaatcaacagagccagactcgattgggggcatgaggtacgcagcaatgatctcagacaccagagcggcaacgtgaggaatcctcttcaggttcttcaccagggggatatcgtcagactcgcctatggcaatgatctttttgttgatctccaccatcctgtctaacttcctcttgaattcagggttctcgacgtcaagaacagcggggaaaatccttgctgttgtgcggttggtctgccaaaaaaatgcacagattgtatcatcagtgtggtcatttcagtatacaaaaattaaaaacattctcctaagcatataagtaaagcataaaatggtctgcacccattgcataatgaaattgttttaatattcagcaattcttctgaaacagtctggactacagtaaagtagggcacataattaattttgtaaacaagaaaaggaagttgattttcttacctcaattatcacatgcatgtcgaattctttggtgtccagaccaatcccttcatagaatgtagtacgttggcaatcatttaggtacatggtcacatacacctgcaaaggatcacacacaaaaactgttagaagaggagcacagtaacaatcttcagtgtgaactgttggtccatgcaaacaacggaatagctcggagattaccgagaggcagaagaaccgtgaccagagcttggccttccagtcgttgaggaactgcggctgcgccttgagcagcgcggagaagaaatcaccgtgacggttctcatcctggcaccagttctcaaagtacttgaagatggggtacacctggtactccgggttcgccttgaggtgcctgaagatggtgatgtacctccagtacccaatcttctccgacaggtaggtcgcgtagaagatgaacttgggcttgaagaaggtgtacttcctagccttggtcaagaacccgaggtccagtgccaagttgaaatcagacagcc

SEQ ID NO: 60520 - DNA, 15582 bp, Oryza sativa
agtctgttagaattttatcttttttgttgttctccgtgtacgatgaatttaaaaatgggactttactgtagaagcaatactattgaaagcacatggataatttttttgataatcactagctcatatgtaccgtgtgtacatgtgagaacttgtgtaatacgttcccatcttttagagctataaatcgaaaatcatagacttggcttgcttgattcagtcatattttgcttatttaccaacaattacttaacatgtaggtgctcaaaatctttgcacaccttagtaagtctacgtgaattttaccatactttttgagccattgacgtgtggaatctaatttattgaaagaaaatcttaccataaccgcgacggcaacaaaacaaccttaatgttaacaaatcaaccattttccccgcgatgttcacgcattggtattcttccgtgcaaacaaaggaacaatctcaggtattcaagataaccatcagaaatgtgtacccaatttacacctacaatttttctgatttctccaacttgctttagagccaaaacgcccaaaaagaataatttaaatttgcaacaactagaggcatctggggacgtcataatcgttctgaatttacatggtggctcaccgccgtcggagtactctcacagtcctcgttgtgccaccggccggccatgaatgggtccggcgctgccggtgccgctccccgatccttgatatgcacgctgacatcgttcttctccatctcgtcgtagtccagcccccgcaagatcgccgggatgatgccgccgttgcggcccatctccaggtccaccttctccttcacgccgccggtgagatcggccccgttcctcggcggaagctgcccgctgacgtcgtccggctcctccagcggcggcggcgccacccatgaccggaagttgttcatcgacggcgggatcccagcgcagaacacctctgctatgttcgatatagcacccctgttatacgggttctccttcttgtcgtacctatatctgaagttctcgtacgttgtctgcagtagagaagcatcacatcagtgatcacaaatatttttttcagaacaaattttgtatcgatttcaagtaaatcaatcctagatcaggatttacttgaaatcaaaatgtgcaatttatgttcattaaaatctcgatcctagatcggaatcggaagtttcttttaaaaaatatattaaaaatggtaaataatcatagttctaggtaaggttacaatcataaaatcgtaaataatcatagattcaggccttcgatcgtaaagtcataaatggtacgatagaatcgagaatttgacaacctggtcactaagtagtgatgagcatgataattttgtcgcgaaattggacatctttgtgacaattcttgcgtgcattttcttcaggaaagaactcaacaaacaatttaacaacatggcttgatgcggcctacctggtttgtgctcatgaggtagaggtggaacacggtgaggccgccgacaaaccacaccgagacgaaggtgtacacgatcagcacgacggacaacggctcaccggccatggatttcagcagcgagccgtcgttgccgtccttatgcgccacgatgttcagccaggacaccacgaagacgtagacgcagaggagggtcgacgtcgagatgaacaggaagaagaaccggtaattccgctgcacaaaatgcgaaaacaatcctccgtctcatcaaatatatcatcattggtattttatcgagtggattatctacttggttgtagggattaatcaaatatttagaaaaataaatttaacaaatagtttaaaacaacgcagtagaagaagtttttttaagaaaacttatttttttcacgaacatgaaaaaagattacacatcaatatatcaaaagaaaaaagagtttagttacacaacacaaaacggctatattgccattattggagaataaagaaagaaaaaaccgaaaaaggagaagactgatactaaggaaaaaggctacttaaaaaggaaaaaaaatagcaaggaagggcagaggcagaggagcccactgtactttcagcaaacccccaaacttattttttaatgcttgaagtaaataattcgtttaagtaatccggtgaaatagctggaaacttgtttttcgaagcatgaagtaaataatttgtttcagtaattcaatatatcagcttaataatgtacagtactacatcagtaacagtatggtgctcaccagaccgatgcactggccgacccaggggcagtggtggtcgaacttgcggacgcagttgttgcagatggagcagtgggaggcacgtggcggcctgtacagcaggcacgtgtcgcagtacttcaccttcacgacgcacccgttcacgaccacgtccttgctgcgcggcagccggaggtgagggctcgccgccgtcacccactccgccgacggcgtcgtcacgtctccggcgaccccctcctcgtcgccgccgccgcacgactccggtggccgcgcgttcctcggcacgatccccgggtccctgctcgatgtcatcagcaggaatgccaaatcctgaactcgaaattgatccatgaaaggggaagaaaaaaacatgagctgttgtgttacaattattcagacaaaaaaaaagcatgagcagttgtgacagattattcagacaagaaaaaacacgagcagttgtgacagattattcagacaaataaacagctgtagttagtggtgatgattgctgaatttcagaatttgtgacttactgctaggccaagaacgatggtggcaatgaggacagggaggccaagaacttgtttctctgaactgatcgagttcatctttgtgatgcattggcagcataggcctaccagaggagccactatgagcacggtggacaggaacagagaacccgcatccggaccgaaaatcaggcgtccgccgcagagaaatttctgaaaaagaaaaaaatggagaaagcaaagctgtctgtcatctcaaagtgtaaacaaaaaaaatattgatctgaatttcacaaggattatcacaacaaaaattgcaggttgcaagaagattttcaaagagaagtaatggaaggaagagagaggcgagatgatcgtatcgtgtcgtacgttgcttccctgccagacttggtacaacctcctctggtttggctcccccatgaacaatctatctttctctcccttgaatcctgatcaacaccagcagtcgatcgccgccgccgccgcagcgcgcgtagcttcgtcccgtcctccggccgccggcgccgtcacaacgcggccatgaccgacgaagaggcaggtcagcttcctatctctttctcatcgccttcctgccatggccatggcttctccagctctctcgtgctctgttttttcttttttttttctttccgcgggaaagtgttggaaacgagacgaagctaggcttaacgaccgggctggctacctgccggctacacacccaacgtgcccgcctgcactggcgctgcgacagggtggatccatttggccggcgcgggtagattgtggcccacctgtcggtcggtgcactagcccgccttcacgttcaaatattctctcccacctagccaatcactcatcagagcttattatttcgccaaaaaaaaatctgattagagaaaattaacgagtttattaattttgtttcacagagaaaaactgcaatctcctttctgttttcaggaaatgtgatatcgtttactatgataatactatctttttttctttgctctgatccaaatcagacaattttagagagggctcggaaaaattaaattcgtcaaatattgcaaatgttgggagagcaggtcatggtctgcacgtacgtgacttagtctacaaaaataatcgaaacaaaattgaagcagagcccacggtagtacgtgccaacaactaacgtttaatcttttccattttttggagatcatgatcttgattttgatattggattgatgctttgggcagtactatctttgcccaattaatcctacaatttgcgggacttgcaggaccagatctaatttaaatatttaaacccttcacaaaattagtagtcgctcatatgtaaatgtttggtttccatgcttttagcccatgtgatttgagcttaatttggacacgggtggtgggcaattaggctgaagacaaacggccctagttttgatcgaagagatcaactgcaactaattaatcctctgtgggcaaaactttttgggataaattcaatcagtagcctccacttgtaatcttgtatagctcctgttgattacccaatcacctggcaagtggcaacaactggatgattctgtcgacatgattcgatataatgggtttcaagtttgttgatttttatctggtaggtttagagggttgtgcacttgtgctctaagattggtggaggttattatattagccttaggttgtccaaacttatgatagcagctactagcaattgtgaatggttaattaaaaatctgtaaatacactcaaaatctgaattattccttgcttttccaaaaaaaggaaggacactcaacaccatacttcgagatccaagactgaccctaaaaccatacactcacaaaaggcaagaaaaaaaatggaattcagcaatcaaaaataaaatgaaaatgaaaaaaaaaagagagagatagagagagagagagagagagagagagagacaccaatcagatgacattaaccgcgaacggcgtccggacggagtgcgcgccgtcggaccaggtgacggcgccgtgcacgtaccccttgctcgccccggcgccggcgccggcgccgccgctggcgatctcgaagctcacctggtacgccgccgtcgtccacctgctcgagaacacctttctctccggcgacaccttcacggcgaggccggggggcgcctcgacggccgcggcgtacgtcgcgttcggtggccccacgttcatggcgacgcgcgacacggtggccgtcctcccggcgaggagccgcggcacggagatggacgggtagttgacgcccgacgcgatgaggtccggcgacggcgcgccgcgcgggcacgcgaaggcggcgcccgcggcgccagcgccggcgagcttgcggacgagctgctccttgtagccgtagtagcagaggaagttgaggtagtcgcgcgtggtggtgtcgaacaccagcccggggctgagcgcccgcagcgggctgatctccccggcgcccatgtcgtgccccgtcgccgccgcgcccgtgctgctcgccaccgcctgcccgaggttgttcctcgtcgtcgctgccaaaatcaaaaccgatcgatcgatcaatcaatcggacacgcctctgctctcgtcgcgttcttgattcgatcggctacgtaccagtggtcatgagagctgatctgatcatggacggcgaccagcctgggtgcgccgacttgacgaaggcggcggcgccggcgacgtgcgggcaggccatcgacgtgccggacttgatggcgaacggcgacgggttcttgccggcgggcacgtcctccttgtcggcggtgggtatcgtcgcggcgaggatgctcacccccggcgccatcagatcaggctaaccaaaaaccaacacgcagtcaaaatggaagttaccgccatttatccttctagaattttaccaggtgatcattcatcctaattcaaaaagtactatcgacgaactcaacttccttaaaaataccgtcgtacaagtgtctttatccaaacatactatcatcgttaggttttcgttagcaaactccgtttaaatgctactataagaaagccattttacctcttacgcattgttgtacgctgacggaaagagcgagaatttcaatcagctttcaacgaattgtagggggtaaaatgttttttttttaccccaacgataccttgaggatggcttcggtgaggccgccggggccgcgcgccgagaagctggccaccaccggcgccggcttgtcgtccttggcgtcctcggttgggaggatcacagccgtcggattcctgcaccgggggcaacatcagccgtcggatcacgtaacaaaacatggttagttgatgacggcgactcacttggtggagttgatgtactcgaggatctgcgcgccggcgtcggtggcgacctgggagaaggggaagccgccggcgacgaaggggacggccttctcggcgtcgtcgatgagcaccaacccgctagcgccggcgccctcggcgaccagcttcttcacccgccgcgacaccatcgggtccgtgcccacgcacaccacgatcttccccgccgccttctgcgcgtccagcgacccggggtagcagttgctgcacagtgcatggtgtgatgagcgacgcagctcaactgctcggcgatttgcctccatgggaaagaaggttgctagtatagtctactactactaaccttgcctccgacaccggcgtgtaccggccggccacctgtggcccgaacaccagcgggtactggcctccggtgatgctctggttggagaagttgatggcaattccctgccattgacgaggagaagggattgaggtctcattcatggccaagaagtgaggcatggcgatggtatgattaccttgacgagggtgccgttgccgaggacgatggtggagtggaaggagcggtcgatgctggaggcggcgacggtgaggatccagggggcggagttgacgacggtgtaggggttggggccgtcgttgccgccggagcagacgacgaggacgcccctctggtgggcgtggaaggcgccgagcgcgatggggtcggcgaggaagtcggactggaaggcggagctcatgccgatggagatggacaccacgtccacgccgtcgcccacagcgtcgtcgatggccttgagcacggccgagctcgcgcacccgcccagcgagcacgccttgtacacggccacgcggctcgccggcgcgccgcccttcgccgcgccgcgggccaggccgtagtaccccgcgccgggcaccaccgcgcccgccgccgtcgacgccgtgtgcgtgccgtgccccacggcgtcccgcggcgagccgcctgtcgccgtcaccgcccccgccgccgacgacgacgacgccgagccgggctggctgccgtagtaccgcgcgccgatgagcttcttgttgcagctgctcttcttgaagtcagggccttccatgcacacgccgcgccaccgcgccggcaccggccccatcccggcgtcgctgaagctcgccgactccggccacacacctgtcgccgtccacagtaacagtagtgacatcacaccacaacgtcagagctctggacacacacgacgcaggccaatgtcacgtgccacgtgtcgctcaccggtgtcgacgatgccgatgatgacgtcgccggaggcgcggcggccgaggcggtcggagcggaggccggactgcacgtcgaggaagtcccacgaccgcgtcgtgtgcagctccagcgcgcgatccctgaacacggacacaaccctctcgtgccctgcaaaacaacaacaaaaaaagattcaccaccgtggcggcggcgcgatcacggcgatcgccgggaaaggaatcgatcaagaacaatggatcggatggtggttggcggtggccggaccggacagcgcggcggcctccgcctcggtgagctcggcggcgaagccctggaacgcgtggtggtagctctgcgtcagcgccgccgccgccctcccctgatcgtcgccggccggcgcgacggacgtcagcatctccatgtgcatcgcccgcgccgcctcctcctccacgccggcgccggcgccggcgccgccgccgccgccgcccatgtagacgacatacgactgcaacaaattccatccaacattgattggtcacaataaccactatgataaattgataactcatgcaaattatgcaattaacaatctgctccaactcttgcaggtgcaatctaatggtgatcaactgatcatggtcaaaatctacctctctggtctggtctggctcggctgagagaggtaccaggaggcggtaaacgaggacgaggatgacgaaatgtgcgcggttcaccatggatggaacttctcaaagatcactgagcttcagtgaagcaggttgcagtaaggacacacacaccacactagctagcttcccttcctactaatatatatatatggctaaatattttgctcgtgcaaaattcctctgaagtgcaagttctaagtaggagatgatatgatatgaaactcttcagaatggggcccaatttgtagctggaattctgccttgcttttctgatggctgcagaatcagattcatctgaactctgactggcctctttatgtacccttctatctcttttgatgattctttagtagctcctctctttccatgggagcatggcagatagaaacttctcatggtgatccgctagtcgccgttgttgtcgtcgtcgccgtcacctgaccagccacatggctggttgagatcaaaattaattctgcccaaatgattgttttctgacgagattgcttggctgcgaggaatggaatatgtgcggtctgacactgtctctacttggtggagatgaagccttgctttgctttgcttgcctttgccttttttttttcctcttgcacttaaattaggcttatcatttcattgatctcattctgaagctttagttagtgagcaattagcagtctgcatttggtgtcctacaattgcattgtttcttggttaatgatctgaatatctccaggtggttgctgatctgaaaggcaactagatgttagtactgaataaattactacaaggaaagtgatggatgatcacaaagttagttaagagtgtgtgctgtgttgttacctgttttaaccacacaaaattcttgtcaatagattgggaatcagagctaatcatgtcggtgcgttatgacaattgttgacaaagctgaggcaggctgtttttggtcacctggctgtcttcttttgagtgaagaattccatggagcacatatatcagcttgcctttagttagtgtcagtcgttttctggtagttgagctctcatctcaactctcaggcatcaccagaacacatttttttgcaacagatttgcttctttcttcttctgatcagtgccccttttctctctatctttctttcgttctttcatattgaatgcgattgtaatatccaaataacccaatagtgggatcgatcatcgacaaccgatgattgctttttaatggggctgaagatccaaggtgatgatcagatcatactgatcgtgatcaaagatgctaggagtaaagtgagaaagtaaacaagagatgtgagttatactgaccatcagtaccggcacatgagaaaaaagtgtcttcacagcacacaccgactgcttttgctccttcagaaggcagcgtgccaacggagtgttcttgcttgatatctatatttgctaccgatcaggccatgatcccggtgatcttgcaaagaagaaagcccgaattgtttgtcggtgcaaacggttgcagttcattcatccagacagaaaatctggctctcttccatccaaaattcagaccagctgttacctgaacaaatttgaaccatgagtcattcaagtccattttgtactaccatcttctttatagttctttcagcagaaaacatcaaaatatttataacaaaaactaaaaatggttagttactcttacacacacaccaaaaaaaaaactaataactgaaaaggagttttgtgaggttatgtggtgattgttccttccttgggcatcgaagcatcaagggccctaaagagagaagcgtgggggcagtagaacacatgcaggcaacaacaccatgtagccaagcaaggcaagcaaacaaagattctttccagcaacttaggaaactaggaatccatcttatgagactgtcagactgatgctgaaaaaggtcaaaaacatagtcagctacggccatgttcagttcctacgatagagagattacaaattttgtttccacaaaaaacatcgtggttaacatttcaagaacttgtgacggtacaccatcaagtcacaaagatggctcaagaaggctaaatttcagataaattttacaaccacatcaacaggaagggcatcagaaaaaaaatcgaaaatggcactcttcagattgttcacatcgtgcctgacaaagtggcaaacaacaaacaaacccgaatttgctccagttatttccttgtccaggttgatcctttgtgctttaatcaacatcaggtcagacgaaagagttgtgagaggccctaacaaaacacatcatggaagtgtatatacaggcaaatacctcacaaatatagagtgcagcacagcaaggcttcttgaaatttgctatgattttgagtttttgacaaacacagaaggcatcaaggtgcatatgatatttccactatgggaacacacattagatttagtggtacttctgtaggacagctaaagcctaaaggagaaaaaggagggacatgttagaagaaaatttgttcagtactgggctttgtgtgtttttaacggtgaccggtttatccattatctaaaaaatacaagatgaaatttcatcgggaaagaaataatcacattttgcaaacattgtgtttcatattttgaacagcaaaattcgctgggcatcagcttaggaaatacagagacggatgaacagaacatagaggtgtacagaagaacagcgaccgacatcactgctggttagacgttcttgagcttcttcatcttggatggtggccatctacctttcttcctcagccgcctcttctggacaagcctcctgcgccgctgcctcagcttcttggccagcttcatcttcgccctctgctccatgatcatcttctgcttagtttcgagcggcattgtctcaatcgaaaccgtgggttttggctcctctggttgatctgtgccagcttcttctgcgccagcctctgccgaggcatggacagaaactagcctcttcttggtgaaagaagcattcagagggctctgcgaggagagattcttgcactggagccttggggctgtagcatcagaaaggacaaatggcaagcctcaatgtgcatcattttagatatagaattcagagtacatgcatgctactttcaaaattttgatagaatctccgtcatataagaaacttgaaagctaataagtctagctcatgtgtgccacttcatggatagtatatagtacaataactagtaacaatcctagtgttctcaattacatattatgatgaatcttagcagagcacagatatgtaaaatctactcatctattaacaatcaggccccaaatgtagggtgtactacgaatgtcaccctttgccagtgaccggtgcttacatagcatctgatattatcatttaagcacgaaagaaccaaagcttcgagaatctgcagagttcactgagatgaattatacctagctttgtacagagatgataaatgcacggaatctcccacgaattactgcatctgcacacgacgtgtttgaagaaattccctaacgagccaaccgcatcccagagaatcagaaacgccacgaatcaccaacgtcaaatatctagaccaatcctcccaccgaattacaaatcacacctcacaacaatggatagcctcgtacccactcagcataatccaatccaagaaccaacaccccacaacccgagtaacttatgcgcaaaagtcccggtacggagaaggcgttcacggaggttaccggggatggtggaggcgacattggcggaggcggggagagctctggcgcgaggcggggaggcggaggaggaggcgaggaaggagacggtcggggagaggagcagcgccatggccacgggcagtgtgggattcggcttcttggcccgtcgtcagcctatccacccatcagcccggagggaggagataagcctgtgctgctgtgagcgctccgccgtccgatggagaatcaacggccagatttaatctccgtcaagtaaggctgcttggcagttggcccacatgtcataggtggagagaaattttgattttgattttctttttctcctctcgccgcctccgccgccgccgcgggtggcggcgacaatccgcatcggcggcgtcccctccgcccggccgcgctcgccgtcgcgtcctacgccgccgccggccgccacatcctgcgttcgacgtggatagcaagaggtgggggagctcgccgacgacaagaacctcccgttcgacggccaagcgggtgcccatcggtgatgagaagagcagctagcgacaacctcttcgtctcccactccaagccgaagcacgcgccggcgccgccgtgtaccgcatcaagaatgtctcctcctcgtcgtcgccgtcgccgtcgccgtcgccggcgtagagcagtttcagcatcgaggacgaggaggtgtctgtacaggagctgctgccaatggttgatccgggtcgtcagctctcgtgcgccattggggatggaagcttctgctccttcagctcgcggacacccatcaagattatggagcgtgcagagatcctccagccgagcgtagcttcgacatggacatcaatgctgccggagaggaggatgaggatgatgcacgagccatcgttgtatcagtgtcagagaagatttacagaatctacgacaagtctcgcaggctggctcgcagggttcaaatttccggttcgaccaaagttttttttattcttttgtgtgaatttagtaatatttattcaaatttgaccaaattttgttcgaaaattcaaataattctggaccaaatttcggtatatcagcaccccaatacaaatactgaaaacgaaaaattgaaccatgggctcgccaagcgccactgattgctacattgtttatctaagaaagctttgagtggggtcggagacgccttgcgacaacattggcaaactcctctttgtgggaacgacgacgacagttggagatggtacaaaagcgaaattctgggactttgcttggttgcaagggagaaggcttaaggaagttggcccctctggtctaagcgactttctggaagaaaaacagaactctacagtaggccaccaaatctggccaatggctactcgacatcaacctatcggcgattgcaactaggatgaccaaactaatcagtcagctcgtcactgtctggaatgcagtccaagaagtgcatctcgtagagggcgaggaagacacgaccacttggaagctaaccaaccatggtgagtatatggtggcatcagcctacaaagcgcaactcctaggcacaacaaagtcagaatttgataccctcatttggaagccatgggccccatgaaagagcaagattttgcatggttggtgatctataatagagtttggacatcgaatagattggtaacacgtgttggtaaaacatctacatatgccccctatgtcgttggacacaggagacgaccctccaccacttgacagaacgtagatatacaaagagaatttggagaaccatgttagggtggacgtcctgcgacaagctaatactcgtcttgtgggaaccaaccacgacgatgcagaaatggtggaaggcaatcgctaacacaaggggagtgccaaggcaggcgagcaccttggtgttgctagtctcctgggagatatagcaataaaggaaccaaaggatatttcaacacaaagaactatctgcaccggatatttcaacacaaagaactatttgcaccaagcctagtcagcaagattaaggaggaggccacaacatgggccgagaaggggctaggaattaagcttgttgtgtggctgccttagccatagcagaccttaagggccaaacatgtacttttacacatttttcttgttgtatagttttttttttctgctcaattcaatcaaatttagggatgaaaacgaagcggatacgaacagataatgctcataccatattcgttttcatattttttaccggacacgaaaacgaatacggatagctcgaatacagaaacaaatacggattatctcgaatacaaataagaatcgaatatgatcagacacgaatacagaaacaattttttctcggaacacgaaaaccaactcaacttctaatagaaacaaatatcaacatatataattagctcattttatataaaatgaagtataatttataaatattttttaagaaataaataatattaatagtatggactagtgttaagagataaactacaattaaaatctatttgaaggttatagagttagaaagaaatgcggtatgtctcatggcttctgtggatatccgaatagtactgttcaccggatatccgaattattatcagtatccgactgaaaccctgataccatagcgttattcgtatccgtatccgaactatccgatccgaaaggtatccgtatccgtttttgtccatagcggacggaaattatccgctccgttttcatccctaatcaaattgtcgctcttcaattcattaaaaaaaaggaactacaatatgcaatttatgaatatataaattgattgtttgttgccttatttggtactaacattatacgcctctatgcaattgcttctcattcttcaagtaccaatcaaatagttatagaaaaatcaacaaaaaaaattgatgacgtttatataatatatagactaacttgaaaaatttcaagtacaaattcatgcagtgagtcaaaataattaaattcaattatggatagtactaacacggctcatagccaaatttctttatgtttctttcttcttgttttttttttgcaagatgtgtatatttgaatttagtgtttcatgttggtgaagtgacataggccattgttgcaatccatgcatattaatgttcttttttaaaaaatatattccaacatgaatgagtttatttggtttctctttgattggatttatatttagcattaatgtagatacacctattatgtaaattcttttaactatatgattaatgtttaagtagtgaaaagttgagtcgctaaattgagctcctgatttcttttacctcgaaaggatatcttcttgtttcttatgtgccactcaaatagttcatagattgaggactgcgctacgcgcaggtggcaggagcctgtggcttgctccttgccggccagcgttcgactcccagactcgatgctcgtccctcatttttgggactcacttcggttggtcccaagtagataatagggtacacacatgcgtgcgtgttcagtgggtctgtgcgggaaacacacatgtgaggatttgtgcgggaaacgcacatgtgaggatttaggtcctcaaagtctacatttgcgtgtgttgacgcgcacgtgtgtgtgtgtgcatgtagtgttgcgttgtgtgagtgtggagtgagttcgtgtgtgcatcctcgttgtactctctcaaaaaaaaatagttcataggttcgt

SEQ ID NO: 60521 - DNA, 2004 bp, Oryza sativa
cactcgtcttgttacccgaccgcctcgcaatgctagcttaatgattttgccccgctttggcaagatattatgaccacatgttcttctttgttattcgtgagtgagttgctgcaatctattgtgatatgttttttccttttagctaggaaagcaacgctttcccatttctatatatcagaaatgacaactgtagcagatcctgacaaaaaaacaaactactactgaaaggctacttcctttacaccgagcttcacacgggggtaggaagtccttcaaggacatactacaacacgatagtcaaatcataataatacactcgacagatacaattctcaaaatagaagtagggtattacttttcatcgagaaggtttgaatctgtctaaactctaaaatcttgttcccatcaatccatctactctacgtgctcatgtgttgctcctttattattgctgatataaaacatcgacatctacaatctccaacttgtccttgatactagagctatcgtcacagtatatccaataggtgacagctctacgttgagaatggccggccgtgcagccgcgccggagcatctcgatccatgtctgtcttgcgatgatgccactgtgatttgcgttgccggtgtagtcacgctcatgcagctgtgtgttgctccccaccgtcatctgcctcactccaccgtagaagcctctaagcacacaccactggctattagtgcagatacaatagtagactataaaccagctattaacacatttttaagaagataaaataggagagagaaaagcagtgggctatggatttatagccagctatagcaccgattataagatgcatgtgtgtatgacaggtgggaccaactatgaattatatagtatacgttcatagataactattgtatgaaccggctattaaattgactatagatgatttagagctgatagttggctatactattaaacttgctcttagtgccagccgccacaccaactcaatcgtctcgttcgtcggaagtcgatttgtctattcccttatagttaacgacattaagtgtactactgaaagatgaattctctcgatattgcggttggacaggtgtaatacgagggacaaagtccttcctataagcctaggacggaagacgtcctagtacaaaattttcgttcgttccaactgttggaaatcgcctaatggttatgacctattgtcggaaactgtcggagcaagttagtgatgccccactagttgggcccatggttttgagaagataaatagttggggaatgcctgtttaagagaataatatccttgtctctataacattgttaggcataaacatgcaactatttcagaaattttccaaatcagtcctctaagcttttcttggcgcagggaccttactggctctaagttagtggcgtggaatcaccttctctcacgcatcgctaatattatattatctcacgaccaagatgagtttaaatggaatctaaccactgatgacagattctcggttaaatctctttatcttgcgttggtgcagaccgatgttcccaatataaacaaaagaatctggaagattaaagccccccctaaagattaagatcttcttatgatacttacgttgtggagtagtcttaacaaaagataatcttattaaaagaaattggagaggaaacaagtcttgttatttctgccacaaagatgaaactattaatcatttgttctttgattgtcgttttgcccgcgcagtttggtctttaatccagtttgcttcgaatattagtttacctaataatacaactcatatgtttgggcattgaataagaagacaaccacacaatttgagatctttggtcttattaggggcaactaccactatttggtctatttggttttgcagaaatgatgtggtttttgaaaggaaaaacatatcttctcctttgcaggttatctttttgattacacattggctccggtcatgggctatctttcagaag

SEQ ID NO: 60522 - DNA, 14249 bp, Oryza sativa
tgaataagacgagtggtcaaacagtgtaagtaaaaactcaaaatcccttatattatgggacgaagagagtattattggatggatggagtatatagttgctatatagttacaaccaataacttcataagtattgagccacatcatttagaaagaagagccattacatcatttccattcttaatcacaaccattcattttgtagctactattccacattaattagttagtatataaattagcattgagtgattcacttagtgtaaaatgttattgccataaagaagttacaccatcaccatctttgacaccattggataacacctttatagttcatatcagcatatatataatctttctcatatctatattttgaaattttgcagttgtattgcacacgccaatatctcgttgcaccatctgcatttcatttcaatgttgcgccatctaaatgcattgacgaatcatttctcagtctccaacatcgtctatcactttttgtttgctgaagtgtgttcctttgttgtgctttcatcgttggatgcatcagattcctttcttttacgtgttgccacttgccagctgaacgtgcaaatcagaaggtgatggcttgtcgcagggcctagcttcttgtttatggttgtgctcgtataagtatgttaccaaccatgtgttgggatcatcgttgttaggctcaacaatcttccttgccacgcaccccgtggactgcttctggttgcatctgtaccatgatctgaaatgttgccgtaaaatccagcttaactattgagtcttataacgtgaccatagaattctttgctagatgacatgcttataagatacaactctttgtttatctaataattattttattataaattaatttaataattttatttgatgaaaacactatcattagattaacatttgggtttacttttatatgatgatttgttgctataaacattatagaatataagaaatttaaagtcaaagattagttttagagggattgtgccaagtttgaccacgtcttattcagtgggctggagggagtataacatcaaccttatcaaaattttgtaacacattttggagataccaaattttggtaatattgtaggtgtttagtttgacgccattccataatttggtactacctctgtttcatattaagttgttttgacttttttctaaataaaatttcttcaggtttgagcaagtttttttttaaaaaatatagtaatatttttaacacaaaacaaagaaactataaaaaaaatatgttcaatgctagatgtaatgaaactaatttgatgctataaatgtttctatttttgtttataaacttggttaaactttcaataagtttgactttaaaaaatcaaaacgacttataatatgaaacgaagggagtagtgtttttttaagagtaaacttatgaaaatactaaagtttggtatgattgtattggtgagatcatgtttagtttgtatcataccagattttggtgagttgaaaatggcaataaagtgaacaagtatctgatcacaaaagcatgtttgttaggatgtgggcagttaacccaagttaacttttatcataatcctgttcagaacatagaataagaaaatgatgtaccatagctttattttacgcaaaataattaagttgttaagttatgtcttgctaaattttgaaagtccaaaaaaaactctcctttctgactgggcagtacatatacatttagagatatatgcatgttctcaccttttgtacttggagccaagtaaatccttttcactatactttctccaattccagccatcatctgtcgtagtcttcttaaggagatattttactgtgtatttgtccctgtatattaggaaaattaaaacaaagaacaataagaatccatatgcatcttttataggcacaattacaaataacaataagaatccatatgcatcttttatgccccaaacatggatggtacttgtagattcgccccagggttgattgcaattgtaaaaatgatgtgtcatgtatatctttctactccctccatcccaaaatataagaatctagtactgaatgtgacgtttcctagtataacgtatccaaacagactctttgtctagatacattatactagaaaatgtcctatttagttctagattcttatattttggaacagatatatagtattttgcaccaagaccaagggacacttttacggtacccttctattgcctctggcagtaggatagtaggaagtaaatgtaaccattgattgattaaggtagtaagggggtgtttggcagagaggggctaaacggagggacttatgttttcgacagagtgccttaacatcagtcccttgggagagacttatgtttttgagagaggggctaaaatttagccccactttagtccctccaaccaaacaccacataacaagggtattttcgataactatttcatttgaaaattagaaactctcgtcattatttttgccttgccctttgaccgatgttcgcgcgctgtggcttctcggattgggtgatgcgacgtcgggatgtcatcccgcacggcagtaaaaagccaccggcgttcgccccgatggctcgtcctctcatgtgcaggcagataattacaaacatggaatgcaagcaaacaccagaaccaaacctgctattgttaattggaagccctaacatgtagtattgttcaatcctttatatgttgaatcgaaatcatcaactatgtagaagtatcaattatcaaatcacggattaaaaatagtcaacagaaaaactacgacaatgcttccttctgagcaaccgattccaactagaaaaatcggacgcccgcagcacatacagatttttgtccccccaccctctccttttagttgcacatgtcatcacatcaatagtcaacatgcatacaacacatccccccacctctctcgtcaatctcactcttcgtaatttaacttaatagcaaagctttaaatattttttttatctaaactatgtatctgatatatgatccgattataccgttgtattcattgcaattaaatcttcgtaataagatctcatgattatattttgataaaaaaatatttttaaggtttttttgttctaatgctttttctaaatattgcaataagtagtttactatgtttcactaggtcatttagaatgttgcgtgtagtgctatttgattgtttcagcagttattttgtgatgatttaaatgatgtttcattaggtcatttggagtgttgcatgcagtgctctttgaatatttcagtaggtatatgtgtgatgttacaacaaatattttgttatgtttcagttgttattgtgtgatgtttcaacagttataactgttaaatttatttgcaataaaaatataatcatgtgatatttgttcaaagatttaatcacgacgaatttaacggtgcaatcaattcgcaaattggataactaatttgtgataaaaaatgatttacatattgaccgtcagtcatcagatgaaaacaaatgaatggttaatattcattatagggcactgtaaaattcccaatttacaagtaccatccaactttatggcacgtgagcaagtgtccataatgttcaggcttgtatgttcatattttgcatggagcgaataaaaattactgacaatttttttctggtctcatcattttgttactaggctacccttgataagtcgaccaaatatttatactgaatttaaaatatgcaaaattatatttctttacctttgaagcttttcccacatgagacagctttccagtgaactgcttccaaaacgaagtttggggcacctgacaacttttaaatttgaaatagacaacaaaggatcatctactgataataactcttttcaatcactgatttccagtttctgtaacattggcatttcaggacagaatctgacagacttgagcttctggaagctttcaatcttcagtgactttagtgatggcaattctgagtaagctggaagttgatcaccacagtgaaatgacaaatataatagcgaaatcagtggcggcaaattagttagttttgggcatctgctaatacagagatgggaaagtcgtgggaaatccccattgtttgttccattccagaattgcagagagtacatctcccacagattcagtatctccagtgatgggaatataggggcatgttttccttcagtagtcaaagggttacttctttgtccaaagctttctacagcatacattttatgtatgaggagatatttaagaaaaggcaggtcaccaagatgtgggatctcattacagtcttggcagtcatcgatagtaatcgagacaagcatggaaagtgaagaatcctgaatccagttggggaataaattcccagaataatttcgaatggagagctcctgcaggttagtgtttggctgaagattatgaaggacctgattagcaatttctttgtcactgtcatcttccatgtcctgactgctccaacaccattccagtgtcaaagctcctaggaattgcttacctactagatttgcttctttggcatcatcacttgcagtaatattctgaagacctgttatatgaacatgtccccttagtccactgagattcttcaggtccccaattgaacaatgtgataaatcatcccccgtattaaatactgttaatgtttgcagatcagttagttgcccgatcccatgaggcatgctaacatgaacatttcctggttccttttggacatcaaggtgccgcagctttgtcaaattcattgtgctttccggtaactcaatgagacagcaacaatacttgagttctaatgtctgaagggtttgtaactgacctatttcagctgggagactttggatctttgtattgttcagagccaagaattgcaagtgtttcatcttcataatagaactggggagctctcgtattgttgtacagctcaaattcaacgctcttaaaatctacatttcatgagaagatcattcagacccagtattttcaaaagtggcacaaatgaacctgggtactctgatgcagatctcttgacaaccatcagggactgcagatgtctttgtactttagtcagcacaactgacttggaatctggaagaacaactgaaaggtggcaaatattttctggaaggctgcaaaatgcttcccctgaactgaagcattcatcctttgagacggagcacgccaaatcatgaaataactcatgcataacaaacttatccttatgatcatcatcgcgagagggaccgttttgaaaaaatgatctgcagaacaactcattaaaatactgcagaccagtgtcttctggttgactgtcttcttcagggttgataaaaccttgagaaatccataactggacgaggtgatgcttgacaaaaacatagtttcttggaaataaggaacaaaatttgatgcactgtttcagacgtgatggcaaaagatcataacaaagtcttagtgctggtaagataccaccaccaacaccaagggaattgatttcaaacaaaagggaactgatttcaaacaaaccagtttctgaatgacataataacctagagctaattccctaattgataaatgcaattaataattggaattggcattgtgggatttttcttgggttccacatgtcacaattgattaataggatttttagtggaattttcagagccctataaataattttaacccatcaaaattcataaaccgcaatatttaaatcctagggaaattcctttttccttttctttttctttcccttctttttctttgttgggccgtcggcccaacctccctcccgcgcgccctctttgttgggccggcccgctcctcccttccccttcccgaagtcctccctccctccctctctccttcgggcgccgacaggtggggcccacctgtcggtcgtctcccacctccagccgttggagctggggctccaaccgccgccgccgaaaccgccgctcccacgtcgccgtccgcgtcgaccgcgcccactccacgtacacgcgccgcgcccacgtcgtcgcccgccgctcctccgcctttcccgctcgcgcgcgcgcccgcaaatcggcgggattcgatttgaatctcgtcccctctctctctctccactctcccacgtctccggccaaataggggccatcaccggccgtttccgcccctcccgtgtcctataaatcactcccccgagtcccctctccctttttccgcgctcgccgctctctcccgtgcctcatatcgtcgtcgcgctgctctcccgagctccgccgctcgccgccgtatttcagccgcgcaccgccgccgctagagccgttgctgcgcctagccgccgccgccgctagcttcgtcgtcacgtgggtcatctcgaccaccgcctcgcgttgccggaatcccaccggaaccctatctccctcgcgagcaggtgagatatccatccccctccgtctccggtcaacaatggtggccgccgtggtcacttaccccacccctaacccatctctgctccctcctagggtgccaccgccgcccgtccgcgcctccgcatcgccggttgtcgccgccgccttcttccttcgcgccggccgccgttctcgccagtgaggaatcccgctctcctccttcctttcctctttctctcccatgagcaccgctgcgatccgcgcgtgcgtcgtcgtcttcggccgtgcgccgccgctttcgcgccggttgccgccgcctcccgcggcgccgcttgccgtcgccggcggccgctcgccgccgccgctccccaaggccggccggtcggttttgtgccgagcagagccatgccaagccaccgcccgcgccgtccgatcggcctcccggccgatctggacagtcggtccagtggaccggcggtggaccacccgcgtggtcccggtccacggtggaccagccgcctcgtgccgctgacaggcgaggcccgcttgccggcgccgcgccccctcccttgatgacgtcagccctggggatttattgcgcaataattaattaaggccttttctttattagtaaaaacacagattatcttctaaaattcatatctaattcatcggaactccgtgtaagtccattcaagtctcagtaaattcataaaaatccctaaaatccattaaaaatggttttgtttcctgtttcagtagtcttatagcatgttttgcttgtgtgctttgtttgtcgcatagatctcggccgtttcgtcgatccgcggtttctcgaagacgttgctgaggtctcatcaatgcgagagcaaggcaagtcatgcattacaattgatcatattgtacccaatttacaaatatcccgcatttctattaaatgttgcattcttttacaatgtcatgtgggatgggtcctatcactcagccatttattgtttgccttatgccattgataacttgggtatcaaaataattagatgttggttttggaaatgcttagccatgcttagttcaactagtacacaaatggggatcacattattacatagactttgactattagcatagctttggactagtgccaccgcaatggtgttagttaattaaaatacactgaatggtgggctatgggtgcatggttttgctggtcgcacccatggcaattaaggaccggttcacgggaaaccctgggagacttaccgtgcttaccacaagtgggagtgggtaactgcttgatctgaagtatagctcgaccctttcctaggcaccggtggcgagggtgggcatgatggagttgggtcggccggggtgtccggttgtccagttgccggattcaccacggcacaagaggggaccgcccactgcctttttaggggtgggggtgaaaccttagcatggtgtggatggttaggggagggttatgcggagggtcttgtcacgatttccccctttgcagtattatggtgatacttcggggcatgtcgacatgtgtggaatcgtatcttgtgggtacagttgtacacctctggccagagtaaaactattcgaatagccgtgcccgcggttatgggcgatcacccagattcaccgtgattagtcttacccctagtttagcttaatgaactggtgtagttcaggtggttggttgggcctgttgcaacgtggtgtagcgttggacagtgattggttaatattgattaattactacaactgttttactgctttcaacttctgcttttaaatgctagctttgtgcaaatgaacccctagcctcctttggttatatcctacatcatacctcctcttccggtaagtcttgctgagtacagtgggtagtactcagccttgctctcttttcccccacaccagagttgaagttctttccagttggagctgtatcgaagaagttgatctcatcgctgccgtcaagggatgcctgtggagtggagtcgccccgctgcagaagtcaagcgtccaagtctagctcgttttatctttccgctgcatttgtaatcttttctatttttgtaagacgtggatctatatgtcaacaactgtcgtttgtgtaccctggctggtcctggacagggatttgatgcacattcagcttagaaattctggttcgtgaatttctgggcgtgacaagttggtatcagagccgaccttgaccgtagaacaagccaactggaaacctaagagccctctgaaccccttttcatctgcatatgctctttgtacttggatttgtttcgggaaaatttggggttttgcctctttggtttgcgggaaaaatcttggtcgttcattcggatcggatctttaaaattagctcagtctagggttttagaaaaaaatatttggagtttattcgacaatcagtcgggaatctattgggtgatatgcattaggtcgtgtctatgtttgatggggcatttttatgcgcatcattttccatgcatctgttttatgcattaagttattgtttagtcagttgcattagtgtcgttatctgggttcatgaaaaatgttctatgcataaaaatcagtcatgctcggttatttatttgagtcatttgttgctttgtttaatttggatttgagcatgaattggttcctatcccttgtccatctttagatgtcagacctgttcctcgatcgcaagcgccgctccaagcttcagagtcgccgcccttagctttatcgtcttcttagtgtgtttgcttgctagtttccgtgtttaggtttgttgcttgtgggttagtcggcggtcgatatcatgtgtcagtggtatgtctgccttaattaggagttgtttgcctctttttcagtgttttaatcaagattaagataattgcacgtaaatttataagaaagattagtttctaagccccctgttttcttccttttctcatatttctacctatccccctccagatggtgaagacaaggaatggttcccgtgaatccaacaacgccagtggcagcgaagagcatatcagtggagcatgtgccagcgatgcatctgacaacagtccatctccaccgcccgagaacccaacgatcgcttaggtgttggacaatcagactcagatgatgacgatgatgatgtaacagatgcaacaacagtaccatcaggtgttgcagcaggtgcagcagcaagcacaacagcagcagcagcagaacctgcagttttgtcttccaccactccagtctaagatgttagagtttctccgtgtcaagacaccgactttctcaagcaccaccaacccaatcgaggccaacgactagcttcatgctattgagaagaagctgaaccttttgcaatgcaacgaccaagagaatgttgcttttgctacacaccagctggaaggtcccgcttctgtttggcgggacaactatatggtgacccgtccagctgggacagaggttacctggtcagagttttgtcagagtttcaataaagcacaagttcctgagggaatcgtggcacaaaagaagagagagttccgttctccgcaacaaggaaccagagcagttatagagtatttgcatgagttcaaccgtctcgcgcgttatgcccctgaggacgtgcgcactgatgccgagaggcaggagaagtttttgtctggtcttgatgacgaattgaccaaccagttgatctgcagagattatgaggactttgagaagctggtggacaaagctatccgtcaggaagagcagtgcaacaaaatgaaccgtaagaggaaggcagctcagctcagaacttcccaggggatcagtcagaagccttgcttcacgatgggacatcagggtggaccttccacaatgattatccggcagcaccgtccctaccacccgggtagcttcaacaagaactacaacagtgagcagcacagcctcaaccctactccaagtcttctaatgattccagctcagtcatttcagccagctctgcctgctcagccagaacagcccaagaagtttggagaaaagcccgaactctgcttcaattgtaacgagtcaggatacatggtacgtacgtgcccgaagccaagacgtgccggactcaagttcgtttaggcctgtgtcaatcatgcatctgcagaggaggcgcagtcagcaccagagattatattgggtacattccccgtcaactcgacaccggcagtaatattgtttgattctggtgcaactcattccttcatttccaagcgttttgctggtgcacatgggttatctttagtgaagcttaagatacctatgcgagttcatactcctggaggtggcatgaccacaactcactattgcccatctgtgacagttgaaatccaagggttgatttttccagccaacctcattcttctcgagtccaaggaccttgatgttattcttggaatggattggttgacaaggcacagaggagtgattcattgcgttagccgcaccatcaagttgaccaatgcgaaaggagaagtggtaaccttccagtctccagtaccgcagaagccaggaatcagtctgaaccaggccactggtgaggtagcagtggagaaaacctctaagaagttggaggatattcccatagttagagagtatccagaggtttttccggatgatctgacaacaatgccaccaaaaagggatatcgagttctggattgacttggcacttggaactgcaccgatccacaagaggccttacagaatgggagccaacgagttggcggaagtcaagaagcaagttgatgagcagttacagaagggatacatccgcccgagcacgtcgccttggggtgctccggtaatctttgtggaaaagaaagacaaaactaagaggatgtgtgttgactaccgcgcactcaatgaggtcactattaagaacaagtatccgttgccaagaattgatgatctgtttgatcagttgaaaggagctactatgttctctaagatagacctacgatcaggctatcaccagttgagaatccgagaggaggacattccaaagacagcattcatcattcattatgggttgttcgaatgcacggttatgtctttcggactcactaacgcacctgccttcttcatgaatttgatgaacaaggtgtttatggaatttctggacaagtttgttatggttttcatcgatgacatactgatctactccaagtccaaggaagaacatgagcagcatcttcggctggtacttgaaaagttaaaggagcaccagctatatgccaagttcagcaagtgtgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgtcggttcattgagaacttctctaaaattgccaagccaatgacccagctattgaagaaggaagaaaagtttatctggtctgctgaatgtaataggagttttgaagaactcaaacgacggttggtgtctgcacccgttttaattttgccagatcagacgaaagacttccaggtctattgtgatgcatctcgccaagggttagggtgtgtggtgatgcaagatggcaaagtggttgcttatgcttcacgtcagttgcgtcctcatgaaggcaactacccgacccacgatctgaaattggccgcagttgttcatgctttaaagatctggcggcactatctcatcggtaaccgttgtgaggtatatacagatcacaaaagtctaaagtacatcttcacccaagctgatctgaatctccgacagcgaagatggttggagctaattaaagattatgatatgggaatacactattatcccggcaaggctaatgtggtagcagatgccttgagcaggaagagctactgcaacgtcgcatgggtagaggaactatgctgtgaggttcaacgtgatttggaacatctgaaccttggtatagttgagcacggatttgtggctgccctagtggcacagcccacactggtggagtaggttcgcatagctcaggcaagcgatcctgagatagcagaactcaaaaagaacatgagggttggaaaagcccgaggttttgttgaggatgaacaaggaacaatctgaatgggagaaagattgtgtgtacctgaaaacaaggagttaaaagacctgatagtgacagaagctcatcaaacccaatattcaatccatccctgcagtaccaaaatgtaccaagacctcaaagaaaaattctggtgggtcagcatgagaagggaaatagctgaattcgtcgcactctgtgatgtctgtcagcgagtaaaggcagaacaccaaaggccagcaggtttgctatagccccttcagattccataatggaagtgggaagaaattggaatggactttatcaccggtttgcctaggacgtcatcggggcacgattctatttgggtagtcgttgatcgagtcaccaaagtggctcacttcattccggtgcatactacctactcagggaagaagttagcagagctttatctggcaagaatcatgtgcttacatggtgtatctaagaagatcgtgtctgatcgaggaagccaattcacttcaaagttctggcagaaattgcaataagaattgggaacctgtctgaacttctgcacagcctaccatccgcaaactgatggccagactgagcgagttaatcaaatattggaggatatgttgagagcctgtgcgcttgactttggtggagcatgggacaaaagcttgccgtatgctgagttctcctacaacaacagttaccaggctagtctgcaaatggcactgtttgaagcattgtatggacggaggtgtcgtactctgctcttctgggatcagaccggggaacaccagttgtttggtacagaagttttaaatgaggcagaagagaaagtcagagctgtcagggaaagattgagaatcgcacaatctcgacagaatagctatgcagacaaccgccgaagggagctcgctttcgaagcaggggattatgtgtatctccgtgtcactccgctcaggggagtacaccactttcaaaccaaaggaaagttggcaccacgctttgtgggaccatatcggattttggaacgcaggggtgaagtttcttaccagcttgagccttccctccaacatgcttggcattcataatgtgtttcacgtctctcagttgaagaaatgtttgagagttcctgaggaacagacaagtccggatcacatcgaaattcaggaagatctgacctatgtggagaagccagtccgcatccttgagaccagcgagagaaggaccagaaacaaggtaatcagattctacaaagttcaatggagccaccactcagaagaagaggccacttgggaaagagaagatgagttgaaggccgcctatccgcacctcttcgccagctcttccgaatctcggggtcgagattccgtttaaggggggtaggttcgtcacgccctgaagtttccccctttttcttactttaaaaatttgttaaataaatcgtccggagaaattgttctaattaacctagagctaattccctaattgataaatgcaattaataattggaattggcattgtgggatttttcttgggttccacatgtcgcaattgattaataggatttttagtggaattttcagagccctata

SEQ ID NO: 60523 - DNA, 11902 bp, Oryza sativa
tgaagttcttcccagttggagctatctcgaagaagttggtctcgtcgctgccgtcaagggatgcctgtggagtggagtcggccgctgcagaagtcaagtgtccaagtctagctcgttttatctttccgctgcatttgtaatcttttctatttttgtaagacgtggatctgtatgtcaacaattgtcgtttgtgtaccctggctggtcctggacagggatttaatgcacatttagcttagaaattctggttcgtgagtttctgggcgtgacaatgatcttgtgctatattagttcatatgcatgtgggtgcatttggtgggcttgtctagccaagtgtggtgagttttctcaagtcccaaacaaagagagaagtgggcacatcttataggtttgggtagcctcatgtggttttgtccggtggagtatcctttggagtgtgagcccttttctcccttataaaagttgtgtttcttggatggattgttcatgtgttggataaccctttgactaagcttcccatagagtccaagaacgtcaaattccaagacctgagtcaagagatatcgccgttttactaacggtcggttgagctgaaaagtgacctgcggtctgactgcagcccttatagcggcctgaccgaggtatgctgtccggtctgactgcagcccccatggcggtctgactgttcatcctgatttagaaggaggcctcgtcttggcgatccagagccgccagagccgcaaccggtcataccgagcccctagcagtctgaccgggccgtggatggtctgaccggccactacactgcggtcagaccggccaggttgagtgggctcaatgattgccctgtaatggctagttaactagccattacaaagtagttcggcctgaccggccacactatggcggtctgaccagcggagcacagagttggggatttcgactccaacggctagttttggtggttcggggtatatatacccactccccagcagcaagggcaaagttttggcactccattgcattatcttgaacccttgcaagagctctcaaacccttgggcacttagtttatctagttaggtgttagagagtgagttaagccaatccaagtgcattgcttcattgttagagctagcatggcacttgatcatcctcggcaagcatcctagacttattacttttggaggttgccacctcctagacggcttgtggaggtgttgcttggtgacctctccgaggagattgtggaggaggcccggcaccggtgtgagtggtttggagttcaccaccttcggaacgaaggaagaattaccctagtgattgaggcttgggtagtcctctccgtgggccaactcccaccttgcccaccccttgacgaagggggcgtgcggtggcttcgtggttgagcggtggagttgggctcgcctgaagcatctaggcccccgttgttaattttggtaattaatgacaagcgctaattgtggactaaccgttgctattgagatatatattaagttaggttcacattatgtatgcgcatggatgtctactgatggattaaaattgacggcgcaaagcaaaaggaagagaagacggtaaactagtgttttcattttaaattgatcggggcgttgggcgatcaaaattgtgctagtttatttatagctttgttgtactattaagaggagtaatgacctagcaaagagatgattttaattgccacattaggtcattgcattttcacttgtgctcactttttcacaacatacacaacaccttgcattcactgagttcggcctgaccagggggcggtcagaccgaccacatagtggcggtctgaccggcgtgccctggccggtctaaccggccccaagcggacggtctgaccagcgcacaaggtcggtctgaccggcggcttatgggcggtctgaccagccccttggaggccgggatggtgttgctcggggatggctgatatagagccgacggagtcgtattcggtcagaccgagctgatggcggtctgaccgagccatggccggtttgaccggccactcaacgttggtctgaccggccaggccgatggggccctctgacagggctacaacggctagttttctagccgttgcagagtagcacggtctgaccgacaacatacctccggtcagaccggcagagcatagagttgggggatttcgcccccaacggctagttttggttggtgggagtataaatactccccctccagcagcaagggggctctcttggcacccaattcaattgcatacacccattgcacctctctcacacacctttgagcttagtgttcatccattgtagtgttgagggttgattagccaagagtcaagtgcattgcttcattgtagagctagtgtggcacttgatcatctccacaccgggtcatcgcttgttactcttgtaggttgccgcctcctagacggcttgtggagaagttgcccagtgacctctccgagaagattatggaggaggcccggcgccggttgtgagtgggttggagttcagcaccttcggagtgaaggaagaaccaccccgagtgatcgaggcttgggtagtcctctccatgggccggctcctgccttgcccaccccttgacgaagagggcgtgcggtggcttcgtggttgagcggtggaattgagctcacctcaacggggagtaggaaaccggcgagtttctgaacctcggtgaaaaatctcttgtctccttgtatcatttgattgtcgcatttacatttgtgcaatttacatttctaaagacatacttgagatcatatcaccctaggattgctaaacattgacataggagtgtgatttacttttctagagatataattgagccactatcaccctaggtttgcaaaacataacttagttgcttcgttagagttgaccatcaccgagcctagcaacttaggttggttttgattaggtgtaatttagttttaaatcgcctattcacccccctagtcgatatctcgatcctacatcgcctcaacggggattaggaaaccggcgagtttctgaatctcggtgaaaaattccttttctcttgtctcatttatttgttgcatttacatttgtgcaatttacattcatagagatatatttgagcttatatcaccgtaggtctgtaaaacttaacttaattgcttagttaaccttatatctcacattgcctagcaatttaggttagttttgtttaagtgccatttagttttaaattgcctattcaccccctctagtcgacatctcgatcctacacatccaaagcaaacgttgtttctactttttcagattgaccaaagcgcaggagcagagttttacatccctcttgcaatgctatacacacacaaaaaagaaacacagttcgctatcgttaattctttttttttctttgattgatgtgcccatcctacatcctgatatcagaaagggataatggatgtaatttcatttcctcatgaaatgcttcccgttataaaaaaaaccatctgatcaactatatgacatttatttacgatataatatctcaaatgcttagttaaagatatggtatgcgtacatttatcttggaaggtgctaccataatactatttccgtttcacaatgtaagactttctagtattgtccacattcatatagatgctaataaataaataaataaataaataaataaataaattaattaatatatatatatatatatatatatatatatatatatataatgtctagattcattaagatctatatgaatgtgggcaatgctaaaagtcttatattgtgaaacgtttcacaatgagctcattcaaataatagtataaaattaacgattaaaattctaaaattttcgatcatttattcaagatggaattcggttacgctgaacgttaaatattcgtggtcgaaaagggcgcgtacaaatccgagatcggtcacgcggcccagtatccacactgttaggaaacctccggcccacgaaggcccggcccggttacccactaattgggcccatcactaatatggaaagagagcatggcattgccctataaatagagggttggaggagagggttggaggagaggtctcgtacacttgagaatgcaatggatgaatgagaaaggatgtcacacccttatatcttgtgtctctacttgtgtagaattacgagatcctcttggactacttcgtgtagcaggagagttgcgtaatacgttatcagcacgacgttctaccggagaccgagaaggaaggagggtaagatctaatcgcgaaaacgaagtcctctcccacttctcatccatttttgcttttcccggagaaatccgcaacgccgacttgaagtcgccggtgaaaaccgttttgggatttttcggaattgttggccaagccgtgctcatttttcactgcgccacaccggccacggacgtcgcatcgcgctgaaacggcaagccggcgatcgcacgcgaagcctgagccaccgacgcacgaaccgccgtgcaccgacggcaccctgcaaggcgttgtagtacggcatactacgccactgtgccagggaggcgttggcaggagaggaagaaaaacaagaaaaatgaagaagaacaagaaaatgaaaaacgaagaagaggccatcgatggagacgacgtgccgtgctgggtttttcgagccgccgccgtgcgccgaccgcagcacggccacgcagccaggcaggaaggggaatagaaggaaagagagaagaaaaggaaagagaaggaggaaaaggaaagaagaaggaaaaatggaaagaattggtgattttgcacaaatgtccccgtgttttctgaaaatcatgcacatactcctctgcattggaaggtttgcattttaaacactgtattttccagaaaatacacaattaaccctcagcattgggctatttgtttgaatggccttcataatttgcaaatatctccaaaaatcatattttcgcacaaaagggaccacaggactctggacttcgaccctcaactttgcattccaggtacctttattactgacttatgtgattatgaaatttatttatcgcatttacgattattgattatttatgatgtttttattacttataattaatatcgttgcggtaaaattgtatagaatagcatagaatatattggaactatttgcgggaattttgtgtaccattatattgcaacacttgtgcattttaccagcgtttaatttgcgcatattgaataatggaagatgactggcatcgcgaattaaaaattcgctaaatctagaatatctctgacatatgcactcaatgtcgaaattatagtggaccttgcagctccattacataattaaacctagcgctttatttactgattcgacgagattgatcaagcacttcaatctctcgttggtgcctccaagctactctaggaatgagtatgctaaatggataagcgtgttggtactcttttgactgcacggaagaagcaacttacaagattatggcgcaaaccctatctctcgtagagcaaggactatgaacaagagtgggtatatttcgactatggttcactgagtagatgacccagagagtacggtaatacggtgcaccgaatttgcaccgaatactgcggaaactcttgatgttctacccgaacgcgacaaaagtcacacgcatgcatcactggtgcccatacgagaagtatgcctaactagttgataatagaattgcgtatcattcggcatagtgttcgtcagaagaacattgtcttcccaaatcacctagcacagttgataataaatttaacacgagcatctagcccggtgcacttacctcaatgaaagaagaggacaagggggagtagaacacatgtcaaggtgaacaatctaggaacatgaaaaggacaatcctaatagcacactcatcatgaattgagggggagaactcctagcctatttgcatggctatgaccgtagaatctcctatgctagataggatcggccgtaagatttatgccagaatagtaaagcattgccataggtgttgagcaagaaattcgctatgaagtaaattgaatccgatgtaccggaatacttcgttgaatcaatatacttcgtcatcacgtgttgcaattttttgaattgaacattgcatcaaagaaatggtccttgcccaagtagagcacacattttctctgcaataaagaattatttttagtataaaatagcatatttaaggcatttactattttatcactcctttctggcacatagttataatgctttcaattttgtgtagcgtccaaacataaaagaaaaatgaattgtggtccgcataaccacaaataacactttaagagaaagaggtatttccagacccatagaactggaaatattatgaccgttgctaacagcaacaactgaatttgtcgacctagaaagtgccatggtcatattacctatggaacaaatgatgcactttatagaagcatctattgttcgtcaaccccgttgaactttctaaaagtgtgatgatttgggctacaccttttagcaacggattttcaaccattccggtcttagaattataagaataaatattacaactcatatggtcatagcacatatatgcataattttcctaaatcatgaagatttgtgtgctagtatgcaccgataggagattaatgcataaacagcgtatagttctagcatccctgaactggattgcgaagaatatatgtggctcccatttggtactgtatggataaatgcgcttccgaagcagcaaacatccagtgtctcttagacaccgtgtctttgccaagactgattcaacaagatcacgtgaactccaatagaactcactaaatcatcttcagaagtccgcgaggacaatgctagcattgcatttgatgattggtgaattggtagcacgaagtaccaaatatccgcataagccgactaagtataagctatgaattgcaatatttactatatcattgttgtaatagccgcagtagaaaaggacatgtagtcttgaaagcagcggactctgaaagaaaactcagatcatcggcatgaacatccatcctgcgactagtgctattgcatctgtttggtttatgtgcatatctcactatcataatgcattgcaaaatgctctctccgaaagtcggaaaccttttacggagatagttatgaagctaaattccttgacaaataagaattattccagtcatttagggggagagaatgaacccctagataggaaatgtcaggaaatatgatagtagaaagggactaatgcatgttacaccgcactagtgaatgcagtttgcacaaagaattaaaactgccaaatcactttgtaaatacttttgtgactttgaagagtttgactaagttgcatgaatgcaccggaggagggtgaaataccgaagaaagtaaaggtatccctcatcttgtccagaggcctcgaacaaaaacaattggacaagaaacttcggctcctcacacccctaaagtaaccggagatgtctagtgaaaacagggcaagagggactatcatactcaaagtcacggaaagtaccccaccgaatagaggggagctagctgttggagtgcacactaacgctggtacatgcccatatcaagaagcattaagcaagaagaagaagaagaagaagaagaagaagaagaagaagaagaagcatatgaaaaatgcatctccttgtatatccatggatactcgcataaagaaattggcaatgagacctatcatcggcaatgtctcttttagacaacaaaactcattggcagtcaaccaggagttgaatggaattaatgaactagaagttgaaaagaactcaacctgaatattgataagcattgaagatagaatcaatggatgcatttcaggagcttggatcggacacttgcataatagtacatgaagaagtactaggttccgaaccaacatcaaaagaatagaataaatcataaaagaattgaagaaaagaaacttaatcgttttgaatttgagtttgatttgaaatatttggccgaatccaaatcatgcttacgcttgcaggtaaaggcatgcgacagatggaagtctagtacatcagtccaactgcacttagaaatgttcatggtgcatggcttttgaatagtcaattatcgtcaaaatgggatggaattcccaaacacaagtgtgtcatagcagcacatgaatatttggctaattgaactaaaccgaactaagcatcgttgaactgttcaaagcctcgatatggttttgagagatggttacccgcaacagcaatcgcgatttgaaaactatctcaacccccaccatttatgaaattaaagcagcatatatcacacatatgcaaatgagttatgtgagtagcaaactcactaagcatatgaacccccaagctcttctatgtacatgaattgcatagaagcgatgaactaagtcatgtgaaagtcttgcagattcatccgctaactcattattgacatcttcattgaataggtgtgtccgagaaatcggaataatgagacttagagaaatgcaaaatttagggggagaatttcgccgactcatttcagaatcttgatatagaaaatcaagtacccaaaatcaatctagaaagattgaacaaagaattgggtggattgtactctttttcccttgaataagttttcccagcagtttcttattaaggtttttaacgaggcaattcgtgcgacattgcaagtgtatgctatgtactctttctccaaatttttcccactgggtttttgtggagttttgatgaggcataggcatcacgcagcgagagcccaagggggagtgttaggaaaccgccggcccatgaaggcccggcccggttacccactaattgggcccatcactaatatggaaagtgggcaaggcattgctctataaatagagggttggaggagaggttttgtacacttgagaatgcaatggataaatgagaaaggatgccacaccctcatatcttgtgtctccacttgcgtagaattacgggaccctcttggactacttcatgtagcaggagggttgcgtaatacgttatcagcacgagagaaatactagtatgacttacattgtgaaacggaggaagtagattttataagctcattcaaatagtagtataaaattaacgattaaaattctaaaattttcgatcatttattcaagatggaattcggttacgctgaacgttaaatattcgtggtcggaaagggcgcgtacagttcctagatcggtcgcacggcccagtatccgcactacaaaggacaccagtgatccgaagtgtagcccacgaccacgatccaatgactactttagtgctctctacgctgccgccccaactctcagtgcatcccaccggcgaccacgtggaagtgaggaagagagatgcggcgagccaaggcgaaacaagaggatcttccatctgggtgacgatgcttccgacggcggcgacgaggaggacagctcgaacctgtgcttctacttccccgtgcaccactactccgacagcatcccccttcaccctatactgtacaaggtggatccccccatccctcgacaacgacgacgaccacgccgccgctactctttccaccgggtcgctgggctccttgatcgttggagttggatactgttccgatggttccggaggcgacgagaccatactgttcaacaccctagaccgagggagaaaattgcaattataggactccaaacaatgcgcttcgcagttataggaccccaatcgtcgacttcgctaaaacgacccttgaaacgttggcactttattttacatgacatttggtccttttaatcacttttctcaactaagatacatgtattttgccctaaagtgaccgtattgcccttctgccttctgtatacttgatcgatggtatcttttcatctcatccgactccgccgttgttcctccttccctccccacgccgccgttcctcctttcctcaccacgccgccgttcccttcccatcctcggctcccatggatagagtgtcgccgcccgaagatggagatggacgcccgatcgccatggaaggccaagcagtcgaagacctggcggcctctgccctagccgctcggggtctggtcacggcgcctggtggcctgggcgcgccggctgatgccttggctgtggcagccaatggccatgtatagtagaacgccaacgctagtgctgtagccgctgctagaacattgctgcccaatgctcctcttccagcaatggagttcaaccttcctgttcttcaagtgcaaatgtattggttgcactagatttctgttttttttaccacgatagtagtaggcagtagtaaaacttgatttcacttgtttaggtcccaagtagatcatgtggaaaatatggaaagagttgattggataacatacacatggtcgagacacatgatgatgaaggtcgtattgcacttatgagtcacagatttgtgagcttttaggtgtgatagaggaggacacaacaaatatacctgcacagggctttgattgtcgaatgtatgaacatgggcatgatagtgagcttgggcaaaataatgatggtgctgccattcctactagtgatgaggtaccgggtgagatgctcatttcatatgataagaacaacccatccatggctttaggaacaatgtacccaacaatggaggagttcaagttggcagtgcggcaatttgccattaaggaggagtttgatttaggagtagagaagtcatgtaagatgagatatagggcttattgcaagtccggtgatgaagattgcccttgcacttggaggataaatggcaccaaacaaaaaggccaaagcactgtggaggtaaataaatttattttttctttcattaattctactttttatgtaaattaacatgaatctctttgattttttgttttgcatgtaactgtcgtagtcgatgagcatacatgtgtgtctagcatgaggcagatagctacaactccaactctgaagtgggtagctagcaaggctgtgagtatccttagagatgatccaaatattggtgctaagagattgcaaaacaggttgcagacagatcacaagtgtgaaatttcatatgacactgtatggcggggtaaagaaagagctcttgaagaggtttatggcaaatgggaagagagtgttgagttgttgtttaggtggaaggccgaggtaatgaagcggtgccccgagagtgtcgtttaggtggatggtcaagtatatttccaccgttttttctgtgctcttaaaccatgcattgatggtttcttagaaggttgtaggcctcatttgagcatagatgctacaacacttaatggagggtggaatggtcacttggccgcagctgtagcagttgatggtcacaattggatgtatccactcgcttatggcttcatagcttctgaaacaacagacaactggcttccataagaaatattgcatacaggctacctgaaggcaggatacttccagctataatgcatcagctaaaggcaaatactagaggcttggggcatttgaaaattgtaccatgttctaattggagtgcagaggtgtgggacaagagcagcaacgttgagaggcatattgtcaagttacaccaaaggacctgtacatgtcttgaatggcagcacactggtaagccatgtcaacatgtattggcctatgtaacccgccaacggggagttaaccttgaacagtttgtgcataactactactcggtgaatagattcagggctgcttatggaagagagattgagccgatgacag

SEQ ID NO: 60524 - DNA, 1256 bp, Oryza sativa
tcaataggacagcaaaaaagaggtaaggactgattttatttatcaaaaaacttaaatgaaaatgccaatattaatttatttgattacttgtaggaagcgtaggcaacctaggaagaatgttacaaaagctgtggcagcagaacctaacactccacggaagccgactagagaagaaatcctacgggatagtcagaaatattaacatatttactgtatattaattttttccaaacatctaattgtcatatcctatttatgtgtagcaagcttgcgatgttactaggagaaggtatatcgtcacaaaccaacaccactagtcccgtgaggatacctaccgcggcggcaccaaaaaagatgactccaaagagaaagctatacattggttgaataattttagttgtgatgagatgtaaactcatactttatttcatatgacttagatttcgtttggaactaaattatggtcttctgagatgaacttgtttatgctagaatctcggttttatgagacaagcttgtttgtgcaaaattcatggttttatctattacttgtaattgagatctcgttgtaattgcgtatggatcatctttgatcatctttcatttattcattgggttagtgttgcaatttttgtgcatgattgaccatgtacagtacaattttggggcatatgcagctggcagctgcagcaagttcaagagcggctagcagcttaccagccatcccaggcgagccagtgctctagccatggacaggcggcggccggccagccatcccagtcccaggctgcggctagccagccagacgaccggctagcagcgtgggagcacgccaattgaagctgagggaaatacggtcacatcaaggtgaaatacatgtattttagtagggaaaagtgattaaaaggaccaaatgtcatgtaaaacaaagtgccaacattttaagggtcgttttagcgaagtcgtcaattggggtcctgtaactacgaagcttattgtttggagtcctataattgcaattttctcagaccgaggagctcatccgcgggctgacacactatgtcccattccgtccctgatttgaataggcaacatttaggctgtgtttagttcagcgcaaagtttagattttggttaaaattggagatgatgtgactgaaaagttgtgtgtgtatgacaggttaatgtgatggaaaagaactgaagtttggatccaaactttatatctaaacacagccttagtactctacaaactt

SEQ ID NO: 60525 - DNA, 865 bp, Oryza sativa
tttattagctttcaaagtttcaataaacaacggagcatttaatacctgtgtaatagtgttgtcaactgaagatggccattgttccaaactttcttttaccatttttctatatgcattccttgtcccaattgcctattactaacttactgtttgttaagttctaaataaaaagcatggttcaatattttcttaccacattcaaaatttgccataatgaccattccttcttatttagaactttgataataacgtagttatgtaaattagtctatgttgatcatgaaaataaaattgaactgtattatgtttgttttctgttggcatatcttcattgtgacattcggaatactcccggcattttgactaccaaatgatttggttggttgattgttacctgtgtattagatagtgttggctgcactcatttatgatcctttatcaagttctctgttattatcatagtaatattcaagctatgaatggacctctttgtgatcaagtgtggattcttgcattgttgtactttgcagttgtcagagcttctgagtattgagttttatggtgaatggattggtttagtagcagaattcacaactaaatccttgttgtcatggcaggtctgtttcccttttttttttttgactaattctcttagcactggattattcaataattaatttccaatagttctaactattgaatatttgtagtgggccagcaatagtgtctactatcttttgagcctttggtcaaggctggtgacatctgttccttacttgaaaagtgacacaccaagtatgcttgatgagactgttcccaaaatcacggagggttttatcacctctaaaaaaaattctgttcaggt

SEQ ID NO: 60526 - DNA, 1425 bp, Oryza sativa
ttttgctgtgtagtgctattgcttttattaatatggttattaagatctcaaatatattcattctaagttttatagcattgaagatgtaaagttctcattatatcgcaatgaaagtgaattgaatgttatgtatatcaattaagcagaggtaattacttgtgcctcaggaactggactgagtgattttagtgccaatcttctaatctaactgagaaccctgcatttacgcacttggtccagttagacaacgctgttatgacagaatatacaaattgatcagatcctagtatcttagcctgtctagaaagatttgtatattctgtcataacagcgctgtcatttttttatttgaaaatatacacagtaaaattaccaggagaaaacatgaaatgagtaccgccaacagtgggctccagagttctatcaggaaactttttctttggaacatgggatgctgctgttattttttatttttatgccagacattttcaaacatttttttaagagcattctccaacccctagaactgtactccagttgtgtttgaactttgcatattttttttcaacattttgtttgtagtctccttggcattttaccagcaggtaccctgcatgcgagcttagtttatttatttaggtgatctcctggcaatttttgcccactggtaacatgcgtacaggtttagtgctatgttttccaacaattgtgcttttactggcttgatcatagacaaataaacagcctagacaccattccaggtcttgcattgtcccacattgatttatggttaaccagatgattgagatattcttgtttcatccgtggaagcattcatactaggctctttctttatttcagctgtcaaaagcattctatggatatattgaagttctgttcagcagccatatcacttttgttctcaatttggatacaaacaccttcgtgcatattgtcagcactcttgaatctggcttaaaaggtctagatacagggatatcaacacaggtatacgacatgatgctttttactgcttgtaaaatgttccccgcttcttgttacaacagcatcggtgaatcactgcttaaactgtgtcctatcggggaagacatacttccaatctgtggttgctggtagataataattgatgccatcataatactctattctcttttatgtggtttcccttttagtttcttctcttggatctggatgtcatgtgcaacctggttagggcccacatagaagcagcagtcaacctctctaggcctgcagtactgtgcacatgaatagtaatgggaacaacatctgcctatggttactgtttaatcatttccatgttcttcgatacggggtatatcgtaaaggtttgggttgtagaggtttattaaggaagcaatacacacaagcttttagtctcttttt

SEQ ID NO: 60527 - DNA, 6175 bp, Oryza sativa
ctagtggatccccctcggcatattggagagttccccactttatttcctcaggtttgtgttaataatcttctctaccatatgcagaaaggtctggatgtaattacattttgttttttttctgtgacagatactgaagacgctttttgagatcatcatctttgaggatgcgggtaatcaatggagtcttagtaggccaatactgagtctgataatgatcagtgaacaggtgcttgtctttttaaaacttttaaatcatgttccttagcatttcttttgcactcttttttccagtttgtattgtctttgttttttttctttttttttttgcgagggtctttagatcttttctaatcagttgtttttctttgtgcagatgtttagtaatttgagagcacagatattagcatcacaggtcagtgaactctctggtctgatattccactatgcagtcctgtctttctagttttatttttgggttaattggatccatgccactgcaaatatgccaatttgaaaaaatgtcactactattcagcattcggctatgtgccactgaaaattggagaaactggaaccgttcacattttccgtcaaaaatccctgttagcccccaactgcacgtgggccccatctccctcccctctcttctctttccccttctctctccaccaccgtagatgcggtaggtgttgtcgccatcgtctcggagccggaagatttgcgattcaccctcaccgatctcgcgacgatgggtgatgtggccgcaccagctgcggcggcgcgggcggcgaggccgacgagcccgttgcgcccgcccaaggcgatccgcagcaccaagccaaggggctcgacgaggagaccgtcatggcaccattcgtcaagcaccttgtctcggagccggcctgctgggatgcgcctgcgtcgtcgtcgtcgttgtcgagcgcctcgtctcggagccggcgagccagactgcgcctgcatcgtcgtcgtctgctcccccggcaaggtccccggccaccgcccccgtgccggtcgtcaccccgcccaccgccgcatcgctgtggccaaccctcgctgccaccgccaccgacctcctcccggagcgctcgctttcatctccttcccccgtgccgctcgtccctccgcacttcaccatcggctccccggctgccgattcccctcagccgtcgccctcctgggctcgccggcgtccatggcggagaagctccccggctgctaattccctcgacgacggcggtgagggtgctgcgtccgccggcaaggacgacgaggaacggacgggtcgcggcggctgctggtggagcagcgagagatggagggggggggggatcactggctagctgcagtggcaaggaccagcgagttcgaggtggagtgctcgccggtgtccatggtggagaagtgaagaaaggaagagggagagagatgacggaggttgacagaaaactggatggaagtggcatggttccaatttccccaaattctagtggcacgtagccgatatgctcaatagtagtggcattttttcgaattggcatatttgcagtggcatggatccaattaacccttttttttcctctgcttgaagctttctagtgtcaagttatcaacaatgtttccagtcatcagcgtgcaggtgttaggagacaagtttcttttcagtaaaaatattaaattctactagtacatcttttgattagaactgtatgtccagcttgtgatgtacctaagttttgttaacatatgtctgccaataacagcattagtaatcattattgaagaactaatgtacgtcttgtttgcagcctgtagaccagcaacaacgcctttcgcaatgcttcgagaagctgatgtctgatgttgctaggaacttggaaccaaagaacagagataaattcactaaaaatcttacacattcaggcatgatttccgtgtgaagaacattcaggcatgacagctgttcaggaccagctaccagctttaaggtggtgcactcatgtgctgtaaatactttagcttagcttcgttttaggaaccaccattcccgtggggggaaagttatggtttaactcagtttggtttggattggctgaaagatgaagggttctcctgctgcacgtggtggcaaaatgcagttgttgatctcttaccttgtcgtgtactagactggcgagtgcaggagattcttcttcttcttcttcttcttcttcttcttcttcttcttcttcttcttcttcttctcttcttcttcttcttcttcttcttcttcttcttctctttttataccttagtgttaattccatctctttttgcttgtacagcaatattcatgtgaaagcctgtgatcgctgtttccctaagttgttagggcgaaagcagccatcgctcaaaatataattcatttgttaacaggttagaagaatagaaaaaaagttgtaaatggttgtgcttcctgttgctgtcaatgctcaaattggaagtgaggagacggtaaatttgctccttgagcttcaatacaggtttttattcagctaacgtctttttttgcggctctccatatttcggttcattatagccccggactaatgttgtgtacagcatttttcttttggaggtgctgtccagagttttggagctcgacggcgccttttgcctatggacctatggaaggcagttcttcagtcttgcccacggtatttgttgattaatcttgttctttagtcttcttcagagttcagattgtttagattgtctgattttccacttgctcttaagatgtattataggttaatatagctagttgggtttctgttctggtttccttggtttgacactattcaggttactattcttgattggtttcaaacttcccatatttcctgtaaaattcggtaccttacaacaagtatgaaagtacaaactattcatataaagtacgtcttaataattaattaaaataaaagcacagaatttttccagcactattgcttagctcactctttacatataattccatttaagaaaataccttctcaatactgcacttgtacaggaagaaccagtaaaaatctaaaacaagtaaacatctgaacaatggataaattggggattttaacgtctttgtgagtgtcactgtattggcacatcactccccagtttacgctctcactacaggccctatttagttcccacacaaaaattttatactctgtcacatcgaaccacatcgaacgtttgaatacccgtataaagtattaaatataggctaaaaaataactaatttgcatagattgcgactaatttgcgagatgaaacttttaagcctaattgctccatgatttgacaatgtggtgctacagtaaacatttgctaatgacatttgctaatgataaattaattaggcttaataaattcatctcgtggtttaccaacggattatgtaattatttttattagttcccgaacaccccatacgatatattatataatacccgatatgacgtgccaaaactttacacccctgatctaaacaccctcgtagacttcagcatacggtagttgtgcaatgggcctacagtgccggcgctgagtcctccatccttggggcattcaagccctgtgacacggaaaatttggctttgtatagttcgcgaaattaaaatttttgggtatcacatcggacgtttgaccgaatatcgaaaggggttttcggacacgaaagaaaaaactaatttcataacttgcctggaaaccgcgagataaatcttttgagcctaaaatctgtcattagcacatgtggattactgtagcacttatgtggctaatcatggactaattaggctcagaagattcgtctcgcgatttccccccaactgtacaattagtttttatttttatttatatttaatgctccattacatgtgtccaaagatttgatgtgacgtttttgagaaaaaaaaattttggggaagtaaaccgggccttaaataaaggggataacatataacacaagatatatacatgtacattgttgtcgtgttacatctaaattctaatgggaaagagaatataagcagacagtatcaaaaaaaaaaagagagaagaatctgcatctgcaacagttaaacccgatgcagaggtcgaaggatagaagtggcacaaacaacgatctgccaagcctgatggaggcaaccaaacacgccaaaatgtggcaaactgcacaatctgaccttaggaggcagaaaaaacatggcaaaaatagacaaaatgcggaatgtccccattagtgcttgagagtagctaccattggtcactagtcaggatgcaacgacaaacaacaatgcacttgaacatttaacaagcagatgctcatctgacaacgaggacaacatatcgatcctgaccgataataggtaggttactttggatatggaaggatgctgcttcacatctccttcatagagttaaagtggatccaacagtaagtccgacaagaaaaccgactgccaacatcgcctcagggtgtatttaattcataccaaaattgaaagtttggttgaaattagaacgatgtaatggaaaatttggaagtttgtgtgtgtaggaaagttttgatgtgatggaaaagtttgaagtttgaagaaaaagttggaaactaaacaagggctcagatttgccaacccgcttgctcgttgtcgctgtagcatttttccagcctatccaatatcccagcaaaagacctcttgcgagtccttcttcattagttgcgcatataaaatagagttccaaaaacaaaacaaaaaagagcacgacctcaatattttcattcaatctttataacataattgagaaagacatgacttatcatattgaattattagcaatgcgaacaaaaatatgcatacattaaatatattgtcacatcaaaatgtattaagcaaacgcaaacaaacaagtgcgagaggaataatgcttgtgttcatcccaaacaagtcgatatacttttgctaaacttttgtatgattaacaaaagtacagaacaaaactcagtttggaaatgaatacttctttaggagcgtatgttgaacaaactgcaagatcatttgctaacaaactctatgcagtcccccaattaagttgatttttcttaatgttgaagtcccatgttacatgttacattccctttgtcagtttggatgaaattttgacaactaaagcaataaggatcgcatccctatggtcagtgtacctccatttccactacaacttaattaatctattaagcaggaatcagaacatgccatgcccttattcggcttccaaaatctgcctcattccaagtcctctgcgtgggcaagccgaggtactcaaacacattgatatcttcactttgtgttggttcgaacgcattgatttacatgccggtgtcaaccaatctaagcccttcatttgtgaaccatcataatactataaatctggataggtagccaacataagtttcatatgtacgaatccaatgatcatagtacaaatccggactagaactaacacttgttatgaatccaacgattacactgcactatatatattatttagtgagtcgtgactttcgctatttactagttacatgcccatgcattataattagatctatagataaaaatataatttggttcatttctatatattttttatgatgtgttgtggatttttaacatttatttagatatatttttagaggatagtttttataacggtgaggaatcaactttttaggtaggaggacgaaagagcattataatttttttaaagtttttttaggggaaggaggatgaaagaaattgttaagagtaaaaagataatttttttttggaaatgtgaagagactgtgcttttaaaataattaatataaatatatatatttttatgttatcttatatagcttatatctaaatacaatatgtgagtaattatattttatttaatttattagttgagttcccgtacgatgtatcgggaaaaaaatatttggttattttccttcaattatttaatatatgatttaatcgcaatatcttttcaacttctaataaagataaaaaaactatcatatttttaagtatttgactataatccatttataattattgattga

SEQ ID NO: 60528 - DNA, 816 bp, Oryza sativa
tctttacattacatgagtcctttccccttcatcttcctttttctcctataaaagaagatggatttgatctcccgcgtgtgagaatacacacattttcatccatttgcacttctgttgctgctacaatgatcacatcccgacgagtgtgtgcacacgcgctgggagagcaggcctccggaacccccaccttccagatcttgcaccgagaagaggaagcgaatcaagtttttgggagagcattgtgcaactgctcgcttgtgcttgagtacgactacgtcgactacttcttcttcatcatggctgatgacaagaacaggaacaacgacgggaacaacaacagttctctttccgctaccgttgcaaccactgctccatcaccatgtgttattatcctcttctttcctttttctttattctgtttattacgcaaatgaattagacatgcttgtttatatgatttacacctatagcatatctattttgcatattcctatggttgagaataatatttctatggtttttgcttacattgtcatgatttgcaatctttatttttggattaaatattatggtgaattgcttatatttccaacatcaagtacatgtagatagagagataactagatgatacccctggcgtaatttatagtagtcaacttaaataaactggaagtggttaactgtttttaagtaggaaaaaaaagcagagaaatgctaaaagcacacagcataatccaaatggaattagttgaatgaatctaagtaatagtcaaactgtacattctactttaaataaaaagtaaagcactaacttta

SEQ ID NO: 60529 - DNA, 1613 bp, Oryza sativa
agcctcttctcttaatatgcagcctatattgtgcatgactctgattttaatttccatggacatttctagtaacaaatatcttaatttgcagtgacaaccttcttgctctgtagtaacacatctttttttctaccttttccatgcagataagaagagtggctagattttgacaataacaaaggttgtggttagagacggtgatgaaaatctggagatttcccttaatcgtactcaaacccaagtaactgaaccaaatcttctgttgtttttttatggaggaggatggaacacactttcggcaggaattcctctaccatcggttgaacaacaacaaaccgttattgcctgcgattcttgagaaatttaggccgtagattgacaccaagtagtattgtagttttctttttgccttcccactttgtatggaaaatacatgtactcagtggctcttagacagtaacaaacatttattttggcagtaacatatgatcaagtgttggcagtaacactagtagtacttgtacttggctctcagattatatttttgctagatcggtagtaacatgctgttcttttttttccttttttttggtttctctgatgcaacagatatgtgttttttagcggtaacagctatgtaatttcggtagtaacaagtatgtactttcgtagtaacatagtactgttggcagaaacagccgttctagcaagcttatctagcagttctggttttctgaatgcaaaacaaatgttatcagaatatatgtgtcacatttttctcagtcatatcggcagattttttctcagtcatatcggtagtaatattgttcttttgttctttttttcgatttctccgatgcaaaagatacgtgtttttttttttgcagtaacagctatgtatttttcggctgtaacaagtgtgtatttagctgtaacagctacgtaatttcggcagcaacaagtatgtatttttgatagcccacaaaagtagctttccgtagagtccaacgtgggctgaaagaatctagcagtaatgctgctaattatttgtagtaacttctatgtatgtctgacagtaacatacctgattttgtatttattttggtaccacaaatgtaacagtacgcccgtgtttataattaccaaggttgacgagaggacataatgacattgcagcaatcggcattacgtcgtgtatctattgttcacaacagcaatacaattttatattgttcttactttcctgcagtaacagattagtatttttgcagtaacatatatgtatcatggcagtaaacatactggtaacatgtcatttcaactggaatcatgataaaacattacaatatagcagtactagaagcatgttatatagcagtgatgtgctgccctaactgggcatcgtgatgaaggaaaacattttagcaaccaatatgcttaaagacagtcacagttatatactatggcagtaacatattacaaatgtcctacaagtcagaagcaatgtatctatcacttgtacacttattcttcttcctctttttcttcgtcataatcatctattgcttggcggttgattgttcttttggccttttgctttctactagggacat

SEQ ID NO: 60530 - DNA, 1347 bp, Oryza sativa
  unsure (1)..(1347): unsure at all n locations
ttcgtcaaacacctggccggggcgggagggggaagaagagttttgggggaggggaggtggtgggcgggtatatacatggtgggacggatggatgagataaggtggcgagagatgaggtgtaatctacggctatctaatgggggctcgccatgtgtaacagagtgcaatctaaccgctagctcatctccttcccttttcattattattattgcctccatttaaaatattatttcttttggtttcttttacaagttggaatagtgtttattgtttttctgggcaaaacaagttgttgtgtttgctggtttttttgagaatgctctttttgccccttttttttctttgtttaggagaaaatcttactgttttctttttgagcatatagcaattggatagcaattcttcaaagctcatctatggagagactatgggcccgatcgagagtgagggtgggggaataacccctctggcacggaaaacggagcaggccattagcacgtgattaattaagtattatctaattttttaagcaacttttatatataaacttttaacaaaaaaacacaccgtttaacagcttgggaagcgtgcgcgtgaaaaacgaggaaaaagggggcgtttgtccgtgggaacgagcgcaccctatatcaaaatcttgagaagttggcaagttgcgcaaacagcatatactaggactgttcgctgcgctgcatccatgtaacttgttcaagtgtgggtgtcttcaaggaatttggctaactgtggcacacttgtagttnnnnnnnnnnnnnnnnnnnnnnnnnntgaacaaccttattaccttattacagtaggtatacaatagcaagctataagtcagctataaatatattttaaggagataagagcaagtacaatagtgctattaggaaggctctaaaacttatcaatcatcctaaaacgagattaaggaaagaaaatcacatattgagaaagaagccggtgcttgcacagcgcctcacgctgtatcggctaggagatacaataaaaaaaattcgtttgtgggtcctaccgcttgttaattcgtttgaaccaatgtagcttataactaacttgtagttagtttattatataaattgctctttaagttagctctacctgagacatgacaaaattttagagcctactgctagctacactattgaccttgctctaagagcaagttaatagtatagccaactactagctccatatcacatacaatcaatttaatagccaattcatacaatagttacatactacactattaatatctggttccacctgtcatacacacactgcgtcttggagtccgtgctacagctggct

SEQ ID NO: 60531 - DNA, 1504 bp, Oryza sativa
attctaatcaaaagttcacaacatatataaacaaaaaaagcagtagctgactctggaaattattaaaacaaattgtcacctcaggggcagtagagaggaatttcccaccacatttcatgagaatatcaccctgacatattccagcaatatcagcgggtgatccctcagccacctaattgtcatttttttattcagttcatctcgtatatacattgagcagagaaacattaagatggcaactatagctaaaagaataacactgctataaacattctgaagaccataaaatttagataatgttaaaagtaataattaggagaaaaagttgacgaattagcagcatgtattaaaaaatgcacttgaatataagctagaatggatatgtaaagttgtatacagttactacattgaaaaaaatagcagacacaacatgttaagaagcttgttaaaaatctaagtttttggtacccaaagtataaacaaatgttatagagttctcatccaaatgttaatgagcctctaaacataatttacaaggaatgacaatatataaattttaaatacctattctggaagtccacaaatctagggcaaagtatcgcaaaaataaacataggatagaggaggttcacacatttgaaatatataggccattatcaacatccgagaattttctgtatatgtgctctagatgactaagcggaaccatttgaatagaggtgaaccagaatccaatccaaggtcgaattattcttctgtaaaaagtaaagaagaatattactataatgcagcagtaaacataaactaggcaattgtataataatgtatagaaattaacaatcaagtttttgaccttcacaggtaataaagtaaaaataatatcaggataaaatattcatcaccaatcaccataaggactggacctacccaaatatctggtgatgttccaagcatttgaaaacaattgccatcgaaagaaatggcgtttggttctcttcaaagaagttaatacctacaacatggccattataatttacaaggggtcccccggtgccagcctagaaaaaaggaatcacaataaattgtcaagatatgtacacgaatagcaagaggtaaaaaagggaaaagtccatgtaaaatgcatcaaagaacatgcaaaaacacgcagagtagaggaggtcaacaaaagaaacattttaaacaaaaatatggattgcacctccacgaaatattaagtgttcacacaatttgctcagttaataaagttgtgttaccctggccctaattatcaactaatctcagtagctgagtttgcttcagtagatcaattcagtattaattcttagtgtccaaagaaaaacaaaacaagctttgacaaagcaacaacaaaattatcctgtctgaatggagaataggtattcaatttgaacaagaggaaaagaacagtacagaaactagatcacactgttggatgatgctcacatggaaaaacactggtgcatcc

SEQ ID NO: 60532 - DNA, 12704 bp, Oryza sativa
acctttgaaaaagaaaaacattgcatacagaaacctttgacaaaatgatattcatctatggaacaatctagctataggatgtttggttttttaaaaaaaagatgtcaaaggatccactcaatcctactctctacttaacgagttgtttggtcttggaaatgccatgggtcaatcaccaaacatgcctcaaaaccagatgtgaaaaacaatgaattggtgggttgtcccaccaaaatcatgggatcatcctatgatcaagcaatctcatccaccagcacagaaatgatttgattcctcaaaacaaacatcacactagtaactgctggtaaaatgatcttaagagacacaggtcaatcatgcttagaaactattcacacagattgatgtgatggacgatgcttcaagttccaagtgtttcaactacttaaaagaagacgataattaaacattcacatagaccaacctgctctatgatggacacatcagcaaaaatgaaacctgaattgttcagtactgaaagacacagagaagcatataacatcatctcagtattgacagaatctataaattgagaacaaaaactatttcacagaataaaaccacagaaacagctgacaatttctgtttggctcttctatatgtgattaaattagttcaggtagtttttggatgccctatgcatattctgatgttcattcaagtttgcatacatgagttgtgtgaagattgtgtgtgctttagtagtaaaatctgaacagagaaggaattaaaagagtctcagttaatttgaatcagtagtttgcataaccaactaatgaattaagcaaggaaaaaaaggcatgtatcatatcggcaacaaagagcaaattgtgttcagatattatttaccattgttatctcgcaacttgatactaacagttctgaacactcaaatatgctggctctgttgcttatttctccccttgagcacatcagaagaccaccttcataagaacggccaagggctaaaacatctcccttgtcgataatatatttaaggataacagcctcttgaagcttgaaattggatgtgacttcaactaaggctatgttatgatggaaatctaccatggaaatctggcaaatagatatatccccactaggtagaaagacctccacctaagtaagtaataaaaaatcaggacaaaaataaattgtgggtggtaacatatttcaacaaaaaaggaagagtaaatttcataaacgccatgtctggggcccattggtaacaagaaaatagtgcaattttgtgatttttatcactaaaccacatgttttgtggcggttgtttcacaaaacccagggtccatcctagtcagctgttgcaacatattaggcccacctgcaggtgccacctcaatagccagcctggcaatctctggaaaggaaccacctggctggccaccactccacacctcccaccgcagtgccatttgctatcaacgacgattgctgtggctcagccttgccgccgcagtgttgtactgcctgttggttgacaacttcttcccctaaaccaccagcacaagctcaagctctgcttgtttgctttgttgatgatctttcctgtccgatgatggttaatgcttttcaagactcttgggagtgtggactcggggatgttaagaacaatgcctctgccaggccggaggactgcataattcaattggttttaacatctgttattccaaaggaaaatggtagtccagtttgagatggttcaattgcttttgctactgcttgattacacggtaaggatatgcatggttcatggcaggaggttgcaacgattgagctgggttctgtgattttgtgaaagactgcctcaaaatatgtggtggttatatgttaccagtgcccccaaacctggtattttgtgaaatttacaccccctccccacaaaaaaaatagaaaaaaagaaacttattacttaccctgacatcatctccgcatggaggtctaacaagtgctgctgaggttaatattgtaccaatgctggtactatcgttccaccgtatcacaaatcctgagcaaacccgtatcctttttcgacctgaattacataacaaagttagtggaggtctaagatgtatgttatgaagaggtttgtttctagaaacaaaaatacctgcaaaggaagataaactgacaattgactgtgaaacacccaaagcaacctttcgagcaacttggcttttagcactaccatcatcaatatcacaaaatgtatcctccagagtgagaattggaccctcagcctgaactccaactagaataaaacattattaccgttagttactcagacagaattagaatatcaatagctttacttgcatataattttcatgcacaaattgcattccagtagaaacatgagttcaattgtgcctccctctatacataaaaatatgcatatgcttccatggtacttgaaatcatgaaaagcttcaaaggcactgcaagtaatacatacagaaatgatcttccatgtctagcatataagcaagaaaatcctagcaatatattcatcgataagctgaaaatcctgaattagagaacatatagaacaataagaggagcaagctggttaatctgtctagccgatactccattatatgaagagtaaattaatttgacaaggcacattcatatgccccggtatttgtgcaagcaatgatttccctataggctttgttcatcaaaatccaaatttcttgggcattttatcacagtttttagtgatgactatatatctggagttcgacgacaaatcctaataacatttaaaagtagagcaggataggcagagatgtcatacatacttcgttcagcgattcggccccttctctctgcctcgacagcaagcatacggcgaatgtttatggccagctgagccctggcctccgccccagcggcggtggcggcgggctcctctgcagtggcgggggtggcggggggagggcgcggtctggtctccggctcggatgaggcgccctcctcctcctcctcctcctgctgcagcctcgtctcacgggcgacgacgcgccggcgcttcccccgccccggctcctcctcggcatgcgcctggggaggcggcgttgcttctcccgtgcgcagcgtcatctggggaggacgcggattctctggcgacgatttggaggcggcgaccggcggcggcgagcgtgagcacgcgttgttcggccggcgagagcagaaccgcggggtggcgatcggaattctggtcggaggacaggtcggtgcgtttgggctagtcgtaggcgtttcttttttttttctttttcttttttttttgacctttaaaccgtgtgctcagcgatatcacgagccacccagtcgcttacaaactctgggaggggtccaaccaatgaaccaaacagcagattgagctaaattatgaccacacacattacaagatcttggaataaaagaaatatcagccttgacaaactctaagggcctgtttatattataggcaaaataaattttatcaaattttagtaaaattgtcaaatatgtgcatctatttagtttttaaacaaactctggtaaatacataaaaaattctgccaaaacttagcaatattgccaaattgacaaaattttggtattgccaaaatttggtaaggttcattttagctacaatctgaacatgtcctaattggatgaggagctttattactcggaaaataggattgctcgcagctggctcatagtcctgcgtttttagcgccgctactagcattgccgaatcagattcgattccaatatcaactattcactgcactacaagggctcgcagtgcagcattcgtccagctccagcaagtatcaaggttcaccttaccgtttttggcgtggttaccgcacccccgcggttaccgcgaaaaccgcgtggtaaccacgagacaaaccataatttcaaaaactgaaatagttaccgtctatggtaaccgtgataaccgcatggttaccacgcggttttgtaaaccctagcaagtatacagcatccactatgatcacgtaccacaaaaccccatcctccatctttggttgcttccaggtaggaaccatcaaagttgagcttcagatttccctccagagctggtgaccagcttttgacagcatgactgccagtgttgctcttctctggccatagaaaataacaagggcattctgtttatttgatttgattttgaagtgattaattaagaaaagttgaaagaggcaagcgctgggctacatgcattggctattattgatttatggtgtgcatgcattagcaagtattagtatcattctacagcacaaggctgcaagtatgcagtctctattgtcttcttgctttgcccgctgtgtttttttagataatggattaaaccagcttctacactcaaagaatgtacacagcctgctttgcctgctgtgttgagggtacacttaactgaactgaggggattgataaacataggattactatagataaaatgatctttggaaccgagtgcctaggaaccccattctcaatgtagctccacccctgggggttctagcttgttcacccacatttatcttatttcggttatcccaccagttccagaggagcaagattatcttcaatttaatctgaccaccagtttcttttttctagttgaatccgtacaattcacaacaatattattactattcgggtgaaactgcttctacgttaatctatgctccctctatccgtgaatataagggattttactatataataaaaggatattatgtgattggacaaaaagtgatgagtgaaagaataaagtggtaataaaagttagggttaattagatccatgccattacaaatatgtcaatttagaaaaataccactacatttcgtctattcgtagtcgtgtcactaaaattttacaaaattgaaaccgtgccactgccgtcacgttttccatccatctcttcttttttgttcccatttgcttcttcctctttccttttcttcctttcactttctcccctctcatgcctagtgaagcccaggcctccactggagctcctcctcctcctccgacctctagcctcccttcaggcgctcctgcgcccgcccactcgctgaggacgagcagaggatgtgatgcgaggaggacaagcaagcaacggcggcgcgaggatggcaagtggactacggcgatgacgcgagcaggacggatgggctcccaccagcggcttgaggatggagagtggacggcagtggcggcgacgcatggaggacgaccggacgacgccaacgacgcgagaaggaccagcgaacactggacgacatgagggtgacgttgttaggtctcgaatctggccgacgatggagcttgagcaggtgacggaactctagagggatggcctcgacagatccatgcgggaaggctcgggaatagctacttcggcagcccacgaaggaactctggcgtagcgacctactccgatgggcgggcgtttgctcgtccgcgtcctcctcggtggacaggcgggcgagcaaaggagcgcttgaaggacgttgacttgctcggctggagtagtagttggtggcggctaggctttggagtgatactcgtaaagcggatgattagggtattggggtacgttggaacgaggatctatgtaatacgatatcaagcaaatagaagacagagattatactggttcaggctccttatcaggtaatagccctactccagtttatataggattgatgatggaaaaccacatattacaatagaagtagacgaaatcaatgataccgataagatcgtagtcgtggtattcgacgagatctcccggcgacttgacttcgtgtactccagcttcataagctatggtgggtgtgttggcgatgagattcgatgccttccacccctccctaggggtccttgttataccgtggatcatcttgatctccaagtaagactcggagacatcggatcttgtataatataacaaaaactctatcccctccgagcaggactttggaaatcgcttgattcgtagagatattttccataatttgtaacagattcctacggcgtacacgggaacaatctgtgtacgtgaaggtatgccatatccgtatatttcataagtcgtaggataggaggttgttaacaccaaaattttgtaaagcccgaagtcaccatagacctggagtcagtgtcagcttcagagtcctaggatcggccgatgagagttatcaagtcgccagttgtcgaattcttactatattcggttaagaaaattaatctattaaaggaaacttatctagaagtgaccgagttcaaggaggatacagcatgacaagttatctattaattaggaatagtttgttagtttccttttatctttgggaaagtgtgtttagtgtccaataagaactttatgttttccttttatctttaggaaagtttctttcttgttaaggactagtatctacccatgggtataaatatgtacacccagggtcattgtaagaatctctcgatcaatacaactactcggcgcatcgccaccctctttaccgtggtttttacttaccatccggtggaatttggcacctgatgcggggctgcatcggttcagttcgttctccggcgaaggggtaagtcctacgttccgccgaccctggtgaatctgtcggctgtattggtgttgttcaaggctgcatcgcttcgatcttttggatcactctagtttggttgatatatttgcctacctgatatcttagtgctatctctaattgcattgtgtttagagacgcatcggtttagttggaactgtcttggttaggtctgatcttctatcttagctgatatatttctacaatcacaatgctgttataaatagatttgttatatccatcacattagacagatctatcggctcatcaagtattagattaccacatataatgtcgtgctgcatcggttaggtccgacctactagattattgttgataatataaatcttgttaagccgataggttcatgctaatgttttatcaggttgctagccgataagttatctggacattgcatcggcttataaggattgcatatacatataagttggatttagccgatcgcaacaaaggtttcattgatctatctaatcttgtggattttatgacatcagacctccaaccgatgtatgctttaatcttcggatcgatgcttatctatcatatcattattagccaattggtttctactggattatattgttatattttattatatcagccgattgccttcatatcatcatctacattgaacatatagccgatagctcaaaaccctatcgacatcggctgatatcggcatcggctgggattactccatcggcttgtcagccgatcggctgtttgatctgttgtttacatattttgtcagttgcaggatgaaactgactggcacactcgcatcccaccaacctttggacctgcactggagctaaacagatatatgccagtgtgtgtttttcgcatcaacagatatatgccttatctgtaaccatgacagcggggggaatgagacgaccgtcgacgcggtgcagctcgggctcgggctccatggctatcgccccactcgtgctcgtgcggagcggatacgcgccctactcgccgatgcccttgccgaggagctcccctcccgcatcgccccttccccatccgccgtcatgccttcctcctcctcaaaggcaaactttggtggtgttctttttcttttaaagatgaagatgaaaatgaagattaagttttttacgcaaaacgaggtggtattaacgtatgattgattgagttttaattattacaaacttgaaaaatagattaatatgatattttagagcaactttcgtatacaaagttttcgcacgaaacgtaccgcttagcagtttaaaaagcgtgccacaaaaattttaatcttcatccaattcttgttggagaaaaaaaggaaccaaagccgttggtttcatcgggtctgtccgttgttcatcaaagcgctgcatggcttggtccacttcaagaactaattaacaactaattaactcatcataattagctctgctaaatcgcttaacgaccgattgattgatagtactccctctctcccaaattatctcctatatatttttttacacggtcttcaataatatattttgatcggtattttattttattctgatcccaataaatatgaaattagcatcacataaaagtatattaaaaatatgaatacagtgatataacatgcataatgttttgtctagatatagtaataattatcagtcaaaagttaccgagtttaattttccttaaagttaccgagtttaattttccttaaaagagggagtatagctagtcctatcttactataaagttataaagctatagcccactaattctaaaactcaatatgcagacatgccacctcatcatccattagcaataattaaatacaaaacttatgcaagtatacaacatcatttataattcattgaattctacaaatcaacatccaatcatcttccttcacattatttttcacaatatttaacacacacacatatatatccatcatttttgtaatatttaacatatatttatccatataatcaaagtgcgtgatatcatatttcatctataatcttatactgagcctactaaatttatctctcttaatattaatatagtttgacaaattagttttatttgttattaagaactaatataattttttacttttagctcgattattaatttttttaaaagtcacatagtaatttctacaacaaagcgcggagaatcacgtagtgaactaaatgtgccagtttgttctttaattattgacataaacaaatagctcttcttgtacaataaaatgtactgctaattattactacctatattttgtaagctaatcgatctcttgaacaccggtgacataattttgaatgtctcattttttataattaccctttctaactaactgttacgaaaatttaaaaccataagacaatgttttgacgatatatctaccaacatcatcttcacttcacagttcaaattatatatatatatatatatatatatatatatatatatattttacatctatcaataatctagggattctaaatttttttaatatttgattagacaagtgttgggacattatctattttgcagatcaatccatgttttcaggatagataatggttagctataggaagggtaattacagaaaatgtaaaaaaataaagacaatgcggatgaaaacagataaacaaaagttgatgacgtatagatgcaacggatagaccagatgaagccaacggtaaaatttgcctttagcctcaaaggcagttaggcagacgatgcagacccaccccgacctcccaagcgcacgcctccgatcctctcgccttagacctagccgccgccgccgccgccgcctccgccggaaagtgagccctccccccgtcgcgcacacacaccccctcccgattccggtgggcgcgcgcgggggagacaaccaaggtatacttgggctggcctcctccccccctcccgatcgctcccttcgggaaggtttggggtgggggaggccgacgccgtcatccgttccgggcgttggttgccgctggcgattcgccggcgggcggcgttgatcgggccccgggcgggggctccgggcgccttcgctgtgggggttttaggatcggaataccgtggaattgtcgtggattggttgctcgtggatggtgtgtgtgtgtgtgtgtggggtgggggggggggggttagggggatcttgcggtggcgctctgctcgtcggatctctcgacggtgttgggtttggtttgtggggcgctttggtggtgggtagacggtagcttggtttggttcgcgggttgttgttggatcttgtgcttgctgcctgatgtgcgtttgcgtgcctacatccttggaggggtggttgcgatagggcgatttcgctgtacggatgcttttgctgcgcaatcggattggtgattaggggtttggaactccgtgtgatgcttctgctgatgtgcatgcatgcggatagcatgtttatgttgtttttgcggtaggattgcgtgacaaatgtggcatgtattttcttcttacatgattgtcctttttcatcttgtcttcgcgtgctacacttccggcccagatgtaatataggtgcatgtttgcgcgcgctttagtatgaaacagcttaccaaatgtagcacgaagctttttgttactctcgaatgcttccgttacctgtgctgtaactgttgcatatgtttgtgttagtgctcatttaagcgtgttatgaactagaaatgcttagtcaattccaacaaaaagttcttcttagatgattattctgccattgtgctgctttagctgtcactgagtttggcatttccactcttgcagataactctacccaggctgagttgtggctggtattggcgatataagcttgttagctgttttctcttgtgtctttggtcttcatctttgattacgcgtcattgaaaagactgtacatgagaaaactcttttgttgaaacatttctcttgtaatatgaatgtattgagtttgtgactatccttctcctgtgctagaatcatatatttcagcttcaaagctcttgtggtacttttcaagtttcctgttgaaccgaatacctagtgcattaactctaagcttgtgacaaacattcatgcaaattcgtggatattaacattggatacttggtctactggaaaattggagctccttattcatgtcatcaatggagagcctagcacagttagagctgttatgtgaaaagctttacaattctagagactccgctgagcgagcacatgcagaaagcaccctcaagtgcttctcggagaacagtgactacatttcacagtgccaatatatattggacaatgcctcaacaccatatgccctgatgctggccagttcaagcttgttgaaccaagtcaacgaccgcagtctttcattgcaattgcgtcttgatatctgtaatgttccttaccaaaaatttatcatgaaatcagttgttcacctgtttttgcttttctattgcatctgcatggcatgttttcatttacgtctctaccaatttattcagttatgattatttctgcattgcaagttaccacagaaagcagtaagcactcgtttgtactgctatttagtataagtggccatatttaaatctttgttgttccttccttgactcaacttatttctgttgcctttgatgtcttatgcttatttaatatggctcgagttgaacaaacaaatatttattctttgcattctatccttgaattcatttatgcctctgcagcatgttagaatggccaaatatttatttccatttacccactgttgttttatgcatcggtaatgtagataaattgcaaaaatacatgtctataaacaatgcttaaatctattttgtgtacttttgtgcccttgtctactgctaattttaaaccaatatattgtgatctgtttgaagtgaattatgtcataaactatcttgctatgaggggacctaaactgcagacgtttgtgattaaatccctaattcagcttgtctgtcgaattacaaaatttggatggttcgatgatgataaattcagagatattgtcaaggaggcagctgatttcttatctcttgtaagtttgttgtctgttttgttggcatttagttgagagctttttaaccgttgataacatatttaaggactatgtaccttcgatttgagtggagctatacaccttggtacataaatccttggcaatttctatgaccaatgcccgttctttagaactaagtaatatgaaaaaggataaccggcctaccagataaatctacataagaacctgatttctattaaagaatccatatgaggaacagttataggttttattccatgctctattgcgagttaattgatgcatactaaagttgctgcttatgcttttcatttcaggcatcccaggatcattatttcataggattgaagatactatatcatcttgtaggagaaatgaaccaggtgccacctagaaacttctctattattataattgttcaataactattgattctaatcaataagataagggtacccataagataatgcaatttggcaatacgtagattaatttaaaagttgaaaaaaaaatatttcaacagtattttttttgtgtttagaactgcacaacgtgcatggtgttgttggcacttataaaacatcggatgaaacacagaaggtcaaacgtacatgaaacactacatatgcactaacttgtgcatgaatcaattaatatcataagtaaaagttgttctttattttcctttgcgacacttaacaaagagttataaacatgcagatagacatatataggcatagtattattgaaaaaatattaatggttaatccaaccaatgttaacaagacaaagttaaacattgacactgatggttactgtattaatttccatttattttaaagagtattggcggcaatatgatactccttcctttcctaaatgtt

SEQ ID NO: 60533 - DNA, 2266 bp, Oryza sativa
ttcctttgtcaggtggactgtaatgtgtttagctgactttttgtgtctgtgtatgcatgcaggctaacgctatgcctttgacacttcacagaaaaattgcttgttcgttcaaggaccagtttcttctacagatcttccacatttctttgacctcattacaccaactgaagagtgaaggtaaagttcaaggaccacattttgtaaaaagtagagtgtatcggaatgcccacactttctcacttccatcttctgatacaatctgtgattaagctgcagtacctgatgactttaggcgtgatcccctgtcgcttgcattaaggtgcttgtcatttgactttgttggttgtcctgtggatgaaagctctgaggaatttggtacagtgcaggtatgttagtttgcacaattgttatcttctctgtaaaaccattgacctatcccagttggtctatttcttataatttgtgtaatttttattgatgcagcttcctgcatcttggaggcctctccttcaagatccttctactgttcagatcttcttcgattactataaagtcaacgatacatgtgtttcaaaagaggtatacattgattgggtgatttgaataatatagatgatataatctctgattatttttaccgagtgctttgtccattactccataaacacaaaagaggtatattttgcttcatagttcctcatgtttagaatgtacactttgatcgcatgatttttcattaatacattttacaaacttattgctagttagctatcactacagttctgcaatattttgattgacttccattcagcagcaatatttttccaatgttgtcttttaaaagcatgacttcctcacctctgtgaagcagcaatattctcctaatgtatggatctctaagaggcatgctttattcctttcaagaatctctaagaagaaatattttccttgtgaatttatcttacaaacagctgtttcgtttttctttctatatgagtaatgtgccatgttcagtggatttgctctttccttgactcttccccgcctccctctcctatgcacttctttatgtcatttctgcaggctttggaatgtcttgtgagacttgcttctgtcaggcgcagtatttttgttgaggacccttcaaggacccagtttctttctcatctgatgtcaggcacaaaggagatactccaaactggccaaggtataacgctttgtcctttttttgccaagttctgttctattgtagtactcctgttacaaatttcagttacttggaccagcggtttcaattgcaatcctcttacatggagtgaaaagcctcttttatgtaaagtgaagaagcatttaaaacatgagttgattgactcatgcctagtcacgctatgtggtgcactgtagaaaccagacttgctttttataagtaaaagcacacattggttcattataaatgcaatagtaatctttaaacttaggtacttgtctgtcaaattagctccatgcaggaacaaaaataaatgctccatatctttacgtaatttattctgatgtgtgatctgctcatctgcaggtcttgctgatcatggaaattaccacgagttctgccgtcttcttggacggttcaaagtgaatttccaggttggaatcctgttacttaaaatgaaggatgaagctaacttttcttgtttgttttgtgtcaaggatttgctcttcgttctctctctttgcattcttttacagaattattgacttgctagtttttggtacgtaacaactgatgaattagttggcaacagtagtgatgcattaattctggttggtatcctgactgaaatgaattgcgatggtggggattttgtgggattccaaacacgccttactgatgttattttaccctgatttgtacttttgtactattgctttgaaggaacagtaataagtaaatccaatggtttgtagcttctagtcttttggctttactagcagcactaactagtcatactgatatgcagttcaaggttttaaatagtggattgcatttttatagtgcattggttttgatgtagagcatatcgtaatgatgcagtgcatgttgtagtgaacagttgatggaatagttaatttgtatcataattataattctacgaagtgaactattgtgtttatgatgtttttatgtatttttggtaatgtttgcaacttgcaagtgctatttttgttggcatcttcttttaattttttgccttacagacatttggtacca

SEQ ID NO: 60534 - DNA, 5120 bp, Oryza sativa
gagtgctcgtgtttcttgctgctcgatctttcttgcttgtttggatttggatgtgttgctgcttgatctgtctgcttgctgcccccttgacgaggaggggatgtgctcgctgcttgatgtgcgcgcggcggcgggcgaccgcccctagcccggatctggcagctgccccatgaagttgcatttatccccctagcgggttttggtgattaataataatagggttaagggactaatgagttttattgagtaatacttaggtgttttagtcccaagatggcattgtgtggtcaagagatgcttgggagacccccacaacatatattcgagcagaattggaactcgaggtgtgcatatgatagtttatttcttgtaatcgagttttaggaaaaaccgtactattaagaggggttccaggtgtggttctgggatacatcaagtgctcttagtgagatccaagtgtcaaaaattttttagagctatttttgagaatagccctatccaggacagatcaggacggccgaaagttccggtcctatggacccggaagttccggaccattgaagggtgaaaatttcctaagtgttgtccggaacttctggaggacaggaagttccgaacctgtttccagttcaaaaatgtgagtaacagctggatggcatcacctagccgtccccagttcactctttggccatttcacttttgcttttccattccatagccgttgctagcctctcccaagagtttatttgcttcctccacctgatcttgagccattcttgagagagagtgagattttgagggtgaaggagaagatttggagaaggtttgaaggttaggattggtgtgagcacttggggtatcttgtgggctgacatctcggtgcttattactcttggagataatctcctagacggttaggtgttgttcgcgagcttcctttcaattgtgcatgtcccgggaaagtttgtgaaggtattcctcacctccgcaaggaaacgaggtaagtgagtaaagaatcttgtgctgaagtcctagaggttttcctagtgtggtgtttttctagaagaaggttgggttggatcttagtggtcactcaaattctagaaaatgacctaaaggtgttggggttgaaggctgtggatttcctctgagatttttgcacaaatgaggcaaggggttaatcgagacccggctctttggagcacctcaacgaagagtaggatcgtgagatccgaacttcgggaaaaaaaatcctctttgtcccttctgtgatgaatctgtgcatgtgtctgtgatattgctacctctctgtttacctgtgattcatctcgtgaattttggctaagttcctgttagtgattcctgaatttgtctgttgcccggaagttccggtataagaacaccggaagttccgaactttttgagcagataggaagttctggtgttctacacctggaggttctgggcctgtagaattttaccgctgcgatttgtttttgagttttctggcaagcctattcaacccctcctctaggttacatctatgcatgttcacccccccccccccggatcgtgcgacaacgacagtgcgcggcccctccctcccctcccttcccttgccttgcagatccggtggaggggaggggcgtcttcagccggtgacgggagcgggcggcggatccggcgtcaggagcaggcgacgacgacggcagtggtggcagcggtctcccagcgtctggatccgttgccagcgaccgcgggggcgacggcggcggctggattacggttagggttttggttttttttctttttttttgtttcaattttttattttcccgtgcgggtgcctcacctgcacgaaaaaattgtgattttcgcagacgttgggttccagacgggtgaaaccaccgcacgcgaaaatgagtttccactgcacggaaaaatcgttattgtagtagtgcgtgtctggctaagtttttctctttgtaactctgcctcccaactaatattagatgggcatgaagccctacaaggacataaccacaaattgatcattagatcaatacaacacccgacgaattcaatccccaaatagaagtagagggcatgaacctgtctaaaccattgacctctttactcattcacttttagaccttgtacactacacccttttcttattgccggtctagaacaatggcatcctccatcctaaaatataaggcataaccaccacaaactcaaaaatgaagaaataatttaattaactagattgtatcacctcgatatatgcacgcaatgtgattagagggcttgatggtagaggattttaaataaaccaaatttagaggaggaagatacactaattaatatatgcatatgtgaacgcattgtattatgagatatgagaaaatgttcaatcttatattatatttttgggatagcgaaagtaataatccagcttggttcagactttccatgctcactgataaattatttatacatgagatgttgtatccagggatgaatctaggataagattggagagaaaactcacattcccctactcttcctcctctccctcttctccatttcctccctccttttataaatggtgaatccgaccatagatgatgttgatgaacgaacattggagttgatcaggtgttacgtaccacacacaccaaaaggccatatatagcgtccgtacgtaccgtacgtggatcggtgtgttcggtcggcatcaattgggagtgccgccgttccgttccgttggggttgcccgtgacgtgacgctgacgcaagcatgacgtcggccgtggacagtcaatcaatcagtcgcctcggtaagggtacgtacggagtagttactacatcctgttttctggagtaacagatgacgccgttaactttttctcacgtgtttaatcattcgtcttatttaaaaaatttatgtaattataacttattttgttatgagttgttttatcactcatagtactttaagtgtgatttatatcttatacatttgtataaaatttttaaataagacgaatggttaaatatataagaaaaaattaactgtgtcatttattaaaaaatagagagagtactacgtacggcctggaccgatcagccacccaacgaagccgtccccatcacgttctgtcgatcaacggccggccattgccatgcacatgcatgcagatcgacacaaccaacgacatgttgactgttcggtactatgctgctcctctatttgacttcctactcgcagactgttaaaaggtgactttgattggtgtattccctccgtcctaaaaaaatcaacatattaacataggatgtatttagttcacgctaaaattaaaagtttggttgaaattggaacgatgtgacggaaaagttggaagtttgtgtgtaggaaagttttgatgtgatgaaaaattagaaatttgaagaaaaagtttggaactaaactcggccatagggcatgtttagatcccaccaaaaattttacatcctttcacatcgaacgtttgaatacatgcatgaagtattaaatataggctaaaaaaactaattgcacagatcgcaactaatttgtgatactaatcttttatacctaatttctctatgatttaacaatgtggtgctacaccctatataatgacagaacggactctttaattagttttttatattagtgcccgggcacctcatacgataccctatataatatccgatgtgacacgctaaaactttacacccctgatgaacaccccctaatttttgctgttctagttatactaggccgagtttagttccaaacattttcttcaaactttcaatttttttatcacatcaaaactttcctacacacacaaacttttaacttttccgtcacatcattccaatttcaaccaaacttccaattttaacgtgaactaaacacaccctactcctacatgttttcaaaatataatatcgtagcagcttgccacgagtactcccagaatttttattatattcttcactgttactgtaggtcaggtacacacggaacactgtacatactccgcgtgctgcatgcatatgtgtacggccctatatatcgtcgattaatttattaatacatttaagcaactaataagttattaaattaacgaagtttatataataataagtacagacttcatagggctactcgtaatccgaatatccgatcagtcaacgttagcgtgtcgccaacccgtcgagtcaatcaatgacacatccacatgcctgcatggtcccacatacggttaattactaggataaatttaatctatatcattagggcaagtacaaaggtactacgttaattagagactatcacgttacaatagttaagacagtacagtctctaaccattaatgtaccaaaatattttcttactagccatttttcttttattagagcatgtacaaatgtgagtctaatatgagctctctatactaattatgtcactagagactatcctcctacaatagtagagacaatgagatttctaaaccattaatgcactaaatatttttttaattatacttctttccttttctccactctcatgcaacaaattttccattaataaatgctaagagttgactctacgccgttgtcatgcgtagcaaccatctttctctttccttcttcctctctcttccacgtcaccgaatatgcttgcatgacaataaagagagatcgctaataaatacattgtacataccctcacattttctatttcaaaagttcatcattactatttacgatataggtctaatgcttctgaaattttataaaattaaaactattccatcgtcatcgtattcttttctttcctccttccttccttatgttcccttctttttcttttttttctcttcattaattgtcaagcttagatagaaatgcaagcgaacagatccgcgaatttacttgtggttataaataaatggataacccggtgggtacgccgatctagctacccgcttctcacgctcgtgctcagcaaggatggggcgtgtgctcgagaacagcgacaacgaggtcgatggggactcaacgactatggtggtgttttt

SEQ ID NO: 60535 - DNA, 5280 bp, Oryza sativa
atgtggtgtttttctcctgaagatgaagataaagatgaatattaagtgttttacgcaaaacgatgtgatattaacgtatgattgattgagttttaattattacaaacttgaaaaatagattaatttgatattttagagcaattttcatatagaaagttttcgcacgaaatgtaccatttagcagtttaaaaattgtgccacaagtattcaaaattttatccaagttttgttggagatgaggtgcttgtgcgccacggccgcgcggatgaggaagacgacgaggaggctatggtgctccacacgtacgcatggcctcgaggacgatgactctgagagaacgctaagctgtgttctgttgtgaaaaatgatcactttgtacatatgtcccgattttttgagtaaatcgatcttgatgcatgacgtgaacgatgttgaagctagtacgttttctcgaggttgaacatactttactctttaatatttgtccttttatatatttagtgtattatatacttgaattacgcatatattaatgacttgaaaactatatttagatcatttataagtagcacgagcgttggtggtatctatctcgtaccaaagcaatattaattgacgatgggtttgcatgcctagaacacatggatatttatagtttgataacgtttattttaaggtgaatatggtttgtggtcatttgttatattactgttaggtactatggtcgttgtcacgtgttaagcatgcatgtgccaaataggcatcaattatttattttgtgttacatataaatgaccgggacatatcttggaatcctacgtatatacaagcttatggtacacactccattcacaccagctaacaaatgtcactaatttttttttaaaaaaaagtaaatataatagttgtgcatatataaagtatcaacttcaaatttattatattttagctataaaacaacaaaaaacctacagttttaagagtatatatgtgtaaggattttgtatttttaaaatataaaatataatgaattttaagatgatatgcatgtaggtataatactattagaagtaacgcatagttgtttgttttgaatttttagtgaaatttgttagttggtgtatacggagtgtgtactgtgaacttgtgcatataggatatgttgtctactcacctgatgtgtagagagaaaagcaaagctaaggtatataaatccctctgtccccaaactagtttatctttaacctctactatttatcctaaaataagtacattcctttatctatacgtgtgtgcagtccgcaaatcaattttactcgttcaataccccttagctacccatcaatactataattttctattaatcgaggatactttggtctttttactccacattaatttgtgttccaatggctaaagatgaatttatttgaggacagagatggtattaataatggtccaatttgtactcaattatgtacaaacatgtatatatacgtacaaaaaaagtccatttaattatcccctaaactatttcatttgaattaaccgctacaatattttttttcctaattttaccctaaactactaaaaatagttcactttagtactgaatattatttatcaccttttgtttctctttgtatcagtcctattttaagctaaaatttttaagacataaatgacaccctatcaaagttcccaaatatttctattgctatttactttaaatttaaaaccttgatatttagatcagcctatgtactttcaacatatgcaaacgacaataatagaaattctcaaaaatgttaagaggtatatgttataatgcatctactaacccatcaaatttcggagcataatatgacatatatatagacacagacaaaatattgttagggagtaagattgatcgtttttatatgaagtaagatggagtgctttttatagttgagggtgtgaaatgaaccaaaaaaatatttacgggttaaaagctcagcgaaatagttaggagtaaaatgaatttattttctagaattcctactttggcgcaaatgtgctagcaaccgaactggcgaacactttatccacttatccgttcactcgatcggttacccctccatctgattcccttggtttcgccccccaaccttgatgtttcgttccaccatagatgagatgccgctcctagctcccctcgacactaccaagcgaggttcatttcttcctcctcccccagcaccttgcacaccctgccccccttttcttcctcttgagcgattctaagttccccttcctgctcatccttggcgagacattgatggcgtcgaacggacctcggcacctcgctaccaacttccacacgacgcaacatgtgagccgccgctctcatagaccttatgtctcttcttctttggggagactcgattctcctttctcctcccagcgagatatcagtgttgtggggaaagctacgggaatgggatataagtgagctcccctcggttgaaaatttgagttttctaaatttggaagtttgttatgtaagttaaaacttttgaggttatgatttgaaacttttcaaaaattcggatataaagtttcagtatatagttgaaaatttctaaagtatgaattgaaagttttcgacgtcgagttgaaaatgttatgaattgtagattttatcgattgggttgaaaattttataccacaaatagaagaacttttgagaggttccgattgaaatttgagatttaggaggaaattgattaggagatgtattcttaatccaagttcaaatagggggagaaaggctgtgtttagatccaaactttcaacttttttcatcacatcaacctgtcatacacacgtaacttttcagtctcatcgtaccaattttaacccaaacttccaactttgaaagaaactaaacacagctaaagctaactagactgtattatgatagaatcagatagaagcgcaaacacgtttgtctagttcgccacgcacccctttggccctttcttttctgctatagtactacaactgaagaaacaaaagtatgaagctcagccgcagccgcgtcagcgtcatccgctgctactagtcaattgctatccgtcgaggtagagcggtggccgggtcgatctagtccgtccatccgtaagatccgacggttgcgaggaggcgaagaggtgtccgggcggcgaggtggaggccagcagcaggctaatccgcggctggggcgcgtgggtcccacctggcagcctccagccccccttgccatccgcacgaaggcgcagccaaactgtcgcaatcgcaaaatcgcaatcaatcgatcacgggatttctcggtgggccggtggggcccgcagcgggtcgagcctctgacaacgcggcttctcggtttgtcgcctgcctctctgactgacagactgacaggcgacagctgcttgacccaccccacgaccaccaccgccgccgcgagcccgcgactttcttcccttccccttgaagcaacaacaaccaggtgatcaaaccgtttcggtctgggtcgacgcccattgcacaatcaatttgtgttcacacttgcctgcctgacgcgtcccccatcgttactactcccattttgagtttttcttgtacgggttgaccactcgtttaattaaaaaagttagaattattattttttatttattttattattcaaagtatttaagcacaacttctcgttttttatatttacacaaattttttcaataagatgtatgttcaaacaatacaaataaaaactcaaaatctcttatattatgggacatagagagagtacagtccttttgatgatctggcggtgcacgttgctttttttttccttcttctcatggttgcttttatatgtatttttttataggataaaaagaatgaggtctgctagctaacatattgttctttctaaaataaacttttaacattccaaggataatatacctgactaggatcctacggtaatgactctgataatcgccgtgacaccaccagaatcctacgtgacatgacacacgggcattgactattttctttttttttctttttccccacctttctcttctcttctgccctctgcatcatgtgagcaaaaaaattggaaacaagagaagggaaataagaaacatcacactccctacgttgtttttctatggaatgaaaggattgtggcataacataatggtctattttggagaaaatgcaaattatggtgttattgaaagagctttagtactatgttccttgactaacaagtacggagggagagaattaaaaaggaacatgtacttaagctgtgttcggaactctgtgttcccaactcccccttcttgtttttcgtatgtttcaaactgctaaacggtgtatttttttacaaaaaatttctatacgaaagttgtttaaaaaaatcatattgatctttttttaaaaaatagtaaatatttaattaatcacgtgctaatgtatcgctctgttttccgtgcggaggagatttgttcccaacctaccgtaacgaacacaacgtagttgtcctaaaataaaacatgtagtagttgtggacttatataatataatattggctactattccctttgttttatattataatccaatttaactttttttttcaaagtcaatcttttaaagtttgatcaaatttataaataaaatataataatatccctaacacaaaacaaacatgtttatcaaactataaccaatgtcacatttaataaaactaatctcctattatagatgttactaatatttctctattaacttaaaccaaatttagaggagtttttttttgcggttatatagttctaatggaacatatattatttgttgaatttttttactagtagtacatgattaacaatgtaaccagcgtggcatggcttgggccgcaagaagagttgactgcccagttgaccgacacatgccacagttgtactcccaccttgtgttgtgtgctcaggtaaaaataaataaaacggcgtggcttcctgtgcaaggagaggaggaggaggagcacagggcacatgcggatgcggcgatgtggcagccaagagggaggatagctgggtcccacggtagtaacggccggcttcaccagcagccagcagccagcagccgcccagaggcatatgcgtgcgtggcaccgcgcggcactccacgcggtttctctccagctctccttcacactccacacgccgcgcatgacaacccgcgccacgc

SEQ ID NO: 60536 - DNA, 1275 bp, Oryza sativa
aactaatagaatgatacaacaacagtagatgcatcaaatttaagttgcattatgctattcattttttatcgtatttaattatacgattctaaaacaagaataaccagagtaattttttggccaacttaagtgctttgttgagttgttcaacttcatattctggacgggtgcagaaaatatagtaaataagataaaaaatttgacaaatttagaaatgctattggatggatcaaaaggaaagataccagtttctctctgcatttttcttttttgggcggttgggggggggggggtcaatggctgtgatcagatgctcatgttccagtataacagtagctatttgttttgttatggcaaactggctgattgaaattttctaagcacttcatgtggtcgtcagcccttcccgatgacatggtcaagaataaaggcaactgtggatagacatgcaacttagcagttttgagccttcgcaagtgttgtgtacacatcctatgtttattatgtatgttagcttgccaacatgtgagtttagctatctacattgtgcctctcaaacagatgaagatctcttattaccatttctgctgttttcagctaatttattacgccacttcattatatatatctgttatttttgtccggatggaatttttatataattattttgagtcactactaacctccttgccagttaccaatagtacgaagaagctagatgaaatgcccttattgttcttaggcctttttttttttgatagggagttgcattatatgacatggccataacatgattttcttttgctgatttgcagtaccaaaacagtagcatttacatcataaatattatggagcctcttctacaagcttatacggtatgttagtgttatttcacagtcctcttttttgggcagaaagaatgccttttcaaagccaaatactttttacaggaaaggtcaagattaccagctcctggagatgcgaatgagctctctgtcattgaaggacagctcacatggctagtccacataattgaagccattctcaagattaggcagaccattggttgtaggtgagaaattaacattccttgcttccttatattctgtttgatttcctttttttttcacctacaatgctcattttttcatgcagccaagaatcacaggagttaattgatgcagaacttgcagcccgtgtgttacagttgataaacgttactgacacgggggtgcacgcacaggttagatgaaaatgatttggtcatctaacatc

SEQ ID NO: 60537 - DNA, 1827 bp, Oryza sativa
atatgctgtggctgatcctttgtgtggttacagtgcgaggatgttattgatcatactctgtccctcttccttgaacttgcatctgggtaaagttgtagctatatgtattcactttacatgtctcatgcttattatggtaacaattcttcatatgtattttcgtagcagctatatgactggaaaactgcttctcaagctggagagtacaaaatttataattgcaaatcattctgtacagtcttctcactagcttctgtttcatgttatccctgtgccattcctggtcttagaagtgattctattttcattattaatcttttcagagggattcttttccatttcttgaagaatacagatgtgcccgcagtagaacaacattctactacatccttggctgcttggttttcatggaagacaccccagtaaaattcaggagtttcatggagcctctcctacaagtgcattgctacttatattcataatctctccgccccagaatgtagctatatctggacctgtacagatcgtaggtagaaatagctacattttggggtgtaggaagtactagttaagttttttctccattcttatatggttttcttcttcgtattctccataggttgcagttaatttggaggcaaccgctgatgctgctttctggactgatgttgtgaagtacgcatttattggtttgatgagagacttacgaggcattgctatggccacaaacaggtgcacaatttgattatatgtggtatatatgtgcatcaactcactaactactttgttgatctgatccagccgcaggacctatggcctcctatttgactggctatatccatctcgcatgccacttttactgaaagccatctcactctgtgctgatgagccggaggtaactaccaaatcgcaatgctttccttgcgtagctgttctttttgaaaaagtttgaactgtttttagaaaatatctagagccatatgcttctaaatcttttgctcagctactgcaaaatcaccactttgtgttcatgcaggtcaccacacccctactcaagtttatgtgcgagtttgttttgaacaaagctcagagattgacatttgattcatcatcaccaaatgggatccttttattccaggaggttagcaagctgattgtggcttatggatcacgtattctgttgcttccaaacggcactgatatttatggaagtaaatacaaaggcatatggatatcacttgctgttctttcaagaggtgagttcagaaaatatgttttgaaaacacctgtatgctctgcaattttattacagtttcagtaaagtctacctgctgttattcactgttttctaatgcttgatttttttagtggatttcatcctttccaattttatgtgcgactctcattgcacaatttttttgtttgaaaaagtgtgctttaggttacacttttgctgtgaaatgttatttgaattccaacatgtctctacgaaatttcaagaccaaaaccttgtttttgcaccccattgagatcattgttttccaacagacaatattaacttatccccatgggccatattacctggactgtgaaagcttgttcatttctgttaatcatttaactccttactgatttgtgatatttgagttgaattgtagcctcataggccctggcagatgataaatatttcaattgcataagatttgcagtagttgagaatgggtttatgatgattttggctaaactgaaatttaactgcaactatggttaaattctgttgcaaatatggcagactttctataccttttcagtttcatgtgtggtatg

SEQ ID NO: 60538 - DNA, 712 bp, Oryza sativa
ttcactctctgctgggtgagtaactttttctttctgctttcattgttgcacctctctgattcaagcccatccttgtggtatgtcatgtgtgttgcagtgcctcgtgacatgtagagcctctgtaggcgtggaatgattgggaggtagcgaagcaccttctgtggagtgcccttcttattctcagggagttctaacccttcaatataacgaggcccattacatgttatacatttccttttgttagcatgctccttatagtataacatgcaatcattcttacaaacatcaatcttttggacaggcatacctaaagcttcgacgactttcttgcatttgtaaaaactacatggcaaatttgcatctggaggcaacatttctttcataaccttgaccagctcatcaaagcaagctacagacatattatggtctgattttattgtcaacaaccgagagactgcagataattgagagtgttttccacacttctcccacaatggcttgtctgctgcatctaacatatcaaaaaatgaagctgcttcaacatttggaggctcttcaatattttgacaaaaattaggccctacggcatccaacaccatctcatctatatgatctgactctccataggcattacctccttcattcatctcattgtcaatactgccttctggtgtctcactggtatcagctccactttcaccatgtctactcc

SEQ ID NO: 60539 - DNA, 1165 bp, Oryza sativa
tataacgatcgttgctaagggagtagagccaccagtaatgacataagtgtggtaggcgtgtacaataataccttcgactaagtggcggtcatggagcttgacgacgaagatagaacagtggcaatgctactcaacctgtcaaccatggagacagtgtatataagacctcggcaacgacaacagtggtaatgtattgattagagggttggcgtgatggcgacaacaagtagtagctactagagtgttaggtagtagtgacaagcatgctagcatgggaaaatatccctctagagtagaggtgccaatgtactgataaatttttatacggcagatacaacggtgggagccttctctcgtttgcatgacacttgttagatatggctaaaaaaatatatcatggcgttacaccattttattaatgtaatatttaaataaaacctatactaaaatataaccttagatgtgactcggtatctctactattaaaatattcgtgttattaaaagatcatgataattaatttatgtttttctattaatggaagacaaacagttatgcatgtcacacgcacatgccctgtttttatcatttgcaggcccttccgaatagttcatttatattttttttatagtactggtaatgaggtcgcgtggtcgacattttatattaacacgtttcatacaatttttatcggttagctatactttaattagcaaactaaaacttagtaaatgtaaaagaagtttttgacagtacaggcacaatttcatttgcaattctttaattttgttttttatttagctatttatagatttttttttacagaaatcaattaaatatatttttatttttagataatgtttaatctatttataaataaaaacaagctcacaagatccatgcatggctagcgtaatactagcaattaactaactgtacaatttatattatgtaatttatattacaaagggatgctttatttcatacaatcccaaggaccatcgcctatgccttggggatgacgatattctacaagggtacgttcatgacccttgcaaataaacattattagcaaggaactagagtgatggtagcagataaggatcttctgcaaggctatactattgcaaggggaaatactcttgacaataattacatttcttgt

SEQ ID NO: 60540 - DNA, 2097 bp, Oryza sativa
tcctgcagcccaattgtaaagtagatttaggaaaccgataccgtattgattaagatttctatcttgtaatcctggccgccatcctatataaggtgggcaggaggccctctagggggcatgagatacaatcagatcataatatctataatacacccggcggattcaaatccccaaacaggagtagggtattacctctcattgagagggcctgaacctgtctaaatcctttgtctccgtatccatccacttttagatcttgtgcgctatccccttttattattgccgaattcatgtttcgacagttggcgcgccaggtaggggctgcgtcgagctttccatcgagaagtgcgatggaatcaatttctggagatgtgctgagatcgatctcaaagagtcgtcggcttcgtcttcacttcgcttcgggatttttgctttgtcatcgccgctgacaactttaacaagttttcactctctgacttggatccaaaccagtcaggagagattcaatctaagtaagaaggagatggctaaaccctgagaccaatcgccgttgcagtcctccgcctgatcctgttcgtatcggcacgagggcagcgacgatccgatggatcagatggtcatccactaccaagcctactgaaccaatcaatctaccccaacgaagatgctatgatgctgcaagatggatctacagacacgaggcatgacgaaaccgatctaatcggcatgcataggagacggttgcagctgatggacaccgacgacgccggggccgcgcacgcagctacgccgcctgcgcgcggctgcgacctccgcctcctccgctccgacgactacgtcgcctccctccccgccgtcctcctggagtcgcggatctgttcctccgccgcttcaaagtcggcgaggactgcccggctgctgccgcgccgtcatcgtcaactagtcgggcaggttgcatcacgcgaaggagtccgagacgtcgacagatccctgctacgaccgcgacatcgctctcgccatcctcaagctcctcgtcttcgccaccggcgacatcatcaacaaccaaattcaacaaggctgtgaatggcaacatggccaacaaatgatatgatgacacgtcaccagcatgcacaggaccatgcatcggcaacatgcatgcccatcaagccagcaaccaatcacacctcacgtgatatttgtgcatttatctttaattaattccttgctgctgctgatcaatttaattatttgtttgattgcatgtgctactgagacgccgtggtggtcaggccgtcgccgtgccgcggagtatcgacttgatttgtcggcgtgttagcccgcactcactattgccgggcatcttcgcctacatggttggctacatccgctgacactgtcgaccgtctcaacaagttcgcgattggctgcttccacgctgccgagcccgactatcgcccctgcatggctcacgctgacccggctgcgcctctcatagctcacgctgacccggctgcgcctctccattggccgttgctgatgggaatcgtcatcttcaccgccggcctgcctctgtcgccgccgactagtgtcctcgtctatacagttggttggtcacactaccgttcatgggcgtccacgtcttcaccgaccggtctgcctttgccgccgcctactggtgtctctgcctacacggctggcctattatgccgctgttggtgggcatcttcgctttcaccgtcgaccgccttcgtcgccgccgactggtgtcttcattgttattgatggacgactttattcccacattggccacctctgctatcaccaaggggaatattacaaagctaagtcatcatttattccttatatgatattttccttttcctctgcctcactacatcaattggttctccattgagtagtgagtcgggggctacagatgttataacatatttttcaataattttcataatatttatcttgattgcttgtgacataatctgagtacaaaagtgtctatcgagttatggagttctatcttcctatgctttccgtttggtttgtcatggatagttgcctttgggccggggctgcaggaat

SEQ ID NO: 60541 - DNA, 9475 bp, Oryza sativa
tgttgggcatctatgtgttcaccgaccggccgcctcgtccgccgtcgactggtgtttccgcctgcacggctggcttattatgccgccattgtaggacgtctgcatcttctccgaccggccacctcgtatgacgccaactggtgctatcgtcttcacggctggctatgtcgccgccaccgcaaataggcatcatcaccttcaatgcaagctgtctacgtgttctaccgactggtttcttcactaccatggctgcatgattttgccagtgttgattggccttatcgtcttcatcgctagtcgtctcttctgctgctgactagtgccctcgcctctacggctaatttataccgctaccactactgatggacgtcatctccttcattgctggtcaccttatctgacgctgactggctagatcgcctccacggctgcgcgtcttcggtaccggtttgtttctgttgccgccgacttgtgttcgcttcatcacggctatgcaactttgtcgccatggtggagcggcttcatcttcattgtcttcagcaccagcaaactctattgcctttactttgcaagctttcctacttcaccaaccacgacgtctacaggagcttcgacatctcggcatgcgtcaccaaatatgatgccgtgttatattattacagcaagtggtgttccaatcttcaatatttctactcggacatcttcaacatatatcttcactgaagcaatgactactcgacgacaagaagctacagttcttgactctatgttcagttgtttctcaactaaccaaagagtcgggggctacacaaatacaagactctcaaaattcgacaagctttatgtcaagatgaagcaatcaatcaatcaacgagtcaactcggggagttattatcttcgtcttcgcttcagagccgacatctaatttcagcgactccgattattacaccagcaattttggcttcttcacgccgccacaatctattccaaatttctcaagtttgagatttaatttacatgtctgggagtttggagtcatcaaccaatcaactcagatcagattcaatgagttgaacaatagcatatactttcctctaagtggagcatctgcaacaactataacaccaagttctactgacgtctttataaatcaaggggcattgcatcagtcttcgttatgcacacgctcgcatcaaggaaactactcgagcttcaatatcttctcaacagtttgatggattattgtcactgacatcatcaccagcacctatatttcatcagccttgatgtctccgttgttgctaatgggtgactacgtcttcgcctctggttgctttcgtcattgccgacttgttatttcgccttcatggttggcctactacgcaactaccgatagaggatctcatcattatcgtcggctgctacaacgctattgactggatcaccgacatcgtcatcttcatcaacatcctgtcaaacctcttcaacatagcctattctactgttgtttgatgcgcaacttcgttatcatatttgatcatctctattgctgccaatcgtcattaccatcggttgcatttgtcgtcgccgactattttcttcatcttcatgattggtggacttcgtcatcgtctttgatgcgtgtctatatcttcaccgtcggcttgctttcgtcaccaccgactggtatcgtcgccttcacggatggcttattatgtcgccactagtaggcatcttcatcttcttcaccagctgccttgtctgtcaccgactaattatttcgctgccatggctacacaactttattgctgggcgccttcatcttcattgctggctgacctgactgctgccgactggtttctttgccttcacggttgtgcaacttcatcacttttgattggtatcactattttcactaccaccaatatttttgccacctctagtgggcaatattctctctatattggttgtcttgtctctatgccaactgcgtcagctaccatcaatggacaattgtgactacgacaaaaggacacgctatatgctcaggggcctactagctcaaacacaagtatcataccttcaatttggacttgttccggatacattcaacatggattcatggtcatgagttgatttatcctgctcaactactggaccactcattattccccgtaagggctatcaactgaatacttgcaccaatcaggatttaattgttatatctattttggagtatcccataaaggataatcactcagatcagaagctattcatatgagctacacttggtctatatcacccggaagatttattactcgggagcatgttacatgcgtcaccctttaaagggtgtcgaaggcatattttttgccctaggcctaatatgtctgcagcccatattatcaggtgtggcctgtcacgttcttttagggacttaggcactttttgcttaggccaaagtgcgcgtgatcaagtgcccaatacctcaaaatccttttataccgcagttactcaactttttaggagttggtacaatgcatcttaaaaggtgtcaaacagtaaagctttatatagctgctccgctgacttttttatatatagtcaaggcactgtttgggtttatcaagcaatttattggatacaatatcattgctttttgccacgtaactgtgcatttttattgaccaatattatggcttaggctgattatatatcttggtcatttttcaggcggttggtaaattctttatgagtttatttactcggattttacaccacgtatgccgtatatttctgggtgtggtgaaaccatgtgtcttttagggacttaagcacatctgttaaagcagtgtgcacatggcgtatgtccaatactttggaaatttctttattcacagcattcaagcttttttatagctgttttgctatatgacttttcaatgatgttgtcagctttaggttgcacgcattatattttacaaagctgtcggtatatcactcggatcatgttatttggagattcacaccgcatatgctgtatattgatatcaagtcacttggttgactataattatcgaaaaccactctgttggttggattatttattccttgactatatgcttggtttgttcaactaaccacatagtcgggagctacacctattaggtgcatctagtcgatgcacctaagtctacattcaatttttgttcagccctccgtagtcttcagatttggtaaaagtactcgggggaccatgaagaagatgattgaagcactcggctttggagtaatctagttcgagagaagattatcttttcaactgcgaaggtctcaggggctactgtggagattatgggtaccccatacccacacggcatggttatccgactgttataagggatagcttatatctatagaatttgtaacagatcatgacttggttattacgtttccatgtatattatggaacggcctaaagtcctgggttgataaaattataaagtagatttaggaaaccgatatcgtattggttaaggtttctatcttgtaatcctggcccccatcctatataaggtgggcaggaggccctctagggggcatgagacacaatcagatcgtcagatctataatacacccggcggattcaaatccccaaacaggagtagggtattacctctcattgagagggcctaaacctgtcgaaatcttttgtctccgtatccatccacttttaggtctcgtgcgctacccccttttattattgccgaattcatgtttcgacagatggcttttatatttttagtattagttttgaaccgctgagaacagacatatagtaatcgtagcttttttttttatttatgttgcatgcctttaacttataagtataagttagaaaatgaaaaaacttacaaggattcttcgtacccttttcctccagcctcccttatttatatgctgtgttctttcatttttgtctaccaaggccatgatcagtcattcgtcaattgcatgaaaccatgtaactgtcctccctatccaagcaatctgtcagcgtccatctgcttgccaaataaaatataaaacaatatcttctttctatctcttcccctcttgcattttcatgtttattaacttctacaggtactctctccgttcttaaaaaaaaaaaagctaatctaggattggatgacacaagattcgtcgttttttttataaagggaggatgtagcatcacatgttactagagttcattcatttgagaaatgagaataggcaataccggaaaagaaacgtggttcacctccatgctatccagcggattacgcgagaattccaggcaacccaaaggtagaggcatggaccgacgaccctggggtgccgccaagcagcgcgtactcactacatcactgcagatcgataggctgtcaggctgccatgacctgcatgaaattaggtagctctagcagggtacgagcatagtattgggcctgactggagttgttgacatatagccgatgcaatataggacattccatagacttaactgcaaattgttttcccaacatgcgaggccttatttcaatggagagaattcttggtaaattttgtgcaaactaaactaattcctaaaaaaaagtgttctaaaattcatacagtctagtttgcaattaatggggcctaaatctgtaacatatggcatgcattgcccccttggcatattaactcgaaacatagtaaatacttgaccgaagcggaggacttgtgcactattctgtatgaagatggttcttatccatatagtgcccatttttgcataatttggggttgggatacgttaaaatcgagaagttggacctgaggatatatcatattctatggttgtataagcgtgcgatactgttaacacaagtctaaaactagatgattataaatcattttatttttgcctataaacttatttatttactataagaaatcagaagttgcataaacatgccaaacaggtttcaaggggaatagatgcgatcctatacaagatcttaataaataagcacatcaatgtttattaagcatattttagcatgatggagcctgcgcgaggggcttggcccttttgttatttcatactaatacaaatagatataatacaattgagctgaaaatcatgagtaaagtgctactccttaaatgagccaggcctgcatataattgggcttagcccataaacaagttgctcactatagggaccttgataggccataagccattttgggatattctttgtcttagataatgatgaaactagatgacaccccgcgcgttgctgcgggatattcatgtacatattactatatattttaatatatagcagttgtaagtcttagtaaaaaaataactaagtaaatagaaaggaaaaaaaagactcaagtagggttggtcagatgtccagtgcactgccactcaggtagcaagacccacagcgctgaaccttaggcacaatatcttgtaatgtaatggaaaatgatgctagtgatcattgttcttttaccgaatacacgcatatttccatgcctggtcttacattctttaataataaaattcctctgacattgtaaaagataaactaaacagcaaaaaaaaaaagagagcggaggaacttaatttttgcagtccattcgatttctatagacatgtttcgtagacagttatttggaagcacgaatatcaaatcaaacaattaaagcaataagatttttctaaaaagaagtaaggatagactaactgtgctgatatatcgagaacacactccgctagagacttgtatatgtcaagaagccagagttatgtgataccctgaatatgaattgaaaaaacaaaatcatttctaccaataatattttcctgcgtgctgtaaggttaaatcaaccatatatttcgccatcaaaaacaaaaataagccaaacattaattccaagacagaaattcatatttcagcgatgtaccgtggattgaatagaatgagtctacaatctataaagcttgcattcagtccctagaaccgccacagctgcgaccaattaggcaaaagtcataaagaaaaaagattgatcaatctctctattacttactgtgttgctgcaacagcagctccgtcagttcctgaagccaagacatgttcgctgaggtttcgccatagccagcggtgtgtatgcatccgccgcgggctgcttcagctcccatcgtggtgtttagcaaaaggtgatgtaacagatggaaagttaattagcgtgaaaaagaatgagcgatttactcagcatacaaatagctattgccgtcgattcgtatgccgtgttagatggcagccgttcctctaatacggagatgacgcagcagacgattggaagggttccgcatgacttggtgacgtctgcaggggaaggttgaaggtctccatgcctcattgcctggtgggctgagaagaatttccaatgctcctaatcaagtgaatgggccacggaaaggagcatattggagatgatcagatggttgagaataactccctcgaatgatctaacggttgatttttagtggatgacgtagcttcacagaatttgagctttatagcactaaatgatctttaatggataccaattatattggaagaaaagatgagcatcataaagttaataacgaaagaaggatcatcactaaattaatgatgagaaaaatacattttcggtacaaaacatgattagggacgcattttaggtgataaacgaatttccgttacatgaacttcatagattttgaaatgtgacataattctcagtttattgaagtaatgaaccatttcttatcataagaataacgctgatcctcattatatgacatacatattttattatcactactttataatatggtcttatatacactaccggtaagaatgattttgtaacaactttttgtaggaccgaatcacaagaactaagctaaccagagggggggtgaatggttggtatacccaaagacccaaaaacttttagcggaaaataaaagttaccctcgaatcgatggatcgcggtttgaccgaagatgttgtaccggtctgaccgtcgagatgcctccggtctgaccgaggtagaagctccagtcgaaccgccgagattgcctgccgcgcctgcctgacgccgccagtctgaccgttgtcgctccgccggtctgaccgccgccttgccgatgaaacacaaatcgaagaactctcgaagtagatgacaactttattacttctctctttgtttacaaagtgcaacaacagcactccttacaaaatctcgactaaactcgaaaccctaaaacacagcgctatgaaaagcaacacaaaagagataccaggaagcctcacgctccccctctatttatacatgaggtaagcagcccaaagccacgaaccaaactcatactagatgtcctaatccacctaggaaaccttctagtacaaaaaacaaacttaacataaccaatcataccaaatttggactccatccaaattcgactccgcatcccatacgcacacaatacctccatcgtatgccatatggaatcttcaccaaccacatgcatcaactctagcctgagtatcccgcatgatctctaaccaccacggacatcgtcttaccaccaagccgactcccggtccatcaccgcaaaatactatcccgaggcgtcgagtcacctacacatgaaccaaaaaagaaatcatattccgagaccaagctatcaccaacttgactcattgttagcaaacaacagtatcacatacgtatagtatccatctagaagtcataaatatgaaacaaactcggatatccaaagaaacaacccgaaaccgaaaccgaaaccgacacagcgtcggccggtctgactgcacggataccgccggtctgaccggaccacatatccagcaacacttgtaaatccaaacatctccaaaaccacttcgaagattaattccaaatatcaaaactaataatcaccgatgctaattgttcatcacagaataagaatcaaaacaccttgatctaacactttctaccttattagacaactgtactcccttcgttctattataagtaattgatttggtagtgtaaatagatatggttaattaaaaaataggaactctacatttactattactaaataccaccataaaagctattattccatatcggtgttagtacgcaagacgtaggagcggttgcattttacttgacaaatttcatcttctagttaattttgttttctttctaggatctactttgtctggtctagttatctgtgtccattttatacctctgtatatactttactacaaccaccaaaccttgttttcatatacttcacctctcttctcatcttatatatatttatgttgatcaataagcaggggttgattcctatatctctctaccatataaaacaatacaactatctctacgattcttacagttatgtagcatgtctgcatgtacgctacacagagcatgttagaagatttttattttaagaatgggtggcgtcggaaaagtagcacagcagatatacacactatcatgcacatcaattcaccaatccacggaacaactgacccactatctgtgaacccgatcagtggctcgagacaatgagctcatcagaatgcagccatggaatgattgagttgcaattgaggtcaagggatggaaaggggctagggcatgtctttgacactgacatttcgcatggtctagcaccaaatttggcccagtgtgcagccactagcattttgtgcctgaagctggtgtgtggagaaagcgatctacggaatgatccttgaccatgatcagtcgaaagcataatcccaaacttgggcatgtgcggatgacacgaatgcccgcagaatttcgctagcttgcctgagtgcaagggcaattgtgcggacaatgatgccgttgcatgccttggaacaaatctggctattcgtacgtgaaggaacatactgcttcgattcgacaatccttcctctcttttttttgtttgctccatgggtcatagttagctaaatatacatcggtcacgcccagatgcactgctagaacttagattattcacgaccaaccttaacaaacatctgatcgttgatagtcaaagaagccgcggtaggccctccgacggccatgtaatcgctggtcgttactacgtgcgtgtatgtggtcgctaataaggcgtcagttcagaattttctatagataacgaaattggtggccgatccccttccccgccggcttagatccgctgcactggtgcaccagcaccgacgccccctacatggtcaccactgccgctgcacccagcggtcgccggccatccctgcgcgcctgctcccgctccaggcttttcccgaggacaagatttggccgccaataag

SEQ ID NO: 60542 - DNA, 4347 bp, Oryza sativa
aatgattggtttatttatctaaaatcgggattcttcttctgtgaacacgcaaatttgtggaggcatcttggcatattgtttaatgtttacagttcagtaacaagatatagcatggccctgataccgctgacaaaacgataatttcattttcaatcaatcatttatcttcccgtactgcaattcatggcttcttgcaggcagttgatagtttatttaacatattctacttattggtatgaatttgccctgctctatgttatcagtagcagagcacacttgcttccatttggatttattaaaatgtgtttagtttctcatattacagctcccttctcttcatggacagattccagtgtgacatagctaaagtgcaaagaaacttattttgtgtgcccagatgttattatttccaatggttcctgcaggatgatttatatatgttgatcaacattcttggatttgatcaacatcaatatgatatgcactgatagtctggtatatggcttgccacttcctttttttttccaagttcaataagatagcatacatccccaacttgtaatgctttggagaaatcaataagaataatcaacagactaatggactattaatgttgaccctaacttagatattgttaggtttacacttaccatagcttggtgtaaaagtagtatctagttcataacataagcattcagactgctctattatacaggctgaattatatgttctcctataactccacatatcgctattacaattcatttgtgtattgattggtttaaaccttggattttgcagtgttcacaacatggatgaaacaagccaagagttctacgactgggttgaagacctttcatgtagttgtagatgtatagtacattatggacgtacatttccaaattatatgtaatgaacgaattaaattatttgcatttgattaataaagagtggtcaataatttcgtttattggtctattaacatctcgttaatctaaatacattaccattactagtaaaaaatgtgatatcgtcattaataaaataaagaccacacagtgttgtcatcgttaaaaaaaaataacgacacaaatcatggtcgttaatgaatataacgatgtcacaatgtcacagtcgttaaagaaatgacgatggcagagaaactccgtcgttagtacaataacgacagaaaaaaagttagcgtgctcgttaatattattaacgacggagcctttaacgaccactgacgatcacaaaaaatatggtcgttaatgacctttaacgaccacatttggactttcaacgaccatattttctgtcgttaataatgatttctctagtagtgatgtcacacaagctagattatgtgaggcggagaacagggggggatccaggatttttgatcgatggtgtgtcatcatcaactctactaagaagcttggtttctaagtacagtcaataatacatatgaaaagtttaaaattaatggtaaacaatagagaaatgagatgaacccacctattaatctagaaatcaagcaatagagagataatttagcaatcatatgtctacatgcaattcaaagttgacgtcaaacatgagaagtagtagcctaaaaatagataaatgaatattttatatcaatttatatctaaataccatgtttaaaaaaatattttcaacaacagtttctatatataccgcatgtccaattggtgaaattaaattatactactatgaactaaatttattagatacacatgtaaataatagcaccgccactaatttgttttactgaacctgatgcatggaagaaaattaaagctcagggccttggctggcagttgcaaacagtagaactgctagctgcggccgcctgccgatgtgggcatgtggccaactaaattagtaagggtaatttatgggcagaacaaatggtgctcaattagtggttactgctgttttcgtgtgagtatggcgttaattggtaaggtgcactggtgtcactcatcgtagactagaacaggttacatgcactactagaaaaattatttgttaccacgaaaaaaatcatggtatcaatactaaaattatggcaatagatatatgttaccacaattttaaaattgttgctagccgttgtaataaatagcgtggtaataggttattgcaacgatttttatttagtggtaataatttcgatgttgccacggaatggatgtaacaaaaaatcatattgcaacacttcacatcgttataataaaagctattgccaccactccatatttggcattagttctacgtaccaaattaaaggttcaaatattaatttatcatcctatctatttatttttttgatattgtgtcttggctaggattcgaacccaagatctattcttcacgcgtgctttcctttaccaactcacacacgcatcaattcttttggaaaatacatatcgttccatttgaaccttacctaactgagatttgaatcatagatttaaatatctaaaagatttcaaatgaaaatgttgtcacctataaaattgtagatctcatcgacagctataattcccatataaaatttgtctcaatttgtgtccatatgaaaaaaataagttaaattatgagacgataatttttttattgcaacgaatttgttgatcgtggcaacaaaaaatagtgaaaagtaccatgtactatgtaaattgccacaaaaattaaaattgtggcgatagaacatgtttttttttgcaacagtaagactttttgtggcgatatctcattttttattgcaacaaaaatactaaataaaacaacgattgtagattgttgcaaaaaaatataattatttgccacagaaaaattatcattgcaatagtataatatattgctacgaattattttttgttgtaataatttggggggaatagctcaattatcttgtagtgatgggatggaccaaaaggtattggtgtcagctgacaccatagctaacatgatggatccgcccctggtggagaagagaagggaggagaggaaaaaggagcgccaacctgtatataactccaaaagagttaaaatcaacatagtagtggattagatggaaatgaataaatgaagatttattatattttggagcttgtgtattagaggtagtctattgtatatgttaccttttattggataagtagatgatgtacactaaattagagatagcaatcatctttacttttaaacatgcacttaatttcctttcatttgtgaatgatgggagtgtcaacctctgttttagctttcatagttggttaagagagtactagataataatactagtgcacctactatgttcgctccccgccccgcgtcttccctttgtttaagaagatccctttacctctcctaaatgtaagattctcatccataaatattgatccacgatctatttacttatttcatacattgcaacacagtttttagaggcaaggtattaaaaaaacattcattgtatcttaggacacaaatgccatctcttccttttagctttaattctccgaagacctagattgccataatatttttcaatctcgcataacctcaccctatttatatacttcgtagataggtcttctatgataggtcatctagttcatccatcacatgaaaccagagacagatgacgaaaagataatgaggtgtggccaaatggcccatggccatgcttgcaaatttaaaatgagttatctttaatggcattgatattgatattatagtttagtaattagactcaacaagtcaatatttaacaacccatttgtaaacatgcataagaagaagcaagcattcaaaaaatatcactatctaccactggaccatggctaaatttggtcttcaaatactatgcagttctgcacccacaaaacaagagcaaaaggtacaatattttcttagtaaatgcttgtctaaattgattaatgaggatggtgtttggcagtaaatgctctgaaggaaataactacataattagacaattactcaagtggttaaaaaaacaggtgactctcatttctagccgggtctaataaaagttaaaaataaatttctaggttttgaatcttttgtcctcaatgtagattttgggaggacaagtggattggaaactcttcttttaaagggtggtatctatctttatataatattgtgcgtcggaaaagtgcgtcagttgcaactatcatgaatacagttcctttgaatgtttctttccatagggaactagtgggccagaatatagttaattggcaaaatttgttgctcgaattgtacgtattaaccttaatgataataaat

SEQ ID NO: 60543 - DNA, 915 bp, Oryza sativa
catatgttttataattggctgattgggatttactcaaagaccaaaaaacatatttcaattagagcatctgccttttatgttggctatatggttaaataggaatgatatggtttttaataaaataccaactaaagtttatatgcatgtactcatcagagcaatatactggttcggttttgacccaactacaaaggtgtgaagaggacattggtggttattcacgctgtatgtcgaaaattggagacaaccgctatgcaaatttttgttaactttggatggagatttaacaataggattgttcttgaataagtgtctctctttttttaccgtggcatttattattgtatcgtttctttatcctttattaaaaattattatacttggttttcagctaagaactatatatgtggttgtagcttccgttaaagtaaagctcagatattatccattatctaaaagaaacttagcacttagcaataagccagtgaaaaaactgtagatattgacatttattcaaactagctaattaaatgtccataccttgcaatcgtacgtaagttaaagaaagataacttaattatatattgtaaagcgtatattataatatacacgaagaatggatcaaaattatccatattatactactatcctattctctcatttctttcattctaatttgttgtactaacatatattatattaaactataagtggtggaggcagacactaccatcaccgctggcttttaaagtagcagagattcacagtgcagctgctatgtcaagggggccggtgcagcgcctgctttgcgtcttggatgcacgcgcgcaccgccgcttcctgctcctttgctcagctagctagggcaagtaatataatacttcatatattgcctctaagaggggctgcaggaat

SEQ ID NO: 60544 - DNA, 1188 bp, Oryza sativa
ccatctgttcatacaagaaatatttcctatataatattaaatctctagtaatcatatgctaactctagtaatcatatattaaaactctaataatcttatattaaaactataataatctcatatggtaactctaaataatcatattctagctctaataatcatatatgaaaactctaataatcatatgctaactctaacaatcatattatatctctagtaatcatatgctaactctagtaatcatatattacatcacttgcatgcgcaaattcctctgagggctagctaccatttagtcttgagagacgacgacgacctcttttctgcaacatgcaaaaaaaatgtattagtctaaatgcaaaggaacatactttgattagtgcaagatagattaaactaggtcggaggggagtagaagtttaggttcatggattcattcgcgttcgttcccgtttgttcgcgttcgttcacgttcgttcacgttcgttcccgttcgtttacgtttcgttcacatttagttcacgttcgttcggcgttcgttcgtgttcggtcccgtttcgttcacgttcgttcgcgttcgttcccatttcgttcacgttcgttcgcgttcgttcccgtttcattcccgttcgttcccgttcgttcgcgtttcgttcacgttcgttcgcgacggcgtgggcaaaggtagtagcggcttcggcctcggcaaaggcggcggcggcggcgacagcgagacgacggcggtggcgtggcgcggcggcggtggcataggcgtcgtgcggcggcggcggcggtggcggcgtggctgtcggtagtggcggcggcatcgtggcgcagcggcggtggcgtggcctcggtcaactccaaccttgttaaggtcaaccgttgtcatcccactgtcatcaatcgttacgcctccaccagtcagcctaacccattggcaccgaaacagagggaccttgagaggtccatagtcaagttcccatatgtcctcgatggcaccgtaatacgtgctagttgtaccatcgtgtcccatatcatctatacgaacaacactattctggttcgtgctcttcatatcttaggctctcgtgtagaatgtgtacccattgatctcatatccctggaatgtcgcgatcgagctagatggtcccctcgccaggaaggccagttgttggttaatcgtct

SEQ ID NO: 60545 - DNA, 2116 bp, Oryza sativa
ttcctgcagcccatgagactttaggtttgtgaacttcttctccttcgtgcttattattcgctttatttcgtgaagtatccagacggaaccttgatgctctccaagcattcgaacatactttccttctctgccttgctaagagtgtagctggctggactcaagtaatggctacctttctcctttggttcagggtgaagatcgctgtgttgttccatatgcttcagatcattacgtgattccagtgtatctttctactttccatatacacctaggaagccaagcaggtttacgcaaaggttcttagtgaggtgcatcacgtcgattgcgtggcggacgtccaagaattcccaatagggtaactcccaaaaaatagagttctttttccacatcgccgtgtgaccatcttcgctctcaataggctggctgccaggcccctttccaaacattactttaagatctttcaccatagcaaacactgttttcctgctgcaatgtttaggcttcgtacggtggtccgccttatgttcgaagtgcttgcttttcttccgtacaggatggtttgcagcaaggaatcaatgatgacctatgtacacaaccttcctgaaatgcttaagatacgtaccttcagtttcatccatacagtgagtgcaagccttgtaccccttgttagactgcccagataggttgttaagtgcaggtcaatcgttgatggttatgaacagcagcgctcgtaggttaaactcctcctatttgtcctcgtcccacacggggacaccttctttcttacacaacagttacagatcttcgaccagtggtcttaataaatatcgatgtcgttaccaggttgcttggggccttgaataataatcggcatcattatgtacttcctcttcatgcatagccaagggggaaggttgtagatacacatcgtaacgggccaagtgctatggctgctgctcatctctccaaaaggattcatgctatccgtacttaaaccaaaccgtatgtttcgtgcgtcctttccaaagtctttaaatgttctgtcgatgttttgccactgcgaaccatcggcagggtgtctcagcatcccgtcctgttgacgttcttcagcgtgccaacgcatcattatagcattccccttgttcctgaacaaacgccttagccgcggtcctccttggcgtcctgcaacatctaaccaagatcatccgtagcgtcgttatcgtcagcatccctgtccacctcgcccgtttgatttccttcaaatccagcgtactgagcccagtccggaatgttctcgtcttccacttcatcttcttccatttcaacccctttctcaccgtggaatgtctaacaattatagcttggcatgaaccccgactcaaacaagtggaaatgaatagtcctggatgcataatactccttctggttcttacacatattgcatggacgacaaataaaacccttatgcttattagcttcggccactctcaaaaaataatgcacgccatcaataaactctttcgaccgccggtcagcgtacatccattgccgatccatctacatgaaatgaaaaaaaatcatacataaataaatattcgtacaataatgaaagtggtacaataatgataaaataattaaaaactctttcaacggttatacaataatgacgtatcattattcatacaataattataacataatccaacaaacaattcttatttattttttttgaagttttaaactaatattaatgttgtgcttcttttaattttcaatttagtttcttttctattatttaagattaattttcattatattttaaactatgagaataaaactttttaagtaaacaaacaaaattcctatatattcttcttcccacacaaattttctctctcatcaacttacaacaaagttttggcgataaaaaaaattgtgaaacatagctccaaaagtaatataacaacaaaaaacattggagaacaagttactaaccttttagacacctctgatttgtatataatcaccaaaaagatttcacaagaaattttggcatgacctcccctcttttttggagaaattttgaagcttgctcgggctggaggaggaagaaaac

SEQ ID NO: 60546 - DNA, 1597 bp, Oryza sativa
attcctgcagcccggtttatatcttaaaaaacaagttttggattagaaagcacttcttagaatgatgaaacatagatgttaggtaatgttgcagctattagaacatatcccatactttcatttatgatcaaaatgactctaagtaggcattggacaaaccgaagctacagaaattgcttaagtaatgaagcggatgcaattacatcatggagaaggacaaaatagtgttcttttcctagattcctatttcatgtatttaacttctaatcaagtaattgttttatttataaacaatatcggtgaatcactgtccacatgttttgcagacacacactcatatttttgttacctccttgctcataagctggtgcatcactgaggtatatgttacttcctaaaacttctcaccaaattactcacttggaagatcatggatttcggatgcaattttattatagttctgcttcttgaaatgacagtagttgttgaagttcctgaaagaaaatcccaagctttgaaagttcctgtgttgagcttagttgaacaaatattatgaaattttcttcacttcagagcatgactttgtagacaaaaaattactaattccttgcaggttaccagatattgtttctatggcatgaaggagtcatttggatttacaccttcctggctcttatggcttaggttggctctagtcgtaaacaaatcataatatgtagcataaacttcagcgaattctcttaaaaatatgctgctgttacttccatactaattactttgcaggtacagcaccttcatagtatgccttcctgttggtacggttagtgaggttggcctaatctacattgttcttcctttcatgaaggtaacttaaataacttagaaaggaagatctctgcctccatttcataacaaatcttgtttaaatgctcttcttttgcatgagcaatatcaggcatctgggaaatactgccttaggatgcccaacaaatggaatttctccttcaactacttctatgcctctatctttttcatggttttgtatgccccaggtagtgtttccatgggattgtacttcatttagtaattgatgctacaacctagtactccctcggtcctttaatatatgacgccgttgatttttgttacaagttttgatcattcgttttattcaaaaattttgtgtaaatcttaaaaatataaataatgcttaaatttcatttagtgttaaatcaagaaaaatatttacttaaattttttgaataagacaaatgaccaaatataatgtaaaaagtcaatgacgtcatatattaaaggacggagggagtattttttttaaggtagttgtaggaatttctgaaatgaaaacaattaggatttgataacacactgcgttgttgtttcatttggatgagtgcagtatatccacgcttgtttcgctacttgatcgcccagcggaagaaggccttggcaaaagcaaaaaccacataactatactcaagagctatctactctgatttctgctcgcggctacagctcaggttgctaccgtttcttgagcaaataagtaaaagtgtattagaatggaaatgccgaa

SEQ ID NO: 60547 - DNA, 2119 bp, Oryza sativa
gctagcgatgccctttggttcacatgtcaatgctctctatggatgctgcactcgaactcgatcacccggtgctcttcatttgctacatcattttcttcaacaaaatcaggacatatcacagatatctctttattttttctagggtaatatcacagatatatcaggggtacaccgtatacactcgtgggtatctaaaaatttatagacatgcagtaaaaaaaaataccacgtacattcgtcagaaaggccatatacgagcaaaattcgttcagatgggctgaagggaagagtttggcgtttcagtaaaaaaaaacaattgattgattctcatataaccatcctgcaaataatacttgaaaagattgctactcttatatggcaaaaacaaaatcaacacaagaaaacatttgagttgccctgtcgaaccagaaattttcaaaaacctgctactccatcaaatgtttctgacaaaacttactaatatggtataaatgacggagggaatgagaagcaacaagcacaccaacattttttcagaacaacatagtggaaatctagagccccaaaattcctaggatggattcattatgaatagagcagcacatttttagttgctttgttgaacagagcaggatatcaaagctcctgaacggaaaactcactaaaaagattatcatggacagatttgtgctactttactgcataagaagactcaagtggtcaagaacaagaatatgactgaacacaaatttatagaacttgcaggttgcagcaaatagcaaaaaggcggttcaaacctccctaaataattcagagcttcgagtccgaataacagaagctcgatggggctcatcacccacgcatagatcagagcttggaccacgggatgcagatcgcttttgagctgctgtgtgctagattcagttcgggtcaggggcgccgagatccattgctccatccatccgccatcccatgaaaaaaaatgcaaaaggagtaaatcggtcactcccgatgtgtacctgctcctggccgcacaaactttgcagctcgagatctaggggcaagcagacaggattcgaaacaacaaattccacaaaacaaaatgaaaaccttcgaatgggaaacaaaaatggaaatgaaacaaaatcatgagccaatcgaacagagtgaaaaccttcgaatgtggcatgttgaccaagcgcttcggctgactcgaaatgattttgttgaatcgaatagcaaatgatcaatggtgtttgggtaggttacctttgcgggtgcgcttgaggagtcggtgccacgggcgaggagttcttggctgcagatggtgaggaagttgttgtcgtcgtcgtcgtcgccgaagctgttgctcgtgttgctgccgttgccacggtggcggtggtgatgctgctgcttctgggcgttgtgtttgtagtgttggtgatggttgatggcagcgatggcgttcttctcgacggggatcacagcggccacgttccacacgtccctgaacgccctcgccttgaccgtcgccacgcctctcaatgctgcgttcagatatcaagaacaagatcaatcacggtgcctcgatggagatgatgtgaatgggtggaacagcgagggcgaaccgttgccccattggcagcggcggcggtgatggtgacgatgtcgccgggaggcggacgctgacagtgaaggcgacggcggcggtgaggtggtcgcgctcggcaccgagggactcggcggcctcgacgcactgggcggggaacagcttcgccgcggacggaatggtcatgttggtgcgcgcagtgcggtcgtccctgccactgctggaggacgcggtggtggtggccaccgctgccaccgacacggcggcgtggacctgcgcgttgtgcgcacgcgtctcctcccgtcttcttctcattccctccttcagccacctccccaccgcttcccaccgctgccgccgccgcatcgatacggctgcagcttcggcgtgctcaccgctctgcaaaacaacacattttttttcaaaaaaaaaatttgttaaattagcaaataactaaggaagaggggtaccagctccggcgccgccggcagccaccgccgcgaggtgagg

SEQ ID NO: 60548 - DNA, 1699 bp, Oryza sativa
attcctgcagccctacagtttgatgatgaagatttaggtcttttactgttatgctcactgcctattccatatgcaaatttcgtgacaccatacttttaagtcgtgatgaactaaccctagcggaagtttatgaagcgctccaaaacagggagaagatgaaaggtatggttcagtctgatgcgtcgtcctctgagggcgaagcattgcaggtcagaggcagatctgagcagagaacctacaacgtgtcacgtcctaataaattcatcccgaaataaaaatcattttctaaaaggaataatagaattaattaaaattctaaaagaaattggcaaacactaaaatacgtacaagaaaaattcaaatgtagcccggagaatttttgttaaattctccttggtctaaaaagagccctcaaattttacttaaattttcagagcaccggaaatatttattaagcaacaacaactatgatcaaagtttacttaaaaagaaaaacctaaaattaatccccctcctccctttgggccaagtttggcccaaagtcctctctctctttctctccctctccgtctctccctccttctcttcggcctccccttcccctcccggcctactccctcctcttctcctcctgggccgcctcggcttcgcccggcccaagccgagccgcgcctcccacccgtgccgcgcacgtgcgcgcgcgtgcgcgccgttgccgcacgttgaccgcgcgcctcccgcgtgggtcccgcctgtcaggccgtccccgacctccagctgccggcctccttcctctctctcccgtgaaccttagcgttgttcctcctccaaatccaccccattcaagccggctctttccaaattaaatagggggaattaatctccattgattcctctttgatttcccccgttttcccccttgaatcgtgcccccaatcgccgggaacggacgcgccaaccccggccgccattcccgcctctgttccggcctctctcgttgccggctccctccccgcgcctataaaatggaaccccctccttccgttctccagttttagccccctcccgcgctctcccgtggccgccccacctctccccgtcttctccttctctctctctccggcgtatggccatcggggaacagaccagctgcacgttcatggaggttgctgtgcccaactcctcaaacagagactgcagccggcagtatcactttcagtcttgctgatgctcgcaagaagtttgcagattgatgatgttggattttagtactagatgtacggtaggtaactggacgctgtgatttaatttagctccatgaataaatcggacaaataagatgggagcaggggttttggtagtttgtgcatgtgagaatcgtacaaattaattaaaatagttccaagaaagctcccatgaagtgtactgtaactttatattgcattttattacaagttaggtgggccatgcatttgtaagttcaggggagtgaaaagaatttagaagaccaataattagtaatacctgaaagaaaataatccctaagagttgggacgtgtaaaacaaatatcatcgtcttgatgaagttatggagttatagttgtgggactcgttttttttacataatggattaaaccggcctctacatccaaacggatgtacacagccaaagttgtgggactcatttgggctgcaggaa

SEQ ID NO: 60549 - DNA, 870 bp, Oryza sativa
ccattcccaacccaataactggatgggtctatagcattaaataagctgccaccgagaataaaaaatgatgtggcaagtgaataaatgagtaaagagaagaaaccatgtcttgcatgaaacatggtttctacgtaacatccaagacatcatgtgagataaatagcattaaattgaagtatggaatagtggtgtttgcattggaaaagtagtgtctagtactagtttcttgatgatgtggagtttatcgaaactatgtatagtatcatgggtaagtaatggcctaagaagatcatacaaaaaggtgtgaaaaacaactgactactcctagttatgttttctccttgacctacgtgcatacctacgtgcatacttattatgtacatccttttcacctctccacttttttttctttcaaaaaaattaactgtatggccacctacgcaattttgacacttccaccatccattcctcctccagtttacattattcttcactagataagggttacttcccctatttgtctgcaaagtgtgcggcgacgcgggaggcgcggctagatcggcggcgcggtgtggtcgagggcgtggcacggtgcggccaaaaaatcgcgaaggcagcggaagacactactacagaagatgtaaagggtgccaggtgggaaagccccttcggtgccggtttttccaaccagcacccgtatggcagcactgattagctagggtgaaaggtgtcggttccaaaaacagcacctttgaggcgcccatgagccaaaaataaatcggctagatgcatcgagccgatgcattgagccgtcaagccaatcccatctaatacctaaatctcaaaatttcctcaaatcctcaaaaatca

SEQ ID NO: 60550 - DNA, 2213 bp, Oryza sativa
  unsure (1)..(2213): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtctgtatggagtcgtcaagtaccttcattttgagaagatactaatcatttctcatgtttactagtcccaaaaaaaaaagtacgatcgttacggcagatcggaattgtatcactgtttgcatgcacagttgcccttcactcgcaagctcgtaagagaatcccagcgcattcttgtcatcaacgcatgcccaagttagggacttggctatctaccagcttcggggacaaaattgtactgccagctacacactgagccaaattcagtcactgagatcaagagagaggtccacgatatttcatccttttgccttaattccaactcaatgagctcagtgtcccgactcccgagccaccgcccgggatcgccagctggtggttctgctggtgcatgaactgtcatgcatcctaaagtgaacatccagtcctcttcttctccaatgctacccgttcttaaaatgaaatcttttagcaagctctttacaaggtacatgtttcagaactaaaaaattacatgtaaatagcatgagttgttttatatggcagactgatatatatgagttgatttttttttttttgcacgcgagagcatgtacccacagttacaccatgtatatatacaccttgcacgaatcctagggcagttacattaaggtgctaacaaaatatacctcgcatgatgtttcctttatactatattttttcaaatgtaaaacatcttgtttatgtgttttttttatttcttgtattttatatggttgccctattaattttatatgtttaattgcttgagatgtttttccttaatatgtttgatgaactgtaaaacatggtagcatatatatatcatttcgggagtatcatttttgtaagatgttaacctggtgaaaaatatattatgcaatttttcatgcgacgcttctgttgtatatatatgattcgtacctgggacccatctgtcgacgtgtaacatcctttctgtatgaaaataatattattctgatgtctcactataaaaaacaggtaattcatatttggcattgtagatataacttcaaatgaaaaaaaaagcattaactataatgttgtagatattgccgggcagtccaaatttcatatatagcttttccccatacgacgtcatttgaaaattttaaacattcttccgtggaaatagatcccaacactttgaacatctaaataaaaaaaatacatggttcaatctttcgttttcggtatttgtattaggggtgccgatatggtgatatttccgaaattttggtccgaaatttcaaacaaaatttagttaaatttaaacaaatattgctaaaattcatgagaattttttttaaaaaataaaatcgtatcggtgggggtggggtccgatatgaccaaatcttttgaaatttcgttcggaaattttgaaccctgacacaaatggatccaaggaagttgtagaactcgtcgaactctacgattttgccataaagtttttcataaaaggaaaaaactatcatttgaatatgtcggccttttccaatattcaatggataggtccgaactgtccggtcaattgagtataaatgctggttcatgttatgaagaaccagtgatgcttgtttcctatcactgccgatttataacaagaacaactagcagtgatacaatagtaatggttcataacaagaaccaagagtgatattcaagtatcactgctggttcagagtagtatcagtgactgttctaaggaaccaacaatcatgggccggtttgatttatttgaaatgataaagtatgtcctagaaagaaaactaaactggaagatggaatctgtcaacaaatttattttctcgatatacaggagaactacatagatgcattaagaattgtcagtaaaatacaatagctgcttttacttcctgcctactatacttttatggtggtgtttactagtagtagaaatgattgacaattgatctctcttttatttagtaaaccatatcaatttaataa

SEQ ID NO: 60551 - DNA, 1337 bp, Oryza sativa
ccccacaacttgcttacctttgccctcatcttcatcttcagatccatcaaaaacttttatgagttcttgaattaaccactgcatgcagtgcttcttcttctccttctccttcatgttcttcttcttgttcacatcatcatctttgactctcccatcatcttccttcttgcctctcccaagcttaggacaatgcgagcgaatatgatcaagtgctctatactcaaaacaatgattcggttctcctgttttcctgttcctaacatttttcatagctcgagaaaatttgttagatagcaaaaccaagtcctcctcctcgaactgttcgagttgatcatcggacatggcattaaataaagcaagaacagaagactttgatgaagaagcaccaagatccaaagaagttgaagacgaaaccaaagcactagacttagaatcacctttacaagaaggaatattcatctcatgagttttcagtttagtgtaaagcgaatccaaagtcaaagtagacatgttaacagactcctgaatagatgtaactttcatctcccaaatagacatgtcaagaccattcaaaaagtgacgagaaatctcagattgtggataattagcatcataagaagaatcaacagatctaagatcactcaaaattttgttaaacctagagagatagtcatctaaagcttctccaggtttcatctcaaatttaatgtactcctttttgaaaagatcacgacgaagttctataatatttgaagttccttgatgaaagtttttcaaagcgttccaaatctcatgagcagtttcaagatgagaaacacgatcataatctgaacgagaaatcccactcaaaagaatattgcgagctttgcaattgtgttcaaattcaagttttaaagcatcaatattaatttgatcaggaatcacataaggatgagaaaattttctccaaatatcataatcctcagccataatgtaagattgcatcctactgcaccaatgagaaaaatctgttccatcgaaaacatgaggcttagttgaaaatctattagtagccatggcaaaaactctagatcggttaaaatccaaagaagaaaacaaggctctgataccacttgtaggatcgaatcacaagaactaagccaaccagaggggggggtgaatggttgatatacccaaaaaccgaaaacttttagcgcaaataaaagttaccctcaaaatcgatgaaatcggtctgaccgaagttgatcggccggtctgaccgcgcctattctgccggtctgaccggtgtagatcgctcggcttgaacgtcccgaagtcgcctctgcctatcgacgccg

SEQ ID NO: 60552 - DNA, 1166 bp, Oryza sativa
ctattgtgcttgatgagaaggatcacactattgagattctaaatgctgaaattgatagattaaaatcttcaatttctgatgatgataattgttaatcttgtgaagttttattttctgaaattaatgctttgcgagatgccaattctgttaattgcaaaaaattggaattttagattgaaaaatctaaaacgttggaatcttcttttgcgattggatttgctttacatgctcgtgttgttgatgagttgattttgacaaagaacgttttgaaaaaatacaaagttgctttttgtgcaagttctttggtcaatgcttcatgtgtgaataaagcaaaacaaaacaatggtgttttgatttctcaagattgttcaaagtgtgttttgaatgagatgaagttgaaagatgcttttgggcgtgttatacacatggaagagattgttaatcaagatgaggtgttttcttgctcaacttgtagaaaacaaaaaggtcttttggatgcttgcaaaaattgtgctgttcttacacaagaggtttcttatttgaaaagttctttggaaagattttctgatggtaaaaagaacctcaacatgattcttgatcaatctaaggttagcacacacaatcgtggtttaggttttgatccttatgctcataattctagacatcctcctactgttttgggtgttgctaggagaggtgaaattttgattgaatctgagcctaagaacactgtgcttaaatctgctggcatcatgtcttctttaaatgcatcttcttcgaaatcaaatgttgtgaatccaaaaccttctgttgttgcaaaaccatcaatttcaaaaccatctacttcacaaacttgtcgtgaaaagtacacttgttctttttgtggaaaagatggacatttggttggtttttgttttagacttgcccataaacaaaaaaaggaaagagaaattgcttttgcaaaacaacgttggcaaaaatcgggttttaattcgaggaccatggttagaccgacactaactagtcggtcagaccggttgccaggcccggtcagaccgcaggcacagcagcggtcaaaccggccttagggtgattttgcgcgaaattcaaatcggacttttgtgaagcaaaacggtaaattttctggtaagtctgattctgatttt

SEQ ID NO: 60553 - DNA, 1174 bp, Oryza sativa
attttggccccggttggtataaacaactgggactactttagtcccagttgtttataccaatcgagactaaagataattgggcctggctcgacccgacaactttttgaaccaggactaaaaatgatctttagtcccggttaacaccaaccgggactaaacatcaaaaagtttttaaccaggactaaaaatagtctttagtcccggttcctaatggaaggttcctaatagaaccgggactattgtggattatgggcgaccgaccaaagatggtttctccagtagtgataatatgtagtcaaaacatgcagcatactatagtttcttttatttttgtttaatttgtataagctcgcatgtatatatatgaatttcgagttgttcaaaagagctaactgcacgtctgcacccaatgtggtagtaacattccataagattttccttgctatgtgaaagactggagctgttcatacccatcaaaaccatacaatgcagaagctgtacactatattgctcataattaaagaagtgcaagtgcaatgacaggatcccatcttccatgaaaatatcttaaatttgtcctaatgcatgagtaagaagaggcataacagtaggcaatcaatctctccatgtaatactctctctcactctacagatcttgcaactgcacaccaaatccacacgttccacacatactcatgattgggatgcagcaaacatcggatcattttcatggcccattgtgtcgaccactgtcttttagacatgggacaattgcttatttgaccctgttttgaactgtaattgccgatttggccatactttttgaactttgcttatttgaccctctttttcgagtacgaagcttccgtctgaccctcttttgatgactccgttagggttcgatttttttttaaaaagaaaatgtttcaagagttcctaatgacgaaaataccctccaaccctattttgactctctctctctcaatcgtgcgtgactctcacggtctcacctctctctcactctctcactcgtgcgtgcagcggcggcggctagctaagggggcggcggtggcggcgagctgagggggcggcggcggcggcataaagcactgccccgccggcgcccacctcttgtggtggagggcggcagcggcggcgctttgagggggtccga

SEQ ID NO: 60554 - DNA, 1922 bp, Oryza sativa
ttcaattcagtttattaaaaaatctaatatttttatattattagttaattctcctatacaaagaaatacccttgggattgttttgatttatcatttttttattaattctaattaaccaggaatgatatttttaattattgttctttttatgcagtacgtagcaaataacatctgcattggatactgcatcacatgatgcaacaattatatttactctgacagaaaagcgtcaaaggatttttaatgatcaatataaacagtagacaatatatttgcatttaatctaagacaggtctgtagacaataacacataaataaaatagtctcagaaggtaaattgatcaaactgattaatctagcaactataataggtctgataacatgatcctggattcctgatctctaaatgcttgcaattcgacattagcacatcctagaaacgccagaggtcatcattctcacaagttcttccacaatgaccagcttgtggcgcctcttcagtagtgttcatcccattctgaaataaaattacagaataagctacaaagttactgaaaaactataagggtaggtctaagtttgaacttatgaatgatacatagcagtccatttctaaattgaactcactaactagtatcgcaactaaagccataccattggcagaacatttttaaattgatctattgttgtccaagaaccaaatttttcataatgtttgttcaagagaataaataataaggatgtacagtagtaaaaagattgaagtcagtatataccatgagaagtgcatgaaggaactcagggacaacagaagaagatggtccatttgcatcctgtgatttgaaaaataataccagttagtatgttctttctaggtaacaaaaatagctttaatttatacttacatgggaatgagtttctgccttatccttatccactgtctgctctagcctttctatccttgatgctagttattgatgagcattgttcacagcattagtgactgcctgctgaacaatgtcttgcacttgctgctgtgtatatagtggctgtgtctccatgctaccagatggtgcacttgctgaattaccaacatggtttctatctataattcctggaagaccataataccttccacgttttctacctttagtgagctgcacccaaacatgttgtttgtcgacttgattgttttctccttccttgacacgatcattatacaccacctaattaagatatgtagtggcaccattgcatggttttagatgatttcactttttttgattgccaaacttgaaactagaaactagaataagcagaacacataccgctaactgttcagctttcttgttggcatactgtcccttgccctttgcatgtcgatgtgtgcgttcaaagacatcaatatcatcaacatccgtccctgcattctcaattatctatccaaaagtacatatcatagtgagaagtcaaagtagtataaatcataataggaaaatcatttaactttggtaccatggcttgtttatgcatagcaacacttcgtgaaccacaagtatgatgaacaccacctccttccatccgatttttgctgttttgagctgacactttctttacattttcatcagaccacaagtcacacaacatatcccaccacttttgctcaatccaataaggagggaatgccttccaaagttgaggatcatcaacatcaaaatcatcatgagaaggggcatctccatcctgttgtaactcagtcgcacgcatattttcgatatgcttttccaaagaacgttttgcttcagatttctcatgtgacaaagcttggctaaacgttcaacagctttgcgataaaataatctagcacaatccacttctctaccatcagcaaacttaaaacgcagctgtaaaaggataaggta

SEQ ID NO: 60555 - DNA, 1164 bp, Oryza sativa
gccttaacccaaggcttacgatgattcagaccgaactggcaacccgaccttgggtcccagcttgtcccaagccaacccaggccaaccattccacattttagttgttagcaggttttaagaattaaaacactaacttgggtacattgctcggcttgcccataaccgagggcgcggctattcgaatagattatactctgatcagaggtgtacatctttacccacaagacacatcctcctcacgtgtaaccacgtgccacataccaccacggtatacggacagaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctctgcaacggaggcccgaagaccggtccttatatggccgaggtgctactatcaaaaccatgcaccccgagcccagcctaaaaccattttgaggattttgaatagagggggaggtgtgaatccaattccacaataatccatccattccaaagtgtccaggtgatgagaatattcccaaagtctagagttgtaaaaccacctaatgttgcctaattaaccagcgaagcatctacctaaaatcatactagtggtaccatgagtagagtgtccactagttggggttttgtttattctagggggaacaaggaaataataacaataacaataataaggtcataacaaaggaaaataggcatggcttgataaaacagtgataacgcgggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcggcgtctacacgaccaacggaaaagaaaaggcttttactctaataaactccatataacaa

SEQ ID NO: 60556 - DNA, 1766 bp, Oryza sativa
tcctgcaccccgatgagttttaggagcagagaagagtttttgagaaaagcatgtttttggttcaattggaaatttctttcttttaaaaagggggagaagttttcttttggatttttgagcatgatgtgtacgtttgtacgaagtgtgttttttaccgcttttgtttttaattttccaaactccaaaacatttttaatgggtttgccaatgtgttcatcaagggggagattgtaagatcaacgtgtgttttgattcttattctgtgatgaacaattggcatatgtgattatcggttttgatatttggagattatcgtcgaagtggttttggagataatcagttttcaggagatgaaaagagtttactggtttgtcgggaccggtcagactgggcggttgttgccggttagaccggtgctatgtgagcggtcagaccggccggcccgtggtctgatcggccgacgctgtgtcggtttcggtttcggattgtttgtttggatattcgtgattgtttcatggttatggcttctagatggatactatacgtatgtaatactgttgtttgctaacaatgagtgaagttggagatagcttggtctcggaatatggtttctttctttgtttcatgtgtaggtgactcgatgcctcgggagagtatttgcggtgatggaccgggagtcggcttagtggtaagacgatgtccgtggtggtcagatatcatgcgggatactaagggtagagttgatgcacgtggttggtgaagattccatatggcatacgatggaggtattgtgtgcgtatgggggatgcggagtcgaatttggaaggagtccaaatttggtacgattggttatgtaaagtttctttcttgtactagagggttttctaaggtgtttaggactcttagtatgagtttggttcgtggctttaggctgcctacctcatgtataaatagaggggaagcgtgaggcttcccagtatcgcttttgagagcaattgagttaagttttaagttagggtttcgagtttagtcaaaatttttgtaaggagtgctattggtgcactttgtaaacacagagagaagtaataaagtcgtcatccactttaagagttcttcgatttgtgtttcaccaggtttcggcggtctaaccgacgactcatcggaccggcggcaaggcggcggtcagaccggcggaagcgaggcggtcagaccggcggcggcagcaggcacggtaggcgatctcggcggttcgaccggagttcgatctcggtcagaccggcgtgttccaggcggttagaccggtgcaactacttcggtcagaccgcgatccatcgatttcgagggtaacttttatttccgctaaaagtttttggttttagggtatctcaaccattcaccccccctctggttggcttagttcttgtgattcgatcctacaagtggtatcagagccacgtttgctctttttgatctttgccgatcttgagtttttgccatggttacttctaataaatttacaactaagcctcatattttcgatggaacggatttttctcattggtgtagtaggatgcaatcttacattatggctgagaattatgatctttggagaaaagtttctcatccttatgtgattcctgaagctattaatactgctgctgaaaaaattgcttttgaacaaaattgcaccgctcgcaacatcttttgagtggtatttctcattcagattatgatcgtgttgctcatcttcaaactgggctgcagga

SEQ ID NO: 60557 - DNA, 5546 bp, Oryza sativa
attcctgcagcccatagcaagaacatgtaaacgcgcagcgactggactcctaaaatggagaacacgatcagacgtgcgcttagcacgacgcaaggacacgaccacacgatcacacataaacagagaaattgctaaagactctgcaaaataatgagctatgctatgtacaacgatacaaccatggggttaactaacagtattctcgggcacataaggaacaaacaacaaatatcagtatagaggggcaatacagggagagagaattttacgaggacaaacaaaataagctataaactcctaggagcaaataaagagtttactcgttaagttttttttattgtactactttttcatgaatagttatatacattattttgttactgacaatactgcagccatcgactctggggctgtttagaacccaccccaaaattttaaaccctgtcacatagaacgtttgaatacctgcataaagtattaaatgtaggctaaaaaatgactaattacacagatatatatggattcttttttcacttctgtaacaagtaccctacacataacatgcaagaagattttattttgagaatgagcggcatctgaaaagaagcacatcgcagcatgcactagcgttgcgaccatcctgcaactctgagaggtttgggacaccttgctcattgacaatcggccatggacagtctaaattgtgatcgaggtcaaatccaagcaagagggagcggggctgcacgtatctgtgctaccaacctgtccaatgctcttgccccaaatttggcctattccacagcagagggtagcatttcgcaccctaattaaggtgagacatgaatcccatacaaagctagtggcacgccaagttcagatttgtgcagacacgagttttgccagataattcacgtagtccctctctggatttgggccaagacttcggccgggggttcctttcgtacatggagttttacatgttatttttatgacttgtggtttgattcctgccaattcctttaagtcctaaatataaatcatactgtggaggaattatatccaacaaagaatggctgatttctttcatcgaaaagcgaattattttcaacaatcatatcaacattcaacattcacgtattactttctaagagtgaacccaccactaggagagagattatttctgattgtagcaaccaagatgaagaaaactccactgaaatttgcttcaagtacagactaactattatgcgagttacgttaggcatgtgtaagttcagtgattgataaatagcaaaaatctagaacagtgataaataatctaccctataattgaacaaatggttttacttatttactcattcatcatgtcacacatctaacggtgtaaaatcatcttatgagctagatcgaacgtgccagatgcacacgcgtgtcgctcctaatgccgcaatcacgggctcaccgcgcctcctccgcatcggcctctctcgagcagcacctcgcgcgcccctctcccgcaaccgccggacaccctcattggctccacaaatcacactgccatcgcggcgtcgccgtcccgctgctcgcacccctccgcccatcgcgccgaaccgcgccggagtcgccctccccagccctcagcgcatctcaccgatccacgccgccaggccagagtcgccgtctccgcccctgatctacgcctgggcgctcgcctccgcgcccccagatcatcttcggtcggagtcgccgggcttgtcgccaagccaatcccctccgccaccgataggaggtacagaaacctctgtccacccctgcctggcctctgtcaccgactctgccgtgtgggctctctgctcgcgcgtgctcctccacacatcccagcaccccgccgcggctcttgcccccgtcgcgtcggcgcactcctccggttattcccctccgccaccactgcctcctccgtcgggcctgacctctccgacgtgttgaggcactacataaggtgtccgatttgcttcctttttcatgtttgctatggttatctagatgctaattttgcagtagacatggggttgagctcacctctgttggcacggtatataagtcaatggaatgtccaatgacttatgaatcttcacttgtaattctggattgctttgggttttgggacttgcatttgccaaccaatgcataaatgcttcttccagcgttaaaatcagaccttagatgcaaatccactgtatccatactatcgagtacattatggttgcctataacccaatttggttcaccgatatatttctcaatgtcaatcctgtttgcatttttgggttcagcactctgtacttttcagttttcactactgctcgatggaaagaagccttcaactgcctgttagctgttagtttttacattctacggtgcaaggatccttggacacttaattagagcagcgtaaagaaattggattttgaagttcttttttgtgatgacaaatactaacatcttctctgaacttttgatttttgtattgcccttaatacaggcaggtaaaaaaacaaggagaagaactagcttttgtatagatatgttcatcacaattagctaacacatctgttaatcaaaatattttaactcttgccggtttaaccttacctcttgcatggagtccatggcataattcacatgattctaatatgtttgattcgaaaccatggcatggtgatttcagatatcaaagaaaactttaccatgttcatcgcttgctttgattccaatatgtttgattcaaaactgtggcatggcgatttcagacatcaaagtaaactttaccatgttatatccagctctggaatgacctgtgttcttatctcaaacagaagcataatatgtcgttacagctcagacctatatactatggttcatcggcagtgactcaatgtcatggatgtgaaaattgagaaagcttgacacgtgcttacaagaagaagatcccagttaaataagacattaccattgatctccggtgggcattttgtagaattgtgtccttactactatgatttgtaatgatgaagcgtgtacgatttgaaattaacttgttataaataagataaatgaggcgcaaaaagcaaggttgttttttctgcagaagccatttcaaaaggacttggattctgcagaaggacaatttgttgcccaacttagggagttatctgaggaaaaccagctctacagaattgattgctatctttttttttagtgcaagctaagaaaatggcttacacccaggtaagaactacaactaatatttgagctgattcttttttgttggtactcatgggggtaagtggataatatggacttcaggctcactatggtttggcatttttcaacacgagcaatttggaaaggattttatcagcatattttttattcaatccaatatatgttgttgatatatagttggagaagcatcgaatgactgatcatgaactgtaggaggtactaaaatggccttagaagaatagtttgttgtgccactgccatccaattttttatcatgagctgtaggaggtatactaaaatagccttagaagaatagtttgttgtgccactgccatccaattttttttttaccatgacaaattttagatatccgtacagatttaataaaggcatgcttcatgaacctgcactggaagcaattgtagcgcacaaacgaaagtgcttgttcaagaaaactaatttcatattctctatgtgggttctgccgatatgtgtgccgaaaccatgataagatggcaaaataaaggtggcaagaaatgaagtatgaactaaaaatttgaacttggattcctatatgcagtaacgcttcttcaagcagaacttctaggggaggctcttagatctaccgtatgttcctactgcaaatgggggagcaaagagatgaagcaccggcaaagctagctttgatttattattgtttattgagccgctttgtgaagtagctccttgcgttctaattgtgcttatgcccttcacaaattccatgataaggaaaatctcagtttcatgtaatttggcacatgtgcgtggatatagctaaaactgatgatttagatgacaaatcaagatgtattatggtaaacctttttgtgaagtttgttttccttgagtaaataggaaactttttttaaaatttgatgtatgttgttttgaaatttaagtcagaaatgtaattcaagtctgactccatttgcactaagaatatatgctcttaatcatcttattcttttacatcttgaatataattatttttctaatatgtatttgtacataatgtgcgttgcacgtgcatggttagtataatttttgtaattattttatctcattctatgcttgacaaaacatatatcttattttcgttgtttgatttgtattaccaaatatttccgttgcgttagcacgggcagaatactagttaatattagttgaaaagaaagaaaacatttgctgaggcatgaaatagacagataatctccttatttagattccattcaagcctcgttattattagtattagtgttgacaaccaaattatgcaatacaacaaattataacaatgtttagccagatttggaaaggacctcagcatactatcatgggtcggtcagacggtaggtatacgatcgtttagaccggcggccctcaatccgagtacgattaaggcagtttgtacgtttctttgcttgggcatgaggtttcttgagttctaattgatctataaacttaataggacatagagaaatatgcctatggaagaaagaccaatccctttatacgagctatgcctggttcgattctaacccctaaccacaatcccagctacacaatcgaatcgttattttgccttcaccattacttttaagtcatgtttctaccttatcttcaacctagcattagtctgcctatctttatcgatttgcaccacaaatcatccaccttgccacaaatcattcgccttagctacgagcagtgttgcattggggctgggtctgctattttgattttttatactcggttttataccaggagggatgggtctcactgcacagaatgggtgggaggggaggacaaaggaaacttgcttttccatccaatcggtactttgttggctggtccttgattggcgtgtacaattattttgtatctatagctacgagagtctgctaccgtttgtatatatgtttgccccgtaaatcttccgattacctacgaggcaggtggttatttccgtatcgatctaaatcagcctagagactagttttatgtctaaatcggttccgctagccggtttaatctgttaaacccatcttggtttagagttttctagattaagatgattggcgactctattaacacagtaaatctttaggtgagtccgtgttattagctagaaaggatgccaaccgttagtctattactttcttgaattaaaaggaaggcgctactcccttgattcatttatatatagtgtattttaattt

SEQ ID NO: 60558 - DNA, 720 bp, Oryza sativa
ccatagtatgaatgctaatatatatacagatgatcaggctcagggtcattcattcgtggtcgactggaatttttactgtgcggttacaacattttcactgtcattctgtgcggttacaataatttcattattaatttgtgtggctataacattttcattgtcgatctgtgtatttatacaaatatcaacgaagcgaattatcgaaacaaatcctttgagaagtcaaacactcttatagcttaggtttattgtgggttggggggaggtaaatactgcctggaggatagtcggacgacgacagctgctacagatgagagagggactaaggatcacgggagactaattctgatttatttcttaactagaataatatcgatacaatccatcattagatagatggagggaagaacccaatctcatcagcactggtttgacaaaaaccaacattgatgagggtttcccaccgtaactctcgagatcgttcatgcacagtatataccaggcacagatgggaccacatcagtgccaggccttggttacaaccggcactgaaaagttgccgacccatctgtgcttggtaaggccctaacatctacactgataagtggctcatcgcgccccctccaacatacataaattggtttcggtgggaaaatgtaaaacatagacaagcagtaataaacttggagtgaaaatatttactgatgcatgaaaaacaat

SEQ ID NO: 60559 - DNA, 6675 bp, Oryza sativa
ggaaaacaagaagttgtcaatacaactagcctatgatgatgtgcatttgcgtgactactctacacacatgacacatccgggttatgtgatatgtgagagtaccaatacgtatctcttaggtttcttgttgctagtaaaaatttgggtcaggatgagtgatagtatgaccttgatacaataaatggctacatttgttacaatgtattaccttttatcgcccacttatttttattgatgcacatcctttatggctcatggtcacatattttataggtttttaaaaaatattttaatttgtgtgaaagtcgttcaacctttattaagtgaccatgaccttttcattggaaggaatgtgcatgtctgtgtagcaatgttttttctcaaatacattaacaattaaatgctacaaacaaaattaatcacatgaatatacattttgattatgtcctggatatctcaatcttaactaatgaatctttagttaaaggatgaggtttttttcttcctttctttctttccactcctagtagcttcatctctggaagtctcttgaatgtgttcttaattttaccttctatctaatccaacggtccaagattcattcactctcttttatcttgtagtaaatccaacagctaatatttgctaaatgatgtggagcgtgatgtaggagagcatgctttggcaattaagcaacaaacatttcaaatcatatgtcgaatgccatatacattggtacgttacgttttttaattagatggtgagtgttgtaatctacgttacccagatacggggatatggacacggatacatgatacggtgatacagggcatacaacattttccaaaataatagtacgtaatgcatggcagtaagcgtgtgccatgtgctacaaatttttttaggcagttttgcacttttgccaactctcatctgaattctttgaggctcaggcaacaaaatgaaggctagtgagtactgacacctacataccaaaccccacctctgtccaaggtcttgggccttctacccctgctcctagctgcctagataaataagagctggttcaagattggctagccgtaagcccgagggtccaacccactgccgtcaatgacgtcatacattaaaatatggaggtagtacttaatttcttcaaagatagttcagacagatatatgtagggtatatagaggaaactaaacaaggggatagcattttgttttttcctgccttgatgagtgattcaattttgagtgttattatgagttagctaactccaaaagttggcatgcaattttgactagtattccaaaagtttcttttcttttcactcatctgtggagccttcatgcatcctttagttttgtttcatttctaattctccagtggggtccctcgccaagttcttctatcttgccaaaaattacatacggagttgcagtggtaactagcttgttggtacggcaagtctaagataaaagagatgccctgaaaggaaggcatgtctagtgacgggatgcagtgtatcctggcctgcttgcctgggcagaaacattggcctcacagcccacactaatctacctgagaggtaataaaatgcagtggtgtgtttctctcccaatgccacctactctcaaatactaaggtggtgtttggattcagggacttaactttagtccctatatttagacactaatttagagtattaaatatagactacttacaaaattaattacataaatgaaagctaatttgtgagacaaattttttaagcctaattaatctataattagagaatgtttactgtagcatcacataggctaatcatggattaattaggctcgatagattcgtctcgcgaattagtctaagattatggatgggttttattaatagtctatgtttaatatttataattagtgttcaaacattcgatgtgatagggacttaaaagttttagtcccatctaaacagggtctaactcatatgtaccaaatgtgcaactgtagtacgtgtgaaaactatggaggtacttcgttgctgtaccagatctttcattggtacctaatgaaatggaggtcgccattggaggttgctactttgagcttaagtttgaggtggaacaggctactcaagacaacaatgtggctacagactaacgtgaaattggatgatgatggctttatagatggccaaacgggccgtccggccctacatggcccatgtatggcccaataaggctcgggttgtgtcgggtcggcccgaaggtacgacagcccatggtacttcttcatagaataagtctattttcggggctgtgtcttatatgactagaacaagtttattttgtatatctcttctctttggaccttgccttatatggctgcttaagtatattttggatccctttactatttttcttcaaccgtgccgtgccgggctagcccaccgtgctaaggcatcaacctaggcacggctgtcaagccgtgccgtgcttgggctgcgccgtcgggccttgggccttatggccatttatagatggctttaaccaagatgggaaagttgatgtgcagcactgagagttttaaagataaaaaaaacacacgaatatgttgattctcgaggggacatcacctgcttgtttgcacatcatctaaataattatcaagaaatttgtagaaaatattaacaagatagattaatatctgataaatcactccaaatacatgcaaggtcaaatttaatttctacaaattgccaaaaaaataaatttgactatgaatatacctcaactagacagtatttttttgcaacttttggaagttgatcaattttcacttttatgtttatgttgagttctatcttgttgatatataaccatttggataatatgcaaataatgagggaatgttccctcgagagttgcgaatccgctctcaaaaaagacagtgagacaaccttgacatcatctctacacaatggcaaacagggacttatgaccggagatgatgcaccaatagtgcaaactaatatggaattagaagaaaaggttcttcgtagcttggcaaatgacatcttggacatggtagttgaaatgttaccacaacaacaacatgataacctctcggtccatctcgctatggtggaacagatgcagcagtggaggaggagacgacggaagaaacagaagccgccgccggaggtgtcctgcagcagcacggtgaggaagctggggtcggattgccgggtcgtgcccatcgtcgcctctagctccgggcacggccggtagtagttcgccgccccgcccagcccgtccttgcacccggcgtcgaggccgaggtaccccgcggggagacccagcgcctccgacagcagctcgaacagccattccccgagccgccgcggcgtactcctcagccacgcccctgcacggcggcgggatctcctccggcgaaggcccctccggcgccatctccatgaacagcgtgtcgcgccagttggccgccggcggccggaacaggtcgtagttggagctgaaccgaaccttgctgccgacgtccctggtgtagtatggcgcctttgcctccaggggctcctcgtggaagtaccgcaccgctgcgagcatcgcatccgtgagctccttggcgacgtcgtggttgaccacctggaagaagccgaccgtctcggtggccaccctgacctcggcaaccaccctgccacggtcgacatccgccttagcgaggtcgatgagcgggatggccgccgccgatggcgcggcgatggggaggcactactacagaaaagcatttcagtgccggttgggagaccccctattgtgtcggttttcccaaccggcactatgttagcggcactaattagggagccagcaccaatcccattttaaaaaccggcacctttgagacttctgcgagccaaaaaaaacaaaagaagctcgagcatcgaactgttccccatcacccctagacccgtcaccccgagaccatcgatccgaaacaaaatcacactgtcaccatcgattcatccaagcatatccctcgaagcaaatcacagaagtttcacacaaatcacagatgaaggaatcacaaatcaatccatccaacacatatccctcaacaatttcatagaaagaatcaccattgccgctacgtcgccggatccgtcgcgggagtcgccgctaccactgctccgcccgccgacaactgacgccggatgtggctctgcccgccgtcaccaccccagccgccgtcgaggccggatccgtcgtggggccgccatcgctccacccgtcgacaccgaccccggccgctgacgccgccaccactgctctgcccgccgtcgccacccaggccgccgccgaggccggatccatcgtggggccgccaccgctccggccgccgacgccgaccccggtcaccaccgccaccactccgcccgccgacgccgaccccggtcaccaccaccaccgccaccgctccgtccgccatcgccaccccggccgctgccgaggccgcctcgcccaccgccgcatccgccgcgggagaagctgccgacgacgacgccatatgcggggaggaggaggggaaactgagagagagagagagaggcgagagagagatcgagaagccactagctcgtccttatccttatctcgtcctgtggggcccgccggtcggctcgatttgggtgccggtctttttaaaaaatccagcacaaaatgtaataggtgtcagtttttatttggaaccgacacctattattgcttaaaggtgccggctttttgcgatttcaacccacggaggtgggaaaaggcctataggtgtctgttttagcactaccggcacctatagtggcgacacatatttgatgttttgtagtagtgagggggtcgggctggtggtggaagaagtcggggacggtggtgacgccagcatcgacgagtctcttgacgccggccttggtgtcgtcgaaggcctggaggtcgcggaggcggtcgctgctgccggtgatggtggccatagctaagcctgcagaaacaaggcttggaacgacggtaagttggtgtctgagagctccaacacttgtatatccctcaatgaccagaaaaccattccgtttaaaaaaaaataggggctttctacatatctagtgacagaaaatcccacctcctaatattcaaattttggaccattgaatatgcttcaagattcatgcagacccctttaaccctaactcctctcctcctcccgcgttcagatcacaccgccaccactcctccctcctcgcgcgatcccccgccaccaccgccctaccgcccacctctccaacggctccccgctaacggatctggaaccaccacctgtgacctcctaaccacacgcttgctttgcccctaccgccgacgccggctcaccaccctcctccatccctgcggcttcggcggcggcgccgccgcctcgccacctgccaaagtccaccgcccactgccggtcctccgtcgtccacggtcatccctctaagccccgaggaaacccccctcttccccttccccaacccccctcctaccttgaccccaaccccaaaccctaacccgtatgctccctgccggagttggagtgtcaccggcactggagaagaaggagagccctccagagttggaggagagaagccggtggcacgaatcttggcatggatccaatggtccaaaatctgtaagatttcatccctaaatttcattcgaatgacagatagcaatcccgaaaataataatcacaaacatagcatttttctttattctatatccgtaactgttttcaaagtgctgcatgtattttttaatatttagtcacagtttgtggtttacaacatatagttaaatattttctacccttttgataggcacacaatctaccaccgggatacatcgtcgttctcgattttgaacttttaaatggatgttacctcgttgtttatatgtaactcaaataattatgacaaaaattaaaaaaagaaaaagatatattaccatgtgatatatcagtttataaatatgaaagttcaaattcaactcctaaatattgtaacgagataaaacaaattcaactacagctagttaacgtggtgcttagtggcaagacccgacaacgacaataatgtgtcgccgaacagtcagtaccggaatattataagacccgacactaatgtcttatcatcagtaccgggtgaattagcatgtgtataacctgaacttgtttttttttttgtttttggtgtcaagtttattcaaaccggcattgatgagggacacccctcttacgtggtagtagggctgtcaacgagccgagctcaagcgatctcgtctgcctaggctcgagctcgatacaagctcgagccgaacctataaaatattcgagctttaaggcaggcttggtttgaactcgagctcgtttttagacaggctcagttcgagttctaccgaacttgatttttaagtaaaacaatatatatttcaaggataatctttaaaaaaataattaatttcctgatcaatataagaggaaataaaataaaataaatatatgacgtcaatataaggcatacaaataatatatttgatcttctaatttattgatagcaacaaaaaaacacatatta

SEQ ID NO: 60560 - DNA, 838 bp, Oryza sativa
ctctctttttctattcattcttttctctctgctcctttctacactcttctccattctttccccttctctcttctgccgactgccgcagctctcctctcctctcctctcggcgtgggcgacggcggcagcagggcggccgagctggcacgaggcggcggtggaggcgagcagccgggcgggcgaggggcgcagatggtcggggaggaggcagccggcggcaggtgggcgaagggcggaggaggcccgcggcggccgcgcgcatcgtgacggtggcaggcaatgcgagcaaggagcagcggcgcgagcgcagtcctgatgggggcgacgcggacggcagggcctccactccggcgaactccaacggcagacccagtatgtccatcctctctattccccacggtacaatccagatggtggcgcaagttcatctgagctgagtagtttggggatagcgtaaggagagaaactccaaattaggcatggggagggcgcggtttggaggaagtctaaaaatggtgtgcgtgatagaggatttgctagagcgtgttttttcatctccatacgtgaaaaatgagatggatggcgggatggaagagctgctgggatgctctaatgaacccagaacccatgatgctgcccaagattgtcaggtggtggctccactagtagatactactaagttggtatgcgcataggtgaatgcgcaatgtgcttctttaccaatgtcacccattctcaaactaaaatccagtaacatgagttttctcttatgtacatattacaaaaccataaaaaagattgcacagagatagtatccacagcttcagttagctggcag

SEQ ID NO: 60561 - DNA, 2189 bp, Oryza sativa
aagcccttttttataagggagataggatatttgtggtctcctattaagtattcatattactttgtttctatggtgtttttttcttgccaattatactatcaatattatttatcaataataaattacaatattgcaacttgtaaactattattatttaccatgttagaaatgtttatttgtgtcactatatagtgacgtatatgtgctttatatagtatatatattaaaaataaaaatatttagcctcaacttcttaaagacctattgtgtcaagttcatctaggacctctcaaatgtcaggaccgaccatgactataagtcatctgaacctagggccgatcctggggcagggcgagcagtgcaaccgccctttgttcccgttacctcaagcaaacaccagccttgcacaatatgtctgcctagcttgcacggccattacacgtaaagtagtaaatcactgattatgtgctagcacaagcacgttaacgttatcaaaaacccggaagctcatcggtacttgcgcccctactcaggaatcgcccgccgttgaaaccatctcgttcctctcgaaggcatctactctctcctctcgatacaaacatctatcagtactagttggcattcctaagcaattggtctctcttggcaaccatgaactaatcttatcatatctttagcctatggtctatgattaataacatcttgaacataaaaatcagatagaattttgctgatttcctattgttttatagctagagataggagcttgaatgaacaggtttgggcccgggtttattacttctctcgattggttgattcatttctcttgtagctctgcactaacagatagtatttttttatggagacataatataaacttgaataattttaatttgatgtctttttatagtatttaggtatgctattcaactatcacctaacaatagtttgtgcttaatgatgtctaaaagttaaacattactttctatttgaaatataaattatttgtcatacatacatatgtactaatgttacaaggctctttatttttgcctcgtcctgggctaccaaaatttcaggaccagctccgactgacactgtatctactctcgcgtccttctactcggacatgagacattaagggcccctttgacttggattcaatggggccctaataggttaattaggtcctgtttcgattttaacttttttcttcaaacttttaacttttttatcacatcgaactttcctacacataaacttctaattttttcgtcacatcgttctaatttctttaaacttttaatttttaattttgacgtgaaacaacatagcgttaattggaagatctagccggcaatctcgctcgtgtccttctctcttttgtttcggcttcactgcgcgatcacacgtctcctcttttctgttcggcttctgcgcgatcgttgcggctgcacccacctgtaggaatgttgggcgctgctgttagtagttctgggcgaggggtgccaccaagagccaacgccagctgagaattttgcatggacacttttttatttttgcaattagtcacttgacaacttcttgaatagtatgaatttgttaattactccctccttccctaaatgtttgacgccgttgacttttttaaacatgtttgaccattcgtcttattgaaaaacttttgtgaaatgtataaaactatatgtatacataaaagtatatttaacaataaatcaaatgatagaaaaagaattaataattacttaaattttttgaataaaacgaacagtcaaacattttttaaaaagtcaacggcgtcaaatattttgagatggagggagtatatgcgttgtttgagtaaatttcagttgtgtcagttttaggacgaagaataacactcatcttccctctatagcattcatatttcattatcactacttcttaatggtctttatttatgcccactattatgtaatagattttcctggacgacgccttattttatttctatgcggttcgtaaatgcaaccatatagaaaaatagagaaaccagtgttaggctgtcactcacacgagaaaatatattgtcccgtgtgggcggtttaactcactcgcacgaaaaaaaaacttcccctatccctttctctctctactggcctctccctctcgaaatttcaaaaaaaatt

SEQ ID NO: 60562 - DNA, 1734 bp, Oryza sativa
gtcgtccgcccgcgaaaatattaattttcccatacgattggctggagacgggccggacaatcgcacgaaaaaatcgaaatacctgtatggaaaaatgttgtccgtagtagtggctactgatttaactatgtggttatcgataattatatccagttgaaagtaatatgagttaatcgtataagtcgatatggattattaatcattccatcaggtaaaaaaatcaaataggtttgattttcgtttcataagcttccctggtaggcctgtcaactttttatccacgataacttatatatctacttcatgcagtccaagaaatagatagttatcgtggataaaaaaaagagtatgaataccctcttgaactatcacagtcgatcgaattacccccacccccaagctaaaaaagagatattttacaccctaaagtatataaacaggacaaataaccccctaacttaatctgaagtggtttcaatcctatatggtagtccaatcagcaattattttattaaaaaattggtgggccctgcatgtcatactctccctctctctacctctttcccctctcacctctctctctactcttatcatcctctctctctcaccgagcatagcaaggaggaggcgacatctgctgctctagcaattaatcccggtgtatgcattatattgaatgagaaaaggtcgctcgtgcaacaaatggacgtagtggtgtaagtgggctaacccacgaattcccttatagactaatggaataagttcatctgagatcccttaatttgtcaacgaatccgattttcgtccttcaaccggaaaatcagatacaacgggtccttgaactatcaaaaccagtgcagatgaagtccctcagcggtttagatggcggttttggctgatgtggcgcctatgtggctaatttgactcggtcttcaactgacgtggcattcacgtagcgcttacgtgacaattcgatctggaaaaataataaaacccgcgggacccacatgtcagtttcacacataaaataatttcaaaatggtggggcccacgtgggccccacatgttagcctcactccaccctttatccctctccctcggcttcctcgccatcgtcgacctcgacggtcgccgcgtcgtcttcctcggcacctccaacatctacggcttcctcgccaccgtcgacgtcgacggccaccgcgccgtctccctcagcacctccaacatcatgctccgcaactgcgagctcaagataacgacctgggccatcggcgtcgcggtctacaccgtgcgggacaccaaggtcaagtgcagccgcctggagacccacacgaaccgcgagaccatcgtgctcactctcctctgcaccctcgtctccctcctcgccggcatctggctgagcgaccacagcaacgagctaggcgtcatcccctacttccgcaagaaggacttctccaatcccaacgagatcgagaactacaaatggtacagcacaactcccaggtggtgggcaccgtggcaggggccggggtggtggggctggtcggaacgctcaaccgcgggctccgacgacgaggacgaccactccggtgccatcgccaccgcgtgcgccaagaaggcaccgccctccatcgccgtcaggctcgagaaggagatggcattctacggcgacggcggtggtactgagggcggggatgtggccagcgcaggaccccgcggcagcgctattgacag

SEQ ID NO: 60563 - DNA, 2297 bp, Oryza sativa
ttcctgcagcccattattaaaacaggcgagaactagtgatgcttgcgatgcatatatctgttagaataataatattccacagttttagatatactaaccttttgcagagaatgacaataaagtagaggagaatcgacatcaacacagacgataaatcaatcggacgatgtcgagaaccagacttgtgtatgatgggccaagaacgcagacttgacacgatgaatcaggccaaaattcacaagtctacgaagtgaagcaacagaggaggccgctagccgaaattgggctggattgggccagccccaggttcggccgaacctccctcgcctccgttggatccaggttttggatggacggtggagatgaagccgcaatgacggttggaggtattaccgactattccaaccgtcatagctgagctataaaaggacttcactctcttcacttcaacacacacctcaagcaagagctctctcattcctctcaagtttagtttagtagtatctagctggtagaatagaattagaataggaatcaggagtccggaagcgttcggaagagttcgggtatggctctagtagctttcctttcctcttttgtaagctttgtacttttattagaatactcttctatatacatttctggtattgaaatactttccgagtatatgagtacctactttacattatgttcatgttatgctgaatatactgctagcttatctgggagatgctttggtgcgggtatagtctttgcttatgcaattactctatgtcatgacgatgatattagagtagtatctgatagtttaggcgtgatgtctagattacgggatatcattatttggggttatatattgcggatgagaggtgggccgctgatggtaacagctcagtacgggtattccttcgcgcctatatataatcctaagttaatttcctggggagggtattcctccgtatttagccccggttgtatggcatgacggactgtcataaggaactcggcattcaggggtggcttctcgaagtatcaggagggcatcggatagagggtattagctagtataccagttaactagatgtatgtatactatgtatattagaagtataggaatagattctctttctcttttctttctacctagcttagattatttattatgaggatgagtagtaatggttgtgtgtcactctacccttggattatcttaacccctacttagaatatgattatcacaagtgatatataaattattagttgagttctctctacatgatcttcccacaggataaaataaatacgatacccttggaatactctcgggtgatatgctacaatagtatatccgtgcgcttgcaaatgaactctgtaaccataatataccagaagtatttatgcgccattgttgggaattatatttctaggaatgtcgttaagaaataccaacaagcgccgaccaccacgccgccagtctcctccaacaagacgcctgcacccaccgctgcgccgaccacccccgccactcggccgtggggcccaacaccccgcgcccgccgttgcacttaccaccaccttacccgctgcagtgccgaccacccccgccacctcggcccccaccacggcgcccaccgcctcagctccggccactgcggcgcctcctctccgccggtcgaggctcctgtcgctggtgccattgtccaccatcttggggatccctgttgcggcgcacggcgagcagccgccgccactggagctcggacagccctcctcgctcgcctgctcgccgtccacccgcctgtccgctccggcgctcaacaggaagaagagagagagaggggagacggaagaagagaggagtgaggatgaggaagaaatgagtgatgaaagggagatggaagggagtgaggggagatggaatggagagggatgaaagggagaggaagaaataagtgatgaaagggagtgaggggagatggaagggagagggatgaaatgagtgaggctgacatgtcgggccacgtgggccccaccattttaaataatttttttgtaactgacatgtgggcccatggtttttattatttttccgcgatagaattgccacataagcgccacgtcaatgccacatggaacgaagacctagtcaaacaagccacgtaggtgttgacggtcattatcgatcagtttcaaccgtcaatattaccaaaatagaggagaactagtgatgcttgcaatgcatatatatcttagaataataaaattccactatattaggtatactaacctcttgcagg

SEQ ID NO: 60564 - DNA, 4568 bp, Oryza sativa
cccaatgccggttggagggcacttcggacaattccccttccacaaccgtcataactacctctatataaggagctcactcttttcacttcaacacacacctcaagcaatagctctctcatttctctcaagtttagtttagtagtatctagctggtggaatagaaatagaataggagtccggaagtcttcggaagagttcagatatggctctagcaactttcctttcctcttttgtaagctttgtacttttattagaatactcttctatatatatttatggtattgaaatactttccgagtatatgagtacctactttacattatgttcatgttatactgaatatacggctagcttatctgggagatgctttggtgcgggtataatgtttgcttatgcaattactctatgtcatgacgatgatattagagtaatatctggtagtttaggcgtggtatctagattacgggatatcattatttggggttatatattgcggatgagtggtgggccgctgatggtgacagttcagtacgggtattcctccgcgcctatatataatcctaagttaatttcctggggagggtatttctccgtatttagccccggttgtatggtcatgacggactgtcgtaaggaacttggcagtcaggggtggcttctcgaagtaccaggagggcatcggatagagggtattagctagtatattaggtaactagaatatatgtatactatgtatattagaagtataggaatatattctttctcttttctttccatttagtttagataatttattatgagaatgagtagtaatgcttgtgtgtcactctacccttggattatcttaacccctacttacaatataattatcacaagtaatatataaattattagttgagttctccctacatgatcttcccacgggataaaataaatacgatacccttggaatactctcaggtgaaatgctacaatggtatatctgtgcgcttgcggatgaactctgtaaccataatataccagaagtatttctgcgccattgctgggaattatatttctagtaatgtcgttaagaaataccaataagcatttctggcgctgttgccagggattatatttctagtaatgtctttaagaaataccaacaagtatttctggcattgttgccggggaagattcataatagagattgcttgaactaatactttatatttacctctatgtaatcatttcctttgcaggctaaccttggttgttttcacttgttgttgtgaaaacagggtagtgcgtgactggtttcaacctaccagaaagcttcaaagaaaatccagaagctttcttccggaccgtcaggccgtgagtcgttgctctgcagaaaattctaccgacagagaaaccagtcgtaccagcgccaccgaccttcaagacaatggccagcaagactcttcgcgagttcgctgctccctctgctgacaatgtggccattgggcctgacggtcaacataggagaagtggatttcgacttgaaatccaacctcatcacgatggcgcaggctagcccgttttgtggcaagcctaatgaggatgcccacgcatcatctgctacaattcctagagatatgtagcacatacaccatcgagggagtcagacccgacaccgtcaggttgcgactgtttccgttctccctccttgggagagagaagcagtggttttatgccaaccgtgctgttgtcaacgcgtaggatacatactctacagcattcctctcaaagtcttcccgatgggcaaaaccaatgccctccgtggaaggatttccagtttccagcagacaagggatgagtctattccggaagcatgggagcgtctgcaggagcatgtgaccgcctgtcctcatcatgggatggtcgactggctgatcctgcagaacttctacaatggactcaccccaatgtcccgcgatcacctagacgcggcagctggaggtgctttcttctctaaaacggttcaaggagccgttgaattaatagagaagatggtctccaatatgggttggagcgaggaacgactccagacccgtcagcgaggcatgcttaccgtcacggagacggagttacttgctgccaagctggacctcgtcatgaaacgcttggacgaccacgagaaagggccacagggcaccgtcaaggccatggattcacacgtcacgtgtgaggtctgcggcggcacgggtcattctcggaatgactgcccggaaacccgtgaggagacgatgtatatgggcaacaacaacgggtaccgtccacaagaaggttaggggtggaacgaaccacgcccatattatcaagcaggtaacaataatgataacttgtctaaccagccctccttgaaggatctcatttttgcacaagctaaaaccactgatgcactaagcaaaaatcttgctgctaacgataagatcctagagaacattaatgtcaaactagatggctttgcttctgcttttcaaaatcagtcgagctttaataaaatgatagaaacccagttagctcagttagcatctttagtccctgcaaatgaaactgggaggattccggggcaacccgactcttctattgaaaatgtcaaagcgatcacaacgagaggaggtaagtccactcgtgatccgccatatcctaaccctgcaggaactaatgggatgtcaaaagaagcgccatctaatgactcggcttacaaggagattcagcccaacaagaccgtgccgctggaatactacaacacacggttgctgccattccctcaacggagtaggaaaccgtcagtggacgagcagttcgctcgttttgttgaagtaatccagaagattcacatcaacgtgccgttgttggacgctatgcaagtgccgacatatgcccgttatctcaaggacatactcaacaataagagaccgctcccaacaacggaggtggttaagctgacggaacaatgcagcaacgtcatactccacatgctcctggagaagaagaaagatccggggtgtgccacgatcacctgcttgatcggggcacaacaattcgaccaggccttgtgcgaccttggagctagcgtcagcgtcatgccaaaagacgtctttgacaagctcaacttcacgatgttggaaccgacgccgatgcgcctccaactagttgactcgtcagtccgttacccggcagggatagcggaggatgtgccagacaagatacgggattccttcatcccggttgattttgtggtgctagacatggacacggggaagaagacgccgctcatcctggggcgtccattccttagcaccgcaggagccaacattgacgtgggaatggggagtatctgtttccatatcaacgggaaggaggaaaagtttgagtttcaaccgaggacggaacaatgtccatggtcagaatcaaatacgggccaaacccgcagaatattcaagaggtcaaagtggagccgcccaagacggacagcctagtgaaattcatgcaaaacttcctggagaaggaaacaacaatacccaggaaccgttattggaggacgccggtaaaatcacctgtatcggccaagaagttagagcagccggctcagaagaagccgccctctgcaccaaaaccaaagaaggtgtggaaggaaaagccaaagatgcccgctccatcacctccggagacgggtagaaaatccgcgcactaaattggaaggaggtacggtcttgcacgtcggactttaaatgacgcgaccttcaccaacaggcaaattggtatgtatccacatatttgctttcaacaatttgaatttttgcatcatcacatgtttgaatttcaaaattgcatttagtatttttgaattttgagggaattcttcaaataaatttttcaaagcaaaccaaaataaattcattgtgcaccgaccacactgatcgttggaatcaaacggccgaaagtggggccggttgggcccaccaggggttcggccgaaccggccaggccaacggtcggctgcctcttcctttgaggcaatggctagtgggccacacaggtcggttttgaccgttgtgggtgcactacttaagccaaccaaccgggagagggaactccacctcatttcaacacattttcattccctctccaaagtttgctctcaagttcattcaagctttgatagtttccctcaaattcaaatctttagttgcatatatacaagttgctttggtgaaattaaccggcgggtgaaattcttgtcatttctaacccccgccgagttagtccgttcttgcttcattgtgcagaatgaggaggcgattgtctcgtccattcaaggggaccggctcttcatcaagtcgtcatgacgagtctagtacttgttcatcagccgatgtctcaatagaagatgccgaagctacgtgacaactcctgagcgacactgaccttgaccttgtcagtgatcgggagaggcaagcctactacatgctgaatgaccgggagtatgctcacacgcgagaatactcaccggatttgctcaaaaagggggtgcagga

SEQ ID NO: 60565 - DNA, 1168 bp, Oryza sativa
ccctcccctcttccggcagggaggcaggaggcgacagcggcagcattttgttgttcttttttttttaagaatttgcgatacattggatctgagaatttttagaagttgagattcattagatttgtgatgtataatctgtgatgatttttttaagaatttggtatgttttttcttttgataatttgtgatgtgaatatatgattcattgatttctgatgatactttgattttgatttgggaatatgtagggagcaacttgatttgcgaaggagcaacttgatttgaaaagaaacaatgaaaaaaaatggtgaccaaccgggctggcgctgccatctttagttccggttggtaacatcaaccgggactaaattaagatggatttttagacccgattattttacccgggactaatgatacccatttttagtcccggagtcatactctaggttgcaaaaccgggagtaaaaatgctttctacagtcgtgtatataagttatgctatgcatgtgcttgttgtgcttattttaaataagaaaaaaaattgaaagactgacatgtaatatcacttgtaaagaaaacattcgattaaggcatgagtaaaaaacacaaatgctatctcctttagtttcctttctgcacactgcgaagtataattactaacaaccctgtttagttcgcgaaaagagaatttttggatgtcacatcagatgtttgaccagatatcggaaggggttttcggacacgaatgaaaaaaactaatttcataactcacttggaaaccgcgagacgaatcttttgagcctaattaagctgtaattagcacatatgggtactgtagcacttatggctactcatggactaattaggctcaaaagattcggctcgcgatttccatacaaactgtgcaattagtttttgtttttatctatttttaatgctctatgcatgtgcaaagatttgatgtgacgtttttaggaaaaaaaatttgggaactaaaccaggcctttgtggaagaaaagtacatttttcagccacctatctccctatatatgtctcccttcagcttcttggcctctcctatttatatccttcccggataacctttcttcttttctacccatgatctgtcaatcattttattcacacctatttcagaggaaattaccta

SEQ ID NO: 60566 - DNA, 1313 bp, Oryza sativa
acaataaccgtcggttgtgtgggaggccgacgcaatcacgcaaggagtgatgagatgaaggttggaatttggctagcggcacctcaagttaggacagtggggagtagaatggtggtattgttctatgtaagtattggtgttgtgactgcgtcagtgcttaatgacgtaggtgatgccgacaccaacagtgtggtacgtatctagagcatgagttgtatgaagaaacaagccatgtggacatgtttcttttttgacattttaaagctttttttttgttttctttagatttgatgcgtgcttgtattcttcacggagaagtttccttgattcgcctgaaagctcataactccatcattcgttaagatctccttccactaatataatttacttttagagttttttaaaaaaattaggttgacggaaaattacttccatacatctggttgaatccttgattggttgggataagggttgatgaagaaattaaacgaggagtgattggaatggggaagtagtactatagaaatatttatatttgtggatgtatggaggaagtgctcactccatcccattttaagtgcggtcatgagtttccgtgtccaactttgatcgtctttcttatttgacctttttttatgtttagtacatttattattattagatgataaaacatgaatattactttatgcatgacttatgttcttaaattttttttataaaattttcaaataagacgaacgatcaagatttgatgcggaaacttatgatcgcgcttaaaataggatagagggagtaataaacaatgtttgtagttccctgcccaccaaccaaattatcctcagaacttctgtttagttactccacgcgttgactcatgacaatgcacctcttcttgcaaaagaaaaactgatagtgtaactactagccttcctttatgatcagggttagaacaaattataagttttttcatgcataatacaggcataacccgcctttgatgagcatttgcagataggtttgcctttgcctcccttttatagccaattacactatgttttttgtaaaatcatagtgtgtttgattgttattttgtgattaacaattgctatttgagaatattggttttttgatatttggagattattagcaaaatggttttggcaccggttagactggggtgtgtgtatcggtcagaccggatgagaataaacagtattttgaggtgatgagctgatttggctagctaaagctggtcagaccggattgtagcaagcggtcagactagccgcccgcaatctgaccgacgactgtat

SEQ ID NO: 60567 - DNA, 1908 bp, Oryza sativa
acggccgacctagtgccccagcagaagcagccaagaattacgtacgacacagcggttgggttgtgagggataacgtgcctatcagcaaggtgtactggcttagaacaagggcacgtggggattatgacagctttgtcccggaatcagagaaagagatgttgtggaccacaatgctcgagacgttcacactccctgcgggtacggagaacatagtgaaacagtggactcttaagaaaatggtagaacagttctagtgcttcaaggaagaactctacaagaaatacatcctgaaggggctgacaccgaacttcaacacattcccgaagctaagggatcactgggacgagtttgttgcttacaagacagggcaacaagggcaagcgatgatggaccgaaacaaagaaaatgctgcaaagaaaaagtaccatcaccacctggggtcaggccggtatagcgtcgcgatgccgaagtgggaggagatggaagccagcttgattgagaggggtatcgaaccggccaccactaaatagccggatcgatcgaagttctggtactatgctcatggtggaacgcttaaccccgttgatggctccctggcgttcagcgatcagatacgcgaagctgccagtcgactaacagacgcagtggaagcatcttctcagggcacgttccgactcgatagagagaaggatgagctgtcactcgccctgcagactcccgagcatccaagacgaacacgagggaaaggcgtggttccttggaagattggattcaaggaggacatccacacgtacaggagtcggatgaggaacaagagagatactgaggtgaagattgcagatcttaagtacagggtatcgagttacgagctaagcatgcaggaggaggtggcaaggaaggtggatgaacacatggccgcacatcggtgctaggatccccagctgtacattcctcatgtaatagtcagcccctcaggcaatcgtagcagctgcacctcaacgaggcaggtaggatcatagagcatggacgccatgcaaactcaggaccaaaccacttgccccgtcgatgaaatcacgcagcggacaccatgtgagctgcatattccctttaagaaattatcaatcaaggtatgcttgtagttttatgatttttgacatgtacattccgccagttgttgcttacgttgattactaacgtccaacctctcatcacgtgaaggtggcgtcgtgaatggccatcccaatggaccctttagggacttaccactgcaggccgattccagcagtcgaagttgagttggtggaagtgttgacatggattttggcttgtgtcctaaatataatttgttaaattataaactaatatattatctcaaatatagtgcttacaaaaaatatataataataaataagaattttattgggagacagatggtgaagtaatttaattaaattgcggccacaaaataaatggccaggaaataaaatataattcacttatattggactaaaataattttcggcttaaaataggaatgcatatgcgcgttccatataagtagcgtgaacaaatatttttcatgcgcttttcgtcggaccggcgaacgctaatacttagctttctcatcatatccgcatacgaaatttggcctaaaacatatggccatgaagtgggattttctcactgacccgaaatagtcacgccccgaatattttcagaaaaggcgtacccaccatataaaatagcaaaaaaaaattaaaatgtaagccaaaatagatgtttagctagctagtgaaaaaattatactccaaatagtcgcgacttacaataaaaatgcatgttacatgtgcgcccaattaaagggggggtcgtgtatgacattatccaatatttttatctcgacgtcta

SEQ ID NO: 60568 - DNA, 2352 bp, Oryza sativa
tcctctataaatagaggatcaaggctagaggcagagttcgcgggggagaggttccagaaaggttggtgaggcttgagattgctagttcgctacgcccaagtgctgttagtctgctacggcaaatttgctagcactagttcttctgcttcaccaggaaattcgctttgcggcgctggaagaacacgagtgctgcaaggtgggaatcatgctccttcctaattcttaggctcggccattgtgtacgagtcgaggaatctctcaattctcctttctctgctcgtgttaatgtattcttttgctgtgtccttcggttcggccaatgagtacgaaccaaggaattatgttcttgccatgttcctaggcttggccatcatgagtacaaccaaagaaattttttctctttgttgtgtccttcgtcttagccaatgcgtatgagacaaggaagttcgtttcatttgatggcttttaacatgatttcacactttttcctatggtccggccagatgagtacgggcctaggagtggttttcatgcatactcttttcatgtcattctaccataccctttgttttggtcccgttagcgcatacaagcctaggcgagattcttgctctcaggttcggtcctctacgagcggatacaaatcacagatataaacataaattttgcataattcaccataaattaaacaagcacttgcttcggtcacgctcacggcttcgagccgtgttagtagtgatacaggaatagtgatgcataaaatcaattgagcatattaattagcatgcatatttgctaattctgacatgtgttcggccatatttctttaaattaaaatagggcgccattcacttttccatgatcaggaacaagaaatagatgcatggttgcattcgtttaattcccctgagcactttcataaactaaacataaattttgcatacttcaccataaattaaataagcactcgcttcggtcatgctccatgacttcgagccgtgctagtagtgatacaggcatagtgataaacaaattaattgaacatactaattaattagcacgcatatttgctagttttgacatatgttcagccatatttacctaacaagaattaaaataaaatggcgtttattttctttccatggtcagagataggaaatagatgtacggatgcatatattttctccttccatctgtttatctacaaaatgatggataaatcacgaactacgctgagtcatgacagccggctataaaattaaccaacactcgcttcggttacgcttcacggcttcgagccatactagtagtaatacaagtggagtgaaaattataatctcaaaatcatctgcatacatatatttgcttaaaacagtgtatactcgctgcaccatatataaagtgcagtataaaaaataattgatgttcgcacatgcatgcatccatatactctggccgtgcattttccttccaattgcaaattaatccatgtacgcacaacaagtggtgacatcgtgatagtcgaccataaatcaaacaaatgcccacttcggttatgcttcatggtacagggccatgctagtagtaatacaggtgtggtgaaaattaaaataggcaatgcaatgcgccgcatcaaaatcccatgacacgttgataataatggcactaaaataaatactcgtttggctacgccccgcgagtgctcaagaaaatttatcaatttatatatgcgtgctacatataaaaaaaaggtaccgtcacaatgccaaaaaaggtaagctatatgcaaatctgccaccatacacgcagtgatatcaaaaaccaacaaattagtgggcatctaaaataattggacgcccaaaatgaaacatataaatgaaaatctacagaagattctacggctgcgacatctggagctttaggatagattttcctttttagccttttagcggtcatgtaattttattttcttttatgttggaattcctaatcaggggttttctctacggagatgtaattaacagaatttctatgtaaatgtatgaattctggaagtaatggactaacaatttctgattttatttatttattgtatttaaattaaattgtctctaacgatttgcggataacggacctagtgctacgaccgtcccgattttcccgtcgtcaggaagagcgtacgaggacctcgagttggactaccctagaggagacggtgagacgcatctacgagacacaagccacaccattatactatggcgcaagcgctacatcatccttcctaggcaacaagcagcgtctcctgcaccatcacctccggctccgccatctcctccgccacctcctcctgca

SEQ ID NO: 60569 - DNA, 955 bp, Oryza sativa
ttctgacactggtctaactgtggatcagttgattagaggcgcaccaatcctgaaggcagaagtggcatacaagtttgaactcggtaaaccgcttgtcacgcctgagcagcttcagtccctaccgatatagatgtacaagttccatgaacggtacatggaaatgagcgccaagggtagagagatgttaaagagcaaggatcagaaactccgacttcttgcaaagagaagatgttctctggatcgaattcaaggatgtcttcgaactataccatctggacgccctcgacgtctctcttctgagcgcatggattttgtaagtatcgttgagttcgattaatttgtttcgttcaataattagctccttgcatatatgtaaacaataataatttccttttatcattgtagaatggagattcaaagggcctgatggtggggggtgtacgatactgggttcatcgaccgtcggaaaatcaacgtcgaaatgatcgacaagtatgagaaagacacagaggacaatctcgtccatctcctgacgcagcagcatttcaagacattcatactactgccgtacaacacagagtgagtttttactgtcgttcgaacaaatttctttcccatacatataacatgtacattttcatatatcatctctcgcatattgcagattccactgggtcctgttacttttcgacttggacgcatgcaaagtcaatgtgtatgactcaatgaataaagaggacaagacttttgacaagttttttcaactgatagacaggtaatataatgccatctattgctaagtcacggggatttttcctgttgctattatgcggatctcggataataattaatcatagcttgaaactgcatgtagggcttgggatcggttccgtcaattggtccgcgggacttggaaagaaaaacttggacggaggtttaattttccagtaagtac

SEQ ID NO: 60570 - DNA, 1251 bp, Oryza sativa
tttgaggatttttttttattctggtgtcagtacatagctacaaggagatatttgcgacgtgttgtgatacggaggggctgagagcaaaagtgttatctacgtggcatgccacgttggcggtcaaacgcaatcaaaggacgttggaccggggtggtatattaaaccaagtttatgaacctaaacgtgcaattttcaagttcacggatctaagtgacaacaccacacaaatttagggaccggccgtgtattttactcaactacatatatcaaactgttgtacgtaaaactacagttttgaggttgtctattatcgatcagagaactacatatttagaaactataagatataagatttaaagtgatgcatccacatggaaactaatctaaactcatctgaataacaatcgtttccaatgaggatggtgaacaaatccacaatatgaaccacgtaaaatgagatactatcacacatgacatgcggtccattcccaatttttttttgttttctaaattaacgtgacatgtagtgacaacaactagcgctcttgtcctagccacatacataggctgtgttttgttcacgccaaaattagaagtttaattgaaattaaaacgatgtgacgaaaaagttaaaaatttatatgtgtgaaaaaattttgatgtgatgaaaaagttaaaagtttagtgaaatattttggaactgaacacggcgatacatatctcaagctacagatatagaagacggccgacggtccaaactgcagggaacctctgctaggtcctacacatgcccgtaggttctagctcagtctactacttctttcctacataagcccaggccacggaaatcaactactgaccgcagattccatacgagaacccaaaaatatgggtgacatacggcctgcagcgcagggtcatcggcccatacctccgacgctgactggacaacagtaagagagattctgaatgtgcagtgtatttgttttccaatgccaaccattcttggtgttctttttctttttcttctgaagatgaagataaagattaagttttttacgcaaaacaatgtgatattaacgtatgattggttgagttttaattattgcaaacttgaaaaatagattaatatgatattttagagcaactttaatatagaaaattttcgcacaaaacataccgtttagtagtttgaaaaacgtgctacgaaaatcttaatcttaatataactcttgttgaagaaaagaacgg

SEQ ID NO: 60571 - DNA, 1553 bp, Oryza sativa
tacttaaattcaaatttgaatttgaattcaaattttctatatatagtatttctatacatctaaagtttatacaccaaaggtttatagacctaaagtttataagtcaaatattaaatttaaatatttatggtgtagtaggaagagaaaaaggggaggaggaaggggggagaggagggagcgttggagtataggggagggcccccagcgattacccgtccattagttgtcccccctttcacctcacccataagacaatatctatttatactaagcggtgtggatctagaaaattaaataagacatattggaacctcaaaaaaagggaaaataaaacattggtatcataacatgttattttactggtgccatagcatgttaatcatacttaaatcacagtgttaataattctatgtataataactttagctattgagtttcctaaaattaagtcatcgctggatcatcctttctccaatagatttccacgtgcttatactaccacctaagcgactgataataaaatatgttattctaatagtagttgatctcttcagtaatggcttagatcacgtctaccggtggtaatactagctagtagtagaaaacacacacacacacactatcagtagaaacaaccgtttaagtattcggttcattttgttttgtgtgttttttttataacgatatataatttgtgtttatatactatgcagcggatacatgccaccagaatacattgaaagacgccaaatcaccaagaagtttgatgtattcagtttaggtgttataatcatagatataattgctggaccttcgggctactctaaatgtgctgaaatgacttcccaacagtttattgaacttgtaagaaaagttccattttatcttatatcgtgaacaatagttattttagtataattaatttgtactgtatgcacgcatgcttacataccttctctactgtattgttcaattttgaaggtacaaggaaactggaagaaaagactgcatgcagcaacatcgaggtatgcatcgcaggaagcagatagcctacaagtgaagacatgccttgaaatagcattaagatgtattgataaagaccgagcaaaaagacctactataagcgatattgttgataaaatgaatgagatcgataccctaaaaatgtcacttctaagcaaggtatattatctccaaacttgtttggtttcgtactacaccaaaataatgccaaaatttgataatgctaagttttaattatttttttgactgaaaagttctaataattttgatacagtaatggtagaattggttattattgtgtttagtaatttgttaccaaaatattataatgtgatttaggtgtatatggtattaaaaaccaaaccaatgtttattcatagtacgatacccctccatcccaaagtaaactcttagtttttcctgaggagattcaggatagaggaaaaagactataatacccctcattaaatgtgatatttggggagttacatggcagctggggataattaagactaagtgaaaattaaatg

SEQ ID NO: 60572 - DNA, 3206 bp, Oryza sativa
gtcattgtccaaaacatcaattaaaataaaactagagggagtagtgatctattgagacaaatttcagatgctaaaagtggccttttattttgggacgaactagaaaattttgaattgtttaattaatgcattatatatggtaccataaccacattttatagtcctacaacattagtaatatctctatggatcttcgttgcagagacctgagcctagggagtttcttgggttcgaccctctagagctacgcttcccattcgagactaacaaggcgatatcctgcgtactgcagctaacaaacaagtcagatgacatcgtcgagttctatgcaaacacaaacaagaagaagtaccaaatacacagggaccaaggagttatggcaccatggtctaggtgctatgtcatcgtaacgctgcaaccacaggggagcgcaccaccgaacatgcagtgcgacgatatgttctttgtacggagcactagggtgagggagacagacatcggctcacttgacattaatgtcactgagcagcacttggaaaaacagatgggtgaggttaagtcattgccgattgtctttgttccaattcctcagcctccaacaagtattgcggattaaacggcatggtttgaggcatcatggagtaacatcatcaatttgtgtcggcatttgatatgcttacaaatatttaagttgttcgatgagttacttttttggaatttcaaattcactactcgatgtgatgttcaaaatctcgtaaatttgtgagaacatatgtatcatgtttatctatgtaaaatcaaagtgttttttattcttattctgtgataaataaattggtatatatgattattggttctgatatttggagattactgttgtttgctaacaataagtcaagttggagataacttgtgctcaaaatatggtttctttgtttgattcatgtgtaggtgacttgatgcctcgggagagtattgccggtgatggatcgagagtcgacttggacataagacgacgtccggacggtcagatatcatgcgggatacttaggctagagttcaatgcgcgtggttggtgaagatttcatatggcatacaatggagatattgtgtacgtatgggatgcagagtcgaatttggaaggaatccaaatttggtacaattggagtttgtgaagtttatttcttgtatgggaaggtttcttatgaggattaagacttcttgtatgagtttggttcgtaggtatagactgtctacctcatatataaatagagagggagcatgaggcttcttggtatcgcttttgaaagcattgagtttagagtaagagagttagtgtttcgagtttagtcgagattttcatgaagagtgctgttgttgcaccttgttaacacggagagaagtaataaagttgtcatctacatatagagttcttcgatttgtgtttgctcgggttcggcggtctaaccggcgagacaccagcgatcagaccggcggtatcgcagcggtcagaccggcggattcaaggcagtcagaccggcaatggcaacagggagcagaggcgacttcagggcggtcgaatcgagcgttctacatcggtcagaccgacggcttccaggcggtcagaccagcacgactacttcggtcagaccgcgatctgtcaaatttgagggtaacttttaatttcgctaaaagttttggtttttcggtacaccaaccattcacccccctcgggttggcttagttcttgctattcgatcctataagtggtatcagagccttgttttcttctttggattttaaccgatctagagttttagccatggctaacaagttgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggggcttcagctccactccacaggcaaaactcaactggggtctgagccttggtcttctaactttgtcttcagctcagaagcactactcttctgaaaagggggaataaaagcaaggctgagtacagccaccgtactcagcaagccacaccaacgatgcagacatgcaaggggatacaaggaggggtttgtggctatttgcataaaggcagttgtaaaacactttattgagcaaaacagtaaaacggttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagttctactctgatcagaggtgtacaactgtacccacaagacacagccccacgacacgtttccgtgcgccgacatgccaccacgacataccggaaagaggccgtgacaggacccttcgcataaccccctctaactaagcacaccacacctcaggtttcacccccactcctcgcaaggcagcgagcagtcccctctcgtgcctaggtgaatccagaagccgcatagaccgtcgcagggcccatccgaactccatcacgcccacccttgcctggatgcgtcagctagaggaaagctacactacaagcccagccgttgcccacgctggcttgtggtaagtacgataagtttttccagggcatcccgcgaactggtccttaactgccatgggtgcgaccagcaaaaccatgcacccacagcccaccattcagttgcattttagttggataattacgaccatgaagcatggccagatgtctcgagcacgcagctcattctgatactaaaaaggtctaatactataattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaataccctgaccccatgtaattagcaaaacatgcatatttatttgtaaacggtaaaacatttataaattgggatcaacatgctcaaggggagt

SEQ ID NO: 60573 - DNA, 3933 bp, Oryza sativa
aaccgtgttccggcgggatcctggccgtgaaaagcggcggccgaggtgctcctcggcgctgcgaagcgagcggcggcgacagcgcgacttggggtggctaggagcggcgccaagcggcggctggagtcggcggcggcggtggaaggaggtggtgcgcgtggcgacggtgcttcggaggcggggaggggaaatggagcggacgccggggtgcggcacgacgcggcgaagccgcttgtggcggtcgcgcggaacgacggtggtgggagcggctgtggcgaccggctggagggtcgtcggcgagcggcggcgggaggtgcgacggtggcggggtggttttcgtgcacgggagggctcgggagagaggggaaaagggagagggaggtgcggggaatgtttttataggggaggggaggccggattgagcccgagagaggtagaaaccggccggcgacgtgggaggagagagagatgcgggaggcggcgacgtggccggattttgcggggagagtggggggaaacggcgcggacgtgggcgacgaccgcgtccacgcacgcgcgggagagggagtcgcgcgggagaggcggcgacgtgggaggatttggcggccatggcggcggttggggatggagctggaggtaggagatgacatgtggggcccacctgtcggagagagggggaggggaaaataggctagggaggaaatgtagacttgaggaagagagagagccgagcgggccgaggaagggaagcccagcctaggaaggaggaggggaggaatttgggccaagcccgaaaggaaggaaggggaagattattttcttttctttttattctaattggttaaatgaactttgtgctatttaaaattatttcttgagctccgaaaattcacgggaaatttcagagagtattttagggaacaaagaatattgcaaaatattcccggccaatgatttttaagggaaaattttaattctcccattaattcactcgaataaattgcttaaatttttatttaatttctaggaaatgcattattaaatgatttttaatcccgaacgaaaatcggggcgttacacaagtttactactaagccccatgttttcgatggttcggattttgcttattggtgtaataagatgcaatcttacattatggctgaggatcttgatatttggagaaaagtttctaatccttatgtgattcctgatcaaattaatactgctgctttaaaaactgaatttgaaaataattgcaaagctcgcaatattcttttgagtgggatttttcgttcagattttgatcgtgtttcacatcctcaaaccgccaatgagataaactttcaagaaacttcaaatattaaagaacttcatcgagatcttttcaaaaaggaatacataaaattttagatgaaacctgaagaagctttggatgacaatcattctaggttcaacaagattttgagtgatcttagatctgtagattctgcttatgatattaactactcacaatctaagatttctcgacactttttgattggtcttgacatgtatatttgggagatgaaagttacatctattcatgagtctattgatatgtccactctgactttggattcgctttacacaaaactcaaaactcatgagataaacattctttctcataaagttgattctaaatctagtgctttgatttcttcctcatcttctttggatgttggtgcttcttcatcaaattctactactcttactttgattaatgccatgtccgatgagcaacttgaacggttcgaggaggagaacttggttttagctgctaacaagatttctcgagctatgaacaatgtcaggaacaggaaaagaggaggtccaacttgttgcttcgagtatggagcacttgatcacatacgttcgcattgtcctaagcttgggagaggcaagaaggttaccaaggaagatgaaatcaacaagaaggagaagaagaagagtctcaagcagaggttaatccgagaactcatagaagcttttgatactgatgagtcggagaatgaagaagagagcaaaggtaagcaagttgttgatctagcttttatttctcgtaatgcaaattcagatgtggatgaatctgatagtgatagtgaagaaaagcttagttatcatcaattagaacatgctgctttcaaatttgctaaaatacttaaaacatgttctaatatgcttgatgagaaggatcatactattgagattctaaatgctgaaattgatagattaaaatcttcgattcctaatgatgatgattgcaaatattgtgaagttttattttctgaaattaatgttttgcgagatgtcaattctgttagtcataagaaattggaatctgagattgaaaagtctaaaaaattggagtcttcttttgctcttggatttgctttgcatgctcgtgttgttgatgaattggttttcacaaagggctttttgacaaaatacaaagttgctttttgtgcaagtactttgttaaatttttatgtccaaaaagggctaaacaaaataaagatgttttggtttctcaaaattgttctaagtgctttttgaatgagatgaaattgaaagatgctttaggacgtgctgagcatatggaaaacattgtgaaatctgatgaagtgctttcttgtcccaaatgtcgtaaaagcaaaggtgacatggtagattgtgaaaattgtgctaatttggaaaaagaagtttcttgtttgaaaagttctttgcaaatattttcttatagtaataaacaacttaacatgattttggatcaatctaaagtgactagttccaataggggtgttggttttgatgttcatgaccatttcaccaaaaatcaacctattgttttgagtgtgactgaacatggtgaaattttgacaaaaccaagtgctaagaaaacagtttttaagtctgctggaattttgccctctctttctgcaaatttaaaagaaacaaaaacaaatctttcaaaaccatctacttcacaaacttgtcgtgagaagtatacatgttctttttttttggaaaagatggacatttggttgtttttgtttttgacttgcttttgcgaaacgacgatggcaaaaattgggttttcatgcgaggagcacggccagaccgacactgaccagtcggtcagaccggctgccaggtctagttagaccatagggacactggcggtcagatcagcctcggggtgattttgcgtgtaattcaaatcggaattttgaaagcgacaaggtaagttttcagataagtctggtcctgattttgttagtgcttttgtacctactggttctactggtcgtgtgactcagtgttggattccaaagtttcttattcctaaccccaacacggaggccttgatatcttctcgttcataggtattttgatggcatactccccatgagcattcaatgttgagatgacaattgcttttcaaggtaacatcaacttacttttgaattgacataattttgttccactttcctcattattagcttttcatatgctagtgtttgaggtagtagttttggttaatttgagtgaatgtatgttaattcatgagaactttggtggtatcgttggcaattggatgtctttttcaaaatctttgatttcttcttgatttttcttcagggagaattgaggttaatttcagggagagttagtgctttttcatttatctttttggcatggtttgagggggagtttttgtacctcatggttttatcaagcaaaattagcaataagaaaaattgagaaaagagagctttattttatatatatggtatattcttgtgcatgctagcaatatattatgaagctttacttgtctctagtatagcttgtatgtattctagtctttttatgaggcttagatattgcttttaa

SEQ ID NO: 60574 - DNA, 1898 bp, Oryza sativa
agtgctaagctcatgaacataaatgaacataattcgtatgcttgatgaaatcattgtcaaaagggaggagaagagaagagattgtgcatgtttttcgatcaaggggaaatttctttcttttcaaaagtaagagaagtcttcttttggattttgagcacgatgtgtgcttttgcacgaagtgtgtttttttaccacttttgtttttatttttccaaacaccaaaatatttttggatggatttgccaatgtgttcatcaagggggagattgtaaaatcaaagtgtttttcattcttattctgtgatgaacaaattggcatatgtgattattggttttgatatttggatattactgttatttgctaacaatgagtcaagttggagatagcttgagctcggaatatggtttttttgtttgattcatgtgtaggtgacttgatgcctcgtgagagtattgccgatgatggaccgggagttgacttggagataaggcgacgtctggacggtcagatatcatgcgggatacttaggctagagttcaatgcacgtagttggtgaagatttcatatggcatacgatggagatattgtgtacgtatgggatacggagtcgaatttggaaggagtccaaatttggtacaattggagtatgtgaagtttgtttcttgtacgggaaggtttactagttggattaggacttcttgtatgaatttggttcgtggttttaggctgcctacctcatgtataaatagagagggagtgtgagacttcttggtatcgcttttaagagcattgagtctagagtaaagttagggtttcgagtttagtcgagattttcgtgaggagtgctgttgttgcactttgtaaacacagagataagtaataaagttgtcatctacatctagagttcttcgatttgtgtttgctcaggttcggtggtctaatagtcgagacaccagcggtcataccggcggcatcgcggcggtcagaccgcgacggattcaaggcggtcagaccggtgacggcaacagggagcaggggcgacttcaaggcggtcggactgagcattctacttcggtcagaccggcacgactgcttcggtcagaccgtgatctgtcgaatttgagggtaacttttaattccgttaaaagttttggtttttgggtacactaaccattcaatcccctctggttggcttagttcgtgctattcgatcctacaatctcaatgtgttgatcatgattggacagctctattctacaccccccttagaataactattctacactccctcctatcctacccaaccacctcagcccaccccagccagctggatgcggcaacggtttccattgactgtgagcagtccgggagacggcgcggggactagctgagttctttcccccactttcccaactcacatctctcgttttccacgcatacgcttttcaaactattaaacagtgcgttttttaaaaaaaaattctatacaaaagttgcttttaaaaatcaaattaatctatttttttaaaaaaattgctaatacttaattaatcacgcgctaatggaccgctccgttttccacgtggagttgggttcccaacccgaagcagcgaacacaaccttagagcaagtttaatagtatagtcaactagtagctccaattcatctatagctaatctaatagctcgtccatacaatagttacatactacactattaatattcggtcctacctgtcatacacacactgcgtcttggagtccgtgctagagaagctgaccggatggatgggctgctgggctgaagagtacgtgtgggctgtgctaaccagatccaaaccattgagagtggactgcactgaccaggatcttgatcattaggataggatccaacggctat

SEQ ID NO: 60575 - DNA, 1952 bp, Oryza sativa
ctccatgacatattcgattcttccatttccaccccaaggaccaatcttgttgaacccagcctcatgagaacaaaccacaaaaaaaaattagaaatgaagaagaaaattaatcgagaacagacatacaaaaataacaaattaacttcttgcagtaagttagtaccatctccatctcctctcctcttcctccaattgtttgcacatcagtggtcaattcctcttcatcaagtactgtgggttgtttcggatgaaggtagacgccgattgcatcaatataccagcccgcacgcccaaagaagccaacaatactgtcagtactctttgttggtgcacagaattcagttcctcctccttgtccgaaaggcccgtatatatgtgttttgaggtattgaggaggaagtatatgaggggtagtttctttcagagttttgacgtggatggctcacagttttggaagggattacatcaatgtaagaattacttgcagaggttggtgaccaagaaagtgcatgatggtagtaaggttgatttctggggtgatacatggtgtggtgaggttcctttcaaagtggcctttaataagctgtttgagataagtttacatcagaaagctactatcaaggagatttggaataatggggattggaatacggtactcagcaaaccattgctctatataaataatcccccccagttgctgaagaagatgaagcggatcctgctgatgaggagttcttccaggagcaagccggctacgatgagttttagggtttcggcctagttcccaagtcgcgcctgtgatgtttggtccaagacctggcttccgcttcccttttgtaatgcagttgtgagctcgggatctgtccgcagcccaacatgactgtacctctactctataataaagagacctctgttgctgtgataatctgtcttcctgtgataccagcactgtttcctgggactggtatcgattaacaggttaatttggagcgtcacggggtagttccggtcggtactagttcggggcgtgacaatatataactctagatattgactcccttataaggcccaattccaatatattacagtgcaaagataattctcagcagccagtactcaatgtttccatttattaaatttcttttgagaaacgagacaggaaataataatgcaacaattataccattatacatacgaataagaatactctaaatcatgcaacaacatgtgtgtgaagatcaagcaatatgcataatcaatatgtgcgaacgtagaccccaagtgcctcgacatatgaccttgcgtgaccaaagaagccaacaatttttccgttgctctgcattggaacgtcaaatggagtccctcctccttgaccaaaaggtccatagctacgaacatttgtaacaaatgtaacagatgttacaacacatcgtgatgcacgaaatggacctattgttccaaaaactcgcaccaagaactcagaagagccgaacttaacctgaaaaggagcaaatgaagagatcatcgatcaagaagctagtacgtattttccacaagatagggaataattgatgagcaacatataaagattagcaaaatgggaaaaggttggatcactgactgtatggctcatcccaccaggaccaccccatgggcctatatcgtatttttgcccgttggatttactgtacgaaaatgcaagtgaatcaatgacaacagcactgcagatcgtcacgctttctaaatggtgaggtgccactgccacattgatgtccttaacaattccttcgcttccgccccatggcccaatctttgcaagccgatcctggattacaatccagtaaaccaaaaattaggaaaatatacacaatatatataactgaaaaaattaatactatctccgtttcaggttataagactttcttgctaaaaagtcttataccctgaaacag

SEQ ID NO: 60576 - DNA, 9907 bp, Oryza sativa
aaataattacacatgtaaattaaagccccgtgattagtaaattattacattatcatattctcctctagcacctctttcttgttccatcgtctccctttcattgtgtctacttgcattgctggaatcctgagaaaatggcatcaactcctcataaatattggtaatcctgctcaaaatatatgtatcgtcacgtgtatcggttcattttaaaaattttcagcccatgcaatgcctgttttcaaacaacttaggcccattttgggttggtacctttctgttgatagtgtcaaacttgaggaaattttaacattaacatatttgatgtagtagaattggtactagatggaacccaaatattgatatatagatagtgtaggcaaaaattggcattgaaccaaacatctacatgttactattaaagttgccaaattaaaattttgatagggcaagaattggctttaagatccacaacagtccatataacatagatttcaattactaagcatcaatatatatagatgtggtaatgtagcaaaatggcattttgtgcacaacaagttagtgttctaggcgaaaagagatccattgtgcaagagctcttttagagtgctccatgttacctttgcggtggtaagataatattaataaatcctggtcattgatttttcatatttgcttcgtttattgacaaatacatttccaccacctaattaataaaccaagaataaaaggaaagctagtgccgataagtactctttatgcatgcaaggaacgaattatcgtttatatatatggtacaaaaacaaataaactaccattaaaatctcaaattttgatttattacaagcacttaatcgcgcatatatactttctagtatcaaattcaaattattcagttttgagcattcaggctgtacatacatatatataaagatcagtaagttgaactttgaaaaaaatgttggcgatattcatgtacagtaattcgaatttggaatgcattacataattactttataggcaacaatgttttttttgtggcagtttaattataatttgcttttttttcattttctataatctaatcatacctgatctccaggtgatgctggatcaatcggcagctcagaaggtaaaagcgatggtgacgttctctgaaacatagcatctaattcattcagtctgctgacaacttccgctatcgtaggccttttgtgtcgatcggcttccacacattgtaacgccatttctaaacatgtcttcacttgtcgttgaagactacctatttcctcagatgtatacgtcggcgttgtctgctgaaatcttctactccagttttcatggacctaaggaaattgaaacataatataagaaagataattaatggtatgggcgcacaaaactaattgaggaccttcatcatataggctagatagaaaatttcttacgagctcgatgaactcttgggaaggcatttcaagcagttttgaccgtgccttaggtccttccattatctctattattatcacacctagactgaatacgtcaaacatctccgtgatatgttttttctcaatgtattccgggggcatgtaacctctgcatgatcgatatcataattaagttagcatttttctcatttacataaagtgtgaatagctaacaagattcaacaattaattagaaaataagtatatgctccctcctttctataatatgagggattttagatggatttggcacatcctagtaaaataaatcttgtccagatttattttactaggatatgtcaaatccacacctaaaatactttatattatggaacggatagagtatgcgattaagttgtcatgtttgatcaacttacggagttcctataaccacttttgttgtatgatgggatagtgttttctcaaatagccttgacagcccgaaatctgcaattttcggcacattgttcttgtccaacaatatgttgccaggttttaagtcgagatggaaaatatgaccttgcggtccattgtgaagatagtttacaccctcgcatgtccccttaattatgttgtaacgtgtgcaccaatcaaatccactggattcgtctgtaccataaacaataatttattttcttgagacatcaatttggttaccctttttcttgttaactgcaaagtaatatagttaaaaacacaaaaacttagttttcaaaaaaaaacacaaaaactatcataccagaaagataattgtcaaggcttccacgctgcaaatattcgaagcagagaactctttcctccatataagccaaaaccaacttgccattgtgtgggacaagcttacgtcttgtttcacagcagtagccaactaatcgaacaatatttttgtgtcggacactcatgaggttagtaaattcattcataaatttcacatcatcaagtgatattatgtcgagcttcttcacagcaatctcttccccattttctagtactccctgataaaattaatatctcattttgatacgggtcgatcaattaaactgtagaaaatataaatgttaagcataccttgtaaactgttccaaacccaccatgaccaatttggtgcttcgttgaaaaattatctgtaattcttgttaacaaatcaatcgtaagatcattgggcatcgtatcagctgtgtgctgtaacttgtccgccatgctatatgtatctcaaattgggcctagcttaccttccgtgtccttctttacagttaaaaaggggcaggtctataacgtcaaggtaagtgaatacgtaaggagacatatcattatcagatcaaaattaattgttttaagatatgttacaaatagcctttggactaggtagagttactagataagatgagtgatgctccgatactctctaccagtagtattatactaccagtataaatgatttgaattgtccgttattaagggtaaattagtaaattactaatataatgataggggtaactttgtcatttatttttttttgtctagatcaatatgtgatcatccattccgctaacatcgcttatattccatcgaaaaagcgaaaaaatggagaaaaaaagtttactcactgctaaatagcgattatacctgtacacacctttttttttgacaattttgcccctcaagtttctactaccgctaactgggatggtagtataaatagatctaaacccttcgatcaaatgagatcagtggttcagattgttttttactatcagtagagagcattgtagtgaacatcagattgttttttactatcagtagagagcattgtagtgaacatcaagaagagaatgatatatttgatattttagaggttttatatggtgctctctactggtagtatgaatgatctgagccgtcaatttgtaaggacattaagtactccttccgtcccaaaatataacaacttttagcccttaaaatttgtcctaaaatataataatttctccaccaatattctcttcccaaccaatcacaactctctaccattcacttttcccatttacctccactactcaacaaattacaaccctccaccatttatttctacctactttcttaataaccgtgtccaactttaaaaatgcttatattctaagacggagggagtactttttttactaactccgtgcttaattttgagattcatttactcccgtctgcatttacaccctagcagcggcgcaccaccccctcccccccacccccgagcggcggggcggctaggagcagcgggccggtggatgacgatgtcggcgctaggcacgggccttctccctctccctctcctctccggtggatgacgatggcggcgccgccgagcttgccatatccgccctcggacggcagcgccgctgagcttgccagatccgttctcgctatcttcgtctctcccaggctgctaacgccgccccgtcgagctcgggtagtggactcgccggcgacgaccgccgcccccttgcatggggtgtgtgggggcatcgcatgggggcttgtcctctccggcgatgctctcctctatttggcggcgtcgggcggtggaagtgaggagggcagcgtcggcgtcacgtgtcgcagagtgtgggcccacctgcgcaaaactgacgaggaacttgtagccaaagatggctacgcgaacctgaggaggccgaacggtttgagtacgtggacacgaatattcggttcgtgggagtgaggctgaacgccatatcggcgcactgtaaacgcccttactactgggatgactacgcagcatgcggaacgcgcgccaaccaatcaggcaacggtctgcgcatctatcggtaggaacttcatcgatctcttcccgacggcagccctagccgagcgtgacgcagtctcgccaagtcatggatcacagcctccgcctcccttctatgcgtgccaccgtacccaccggccggcgagacacatcggaagacttagccgccctcaactccatgccgtcgtctgctcgccgttcgtgtccaggacactctgctcgatcggccaaactctcagcacaactaaaagtacaacgcatgtttacaaatttatatatccggccttctgcacactcacttctctatatatactattatacccaaaaacgtttctactatcattaaatcaatttgatcccttagattaaaaaaaagatgaaaggccgtaggttaattatactatcagtagatcgaaaacacggtacgtagaaagcctcttgatattatatatggacggaatcatcctctcaatttcgagttcccctatactttcctctgttctcaagtccatatcctgtgctcagagttctccatggtcgctgaagtcattctaccaacgcaagacaccaacatcagctggtatgtatagggcacgagttcaacaatacgacccaagctctgtaagcaggagcgcaagaggctcctaatcacatctttatcctccgatcgtcccaactcgatcccaattggatggttccacccacaaccacgccaccccctccttaatttgctgccaatcttgttaggccatgtttataagctagcttatgagcaaaaatatctaagcctaaacaaacgagcaatttttctatttggcttttttaaagcaaaaaaacccactcttatatactgttaagccaaaaatttagattggagagcttttttttttcttatttaaaatgagggtacgactctacaattaaacttaattcttcaaagccacttgcttacaaaacatataagccaaaaatttggcttaaaagcctaatcccaaataaagatgccctaagtaccaatcagttatcacgttaagttagctaattaatactccagcattttttttattataagacatttttaattttttactagtcaaaacattgtagcatttctaacataaaacaaacttagatttgataaaattattttgatgttgttgatgttgcgattttttctacaaacatagtattttttacgaaataaaataaaataaaaattaaaacgacttataatataaaacataaaacagaacaagtattatgttattagttatccgatccgactttatgctcccaggtaaacaaatgattagctagacaaaacaatccgtacctcctcaatccaacatctccaaacactagtaattgttaccagcagaagtggagggaccataaatatataccgaatgaaaattttcaccagtattaattgtagccacgacgattaattacattttgagaccatattaaaatagcaataagtcactcagatgataaaatagcgtgacccaggggcggatacaggagtagggcagctagggctacagccctactcctgatcctaaatatgcattgaaatttcattttaaaacttcaaaaattagaagataaagacaaaattatataaattcaactaattgagttctatgtttaaaaaaaattctgactccgccattggcgtgaccaaaacatcccaagatcatcaggaatataattgatcatcatctcatctggttcagtaactagagatcgaacaataaagcaaatgcacttacctggagaaattcaagtactcgcagctctcgccagctcagtatggcgcggggcttggtcatgggatggtgctttatacactgacatattcatacgaggccgatcgatgtggatcagcttgataacgaaattccaaacgttagtataacaaaaaggtcaggcgcggctgagctatattatgtaattaatctacttgattaatgagaaattaaactttggctatatcagatcacacgttattggtcgccgagcttccaaaaagcatccaatatctttattagtatcgaacaacgttaattattgatcagctgggtgtctatattatatactagtatataggagagagatgatggttgactacaagtcatctatacaactcgctcggatgatacttttatattgatttatagccagtagcagatccagaaatttagttcgttggtatcacaacgtgtctatcggtgtcatagcatgttaattatatttagaatatagtgttataatatatggataggtggtttaagtatagcttttgccaaaagtcatcggtgtcacctgacaccgatggtattactgtagatccgtccctgtttatagctagtcattagctctactattaaacttgctctgatggtataagtctactctggtcgtacaagtcagagcttatttttggctgtatatatatatatatatatagacacacacaaatatagaggtcagatttttatttattattaaaaaaagtcagagcttatgtaaagtagtggagatgatatatattttggcatggaggaatcgtcatcttcaaaatgaaattacaaatggccaactgtatggaaccaattgaccatattaatatgaactcaaccattgtactagctagctattaatgaatgatcacagcagctgattgattacttattacgatgttcaacccaaaatagaaacatcataggtaaggcatgcactcaaatcattaaggctttttaatctccaaaagagagagattgaaggattaagtgaacaaggcctaatgtgaagcatgctggacctggaacggttcaatggaataacaaacaaaattaaccctcaggcgatgtcttctttttacagaggtcatatatttacgagaacttttgttgattactcatgtggaaaaatcattgacattacatatttgcaaacctctctataatatacacaatttgttcaaaaatattataattctagataatttttttgccagagattaatcttgaggagaggaaaaaaactttgatgtccttgttaaatgaggaatggttgggaataatgtgaaaaaaaataaatgggaggtaatggttgatgggacaaattaataatactctaaataaataatggtataagtatttatattttcatacaaattttaaatattagacatgattatattttggaaagaaggcgatagacaggatgctcgacgacttactgccagctgggtcaactcatgagagtcgcctgctgcgttctgaagcctacaaatcataatcttgtttgcagggcagcaacttgcttaccttgtatgcggccctgagtatggagtatactccctccgtttctccgtttctaaattttgataccgttgactttttagcacatatttaactatttatcttattaaaaaaaatcaagtaattattaattcttttcctatcatttgattcattgttaattaaatatactttcatgtttgcatatagttttacatattttataaaatattttgaataagacgaacggttaaacatgtattaaaaagtcaacagtgtcaaacattttgaaacggagggagtacttgttagtacatcgaagatttggtcgacagattccttcaacgaactaatgaatcagcaatcatcacttgagctggaagaccgaagcttttaatataacactagtccaaaaattccagttgcattttcacccctttgtttcctcatacggagtagaagtatataccaagaaccctgcatgtatgatgtatctgtttttgtcatatgagcaagacaatgcacgactgtgtaggtgctgtttggtttgctcctacaacttatctaagattgccacattcactactatacaagacatcaaatgtgccagtcaggaaaccctcgttgttgccggttttttcaaccggcaactgaaggcggcattaattagtgcgccgacagcaatatcgttttaaaaaccagcactaatgtggaatcgacgagccaaaaaaaaaggaaactggctcgagccaatacttcgagtcgatgagctcccacatgaaaaaacaaaaaatgatgaacagatcccacgtcaactcacatcaatagatgaataagaacaacacatgatgaataaatctcacatcaactcatgtcgacacatcaacatatttcacatcaattcttatagcaacaaatgaactcctacatgaacaagaacgcatctcacatgaacaacaacaagaatcaatatcaacgcatctcacagaacgcatctcaaagaacacatctcacaagaacgcaactcacatcgacgccgccgccgccggatccactacaggagactccgccgatgccgccctacctgccaccgccgccgccgtcggatccgccgtgggagagggcgccgccgccgccccacccactaccaccgccgctccacacaaccgtcgatgtcgccccgcccgctaccgccgccgacgccattggatccgccacgggaaaggccacccacatggagttagagaaactaggaaaaaaactgttgaactgagggatcaaacccaagacctccttgttcccacggaaggtctcaaccaccgggctatgtaacgatgttctaggattgtaacacacatttatttgaacctctttaaaccagcagtttgaccggtcgaaccaataaaccagtgaaccgagtgcctggtccggtcttaataactatggtgccaagcatgggggaaagctagctggcacgtgcgcgccagcggcacgcacttccgcgtaactaactccgttagttaacgctaatgacagtagattgaaaaaattttcagttagatttgaaaacttttgacttaagatttaaattttaaagtcaaattttgaaaactttcaactcaaattcgaaaactttcaactcgagattcgaaaactttcaagtccagatttgaaaattttgaaaactttcatcttgaaatttgaaaattttcaactcgagatttgaaaactttcaactcgagatttgaaaactttaaagtccagatttgaaaattttgaaaactttcaacttgagatttgaaaatttttaactcaagatttgaaaactttcaactcaagattcgaaaactttcaagtccagatttgaaaactttcaacttgagatttgaaaattttaactcaagatttaaaaaccttgaactcgagatttaaaaactttcaagtccaaatttagaaatttttaagttcagatttaaaaattactagtaaactaatcactagtaaaaaaaaataggaaactaatcactagtaaaactaattacgattttttctcctactcatacggcatcaaactgcgaagaaagcaaaacaagaaaaaaagaaaaacgacggtaggttagcgaaaaaaaatcgcgtgcgcgcgatgcgtgggccgtgtaggccgggagtgcacgctgccggcgcccgcgcacgaattaggattcttgccaagcatgtgggctgaatgaatcatataccgcatatgggatttacttctattgggcttccacctgtgaccgttgagggaa

SEQ ID NO: 60577 - DNA, 2043 bp, Oryza sativa
attggcggccactgggaaagaaacggtgcgtgggcgccggccgtagggaggagaggagtggtgcatgtgagggaggcggcgggagagaaaggagctgtgtgcaggcgccggccggagggagggttggagcggcgcgtccgtgtagtcggcggccggcgagaaagggttgcggtagccgacttctccctctacttcctctcccgccgccgctgaagacgacgacgacgatgacagcgacgggtttgacggcgtcctcttcttcctcctctctccccatctccctgaagatgcacttaaatcccctagtgggttttggtgattaatgacaaggtggttaaagggaactaatgtgtttatcaagttttatacacaggagtttagtcccaaagtatgttgtgatggctaagaatacatggagaccccctaatttgaaagatcttcatgcgagaaggaccgaaagtggttagactaggttttacactttcaaaattgagtttaggaaaaaccgtactattaagaggggtttcaagtgtggttctagggtatacaaagtgctcttagtcatatccatgagtcaaaagatttttggaatcatttttgaaaaatgattttctccccgggatagagaggcctacccgtatgttctggccggaacttccgggcaccgaggtatagcgagaattttcctaagcgctgcccggaagttcctggcacttttacccggaacctcctggcaaccctccagttcaaatctgtgagtaacggctagatgacatcacctagccgttatatatagccaactcgaccccagctcattctttggccattccacttcagttctttcatgttctagggttttctagcctctcctaagctccctttgcttcctccactcaaatctagagcctatcttgagagattgagagaatagatgagagtgtaggtgtgttgtggagatggcttgaagattaggtttgattgagcactttggataccttgtgggctgtcacttgggcttattactctttgagatcttctcctagacggttaggtgtcgctcatgagcttccaaagatcttgtggatgtcccgggaaggtttgtaaaggttttcctcacctccgcaaggaaacgaggtaagtgagtaaagttcttgtgctgagctttcagaggttgtcctaggtagagcaacttgcacttgtggtcttttctagaaggaattgtgagttagatcttggtggtcactcaattctagaaaatgacctagaagtattgagttgaaggctgtggacttcctctgggatctttgcataagtgaggcaaggggttaatcgagacccggctctttggagcacctcaatggagagtaggattcgtgtgatccgaacttcgggaaaaaatctcctttgtctctattgtgcatgttctgtgattgtgcctactagtatcttgtgaactgtattctgtgaatctctgtgcttgttattgcttagctagaaactcattttactcggtgattttgatattctctattgcccggaagttcctggctcaagaactccggaagttccgggctactcatcactgcctagaagttccggtgttcatcaccaggaagtttcgggccctggtaaatttgaccgctgcgtttgtttttgaagaagttttcaggaacgcctattcaccccccctctaggccacatctctgcctgttcaattggtatcagagcctagtgctcctaattcaagcttcaccgcttggagagatccaagatgtcggacgtagggggagatgacgcgagtaatggaaatgaagatggagcgacaagcaagggaacacctgcatctaagggagtcactataccttttgattacagtaaaattaccattccctcacataactttgtctctgtgccttccgggcgtgctcctccatttgatgggacacattatgccgcttggaagcacaagatgaagttacatttaatctctttgcatcctagcatttggaaggttgtgtgtacaggtgttggtgctccaaatga

SEQ ID NO: 60578 - DNA, 1150 bp, Oryza sativa
aacttaaggtgtataaactttagttgcataaatttactagaataggaaagtaatgcggtgctaaaaaaggaaaccaggtggaggggaggaaatctaatctgatcgctgttagctacccctagcgatcaatcgctaggtagcatttccgggtgaaaggtccacataattctattgagacgtcaacaaatatgaatcatgaggttgcaacttacagtgtccctttaatttggcttgtgatatgggtttttgttgtcgcaaagaatcttgacaggcccaaatctgcaatttttggtatcatgcttttatctaacaatatgttagatggtttcaaatccagatgataaataggattgctggacccattgtgaaggtaatttaaaccctcgcaaatccccttaattatcttgtagcgtgtgtcccagtcaagcccacatgattcatctgcacaaagtcactgaagataactcaattgtctgagacagcatggtcgaaaccacttttaagcagattgagcaaaatcgtaccagaaatatgtttgtcaaggcttccaagctgcacatgttcaaagcagagagctctttcttcaacgttagaaaatacaaattctccgttgcgttcaatatgtttcttctttgtttcatagcagtagccaactagccttacgacattctgatggtggactttcataaggttattaaactcctttttaaactgcacatcatcaagaccaggtataacatatagcttcttcaccgcaatctcttctccagtgggcattactccctgttaaagttccttgttaattagtatacaccctaaattacatggattattgtaatataattgttgatttaaccatttcaaaactagaatgttaattgcgttctgtgaccatcacttataatttgtcttttagttggcttgttaattaatattctcgccttatctaaatatttttttgcagaacgacagacgatatccttgtaatgattctactgttttctctgtagatgatggatgattcttaatctatttataactatttgagggcacgaacaaaataaatttactactacctccgtttcgaaatgtttgacgccgttgactttttagcacatgtttgaccgttcgtcttattcaaaaaatttaa

SEQ ID NO: 60579 - DNA, 4671 bp, Oryza sativa
aaattttaaagaaacacaccaaatcaaatcctttgaatgaattaactatgtataggtatttattatattttattaatgagaaaatgaaaacatgtgtatgtgagttttttacggcagtggcatttagttgaatccagatggcatcaggacaatatgattttgcacagattacaatttgacaattcgatcatatgacaatagcaaatatacaaatttctcaaaaatattagcggtgaaataatttgacaatagaggagctatcttataatgagcactatggccaagtcctttttagcttatttactggatatatgaaatgatttatttcttcacgctttaaaaatatgttttcttaaaaagttcctgcttagacatttactttaaattaccttttaagcttattccttaaaatatttaatttttccatctggtcaaatcactgtataatatgtggcaataatgtagctagattatctaaatcaaatggggtagatataccttgtaaacttctccatacccaccactgccaagtttgtgcttttctgagaaattgcctgtaattttttctaatagagcaaatgaaatatcccttggcccttccgacttgtcttccatgctattggcctcagacctacttgacctcttcgctcccacgtccctttcaactaatacaatttttttatgagtacattatacagtatatggttaaaaaaaatgcatggtgcataaacttcatgagcaaaaaatgatgaaaagctaatgaaagaatattttggtcacaaaattttaagagtaaacagccactgagtgtacggaagagttatcccctaccacactagtttgttctttccctagtatgaacggaaactacagtactgattgccttgtaacgttttattaacggaaactattataagcaaaggtatgagattgaccctactattactaataagaatctaaatatatatccaacacgatgcttgtatgatcttaaaatcctagattaattgtatcatcttcgtcttcatgtaattgtttgagatcaataaatctcattttacccaaaacattgatcttatgtattcttataaaatctatcttataatcttatatgttggttcgtctcaagacgttaattgaactaccctaagccgtatgtgaacacaaaacatatgattgtaaaaatacaggaaaaacaaaggaatgaccgtttgattaaaccgcaggaaaaacgcaggaattagatgagagagatagactcaaaggaaagttgtcaagaggttgaagctcttgctaaattttctccaaaatctctataagattgtccattccatagaaatctcaaaggattggatatgattcaatcctttgttttaaagggctccatagaaaatttttctataggattgaaatcttccaaaattcctatgtttttccttcaaatcaaaggggcccttaatatttatagtgtaatttctttcgttgttaagaagagtgggtcctagtcatgtccgctttatttttaacccacggctgatatccacctttttttctttcatctccattacgttttgccacagtcggactcaacagaaagttttgctacaccccaaaagttagcttaagagacaatggatttccccacgatcaaactcatcagcgcacgatcaatatgtcagcccaactagaaagacttaatgcatcccaaaagctaacccattagcgcatgaccgatatgttggtccaatcgggagaaagccttgctgcatcccatcagtgttaaataattattaagtaattattcaaaaacttttgtgaaatatgtaaaactatatgtatatatgtaaaagtatatttaacaatggtagaaaaagaattaataattacttcaattttttaaataagacaaacggtaaaaaaaagttaacgacgtcaaatatttagggacggagagagtacgagaaaattcgaaagtaaggaaacgacataagtgttttaagcagaaagaatatactctgtttcttcctagtacgtatatatctctccgtacgtaatctctagaaagaagaaagaaatctaaatactgaagtagtactatatcagtctatcagtatctcgaaacgcattatataaaagaaaaattccagtatgcaacgaaaaaaagcttggtataagaacagatctatgtcaactaatcgatcggaaagtatataatgcgtgtccaattaacctttcttccacaaatggttaatttgaggggaataagtacctaattaggaacggttggatatccttggtctggccggcatgcaactgcaacggctgacggaggagaaagatcgagctatgtcgtcccggccttggttgctcgaatcctataatactatacaagtgatcctatgtagggtgtaattaatatcctaactatatcttgtatatagaagatgcaaggcgggggtgggtgcgcacgcgcgaggagaaggatcgaattaaggtgacttatcaatcctcggttagaaatttgcctgtcgtggacaagtagacaatgcaagtaccaataattaagcagttgcataattgcatcaacatatcactctcaattataatagataattaatttcttgaccatgatcaagttatttgtcatgttttaacaaataaaaggtaggtgtgagtctttaactgccttttggtcggactataactgtaattttatcccgcacgttttggatgtggatgagtaacacattctcctctccccgaaaaaaaaatctacatgcatgcatacgcaggtgcatgtacgtgcaaatagccggggtcagagtccatgcaagaacccggtgtgggtgctaatctttaattgtgtccacgttatctactaaaacatttagaggtagtgtatacaatacgttatctctatatagtaattaactctaatacacagccacagtgttaatttattcgtccatctactcttcctctctctctccttaattttatcttgaagtttatataaaaattgtaggtagaaaaagatgttgtaagtgggttataggagttgccacctcacattttttctaagttaaaagaaagagaaaaggagagcgaaagaaaacgggttacaaatatgtagtcaacagtaacgctctataaggctttgtggagagagttagctgtaggactaattactactcccaccgtcttataaaatagaggattttggaggaagtcgaactcctatgctttcaagtaaaagcttgacgtgacgcctttggtccaaaatagttctagatgtgtcgcatccctctaaaatcttttatattttgggacagaggaagtattgatgtagtatgaatatgtagctaactattatatagatatgctacatagattaaagatgatatggcaatagatagagtaaagcatggtctctctcctctattctactcttatccgtatcatcaagttcttattgtaatttctctaattaatacttcttccatcataaaatataagcattttttgagtttttcactgggatcgagtaagaagagggatgaaattaaatggaaaggactatgattagtcgagattataggaagtaaatagaggaattgaatgagagatggttgtatatagcagaaataattaagaaagcagctggagaagtgggtatatttataataaaatttgaacgttaaagttgcaaaatttcaagacgaagggttcgagtaaataacaatatgaacatcaacaagttgccaaacctaacgatatgatagtattaatttatccagctaacaatttatgatcctagcttgttgcttcgtaagaacaagagaattgctaggaatcaattggaatactcccaaatcattagctcgcttatgtacctggctagtgcaactaggcctgatatctcctttgctgtgagcaagttgagccggtttacctctaacccgggagatgatcactggcgtgcgcttgagcgagtaatgcgctatctgaaaggtactatggaattggggcttcactatactgggtatcctgcagtactggaggaatatagtgattctaactggatctctgatgtggatgagatcaaagccactagtggatatgtcttcacactaggtggtggtgttgtttcatggaggtcttgcaaacagaccattttgacgaggtcaaccatggaagcagagctgacggcactggatactgctactgttgaggcagaatggctgcgtaatctattaatggatctgcctattgttgaaaaactggtgccggctattcttatgaactgcgataatcagacggtaattgtcaaagtgaacagttctaaggataatatgaaatcgtctagacatgtgaaaagacgattgaagtctgtcaggaaattgagaaactccggagttataacattggattacatctaaacagctagaaacctggcaaatcccttcacgaagagactatcacgaaatgtgatagacaatgcatcgaaggagatgggtttgagacccatatgagttatactatggtggtaacccaatctatgtgatcggagatcctgtgaattagaacctgggaagaacaagccattagttaactacagaagagtaccattctataccttctctaagtgaagatgcatgtactcttgtgagc

SEQ ID NO: 60580 - DNA, 13233 bp, Oryza sativa
tcctgcagcccatttttgtgtctttgggagtaaatgcttcattttgagtaagaagcctcattcatctaagttctcacctaaggtggatgagggattcttacttggctatgagtcaaatacatatgcctaccgtgtcttcaacaaaacctccggtattgttgaagttacaagggatgtgacatttgatgaatctaatgactcccaaggagagcaagttgttgtacatattgtagatgatgcggatcctagcaaagcaattggtactaaggctattggagacatacgaccagtcgagatgcaggatgaccaagaagatagggatcaacctccgtcatcgacatccaatagccctacaacaagacaagtgtcagttgacccagaagttccgggaccaaatgaccggaacctccggaccactccaggccaggaagttccgggtccatctgccaggatgttccgggcaaaggacagtcaaggagtgcctacggcacaagtggatgggattgatgccaagggcactgtaaagcatcctaatcaggctcaagtctcctcggtgcaccatccaaagatacatcacactgtccaaagatatcatcccgtcgacaacatacttggtgacataagaaagggggtaaccactcgttctcatgtcgctaacttttgtcaacactattcgtttgtctcttctttgaaaccaaccagggttgaagatgcccttggtgattcggattgagtgatggctatgcaagaggagtttaataacttcactcgcagccaagtatggatattggtggagagacccgaccaaaatgtcatcggcatcaagtggatcttccgcaataagcaagatgaacatggaatggtagtaaggaacaaagcccggttagttgtgcaagggttcacccaagtcgagggtctcgatttcggtgaaaccttcgcacccgttgcctgccttgagtcaattcgtatccttttagcctatgtcgctcaccatgatttcaggttatataaaatggatgttaagagcgcctttctcaatggacccatctcggagttagtcttcgtggagcaaccacccggattcgaggatcccaaatttccacaccatgtgtacaagctccacaaagcgctctacggactcaaacaagccccgagagcttggtatgaatgtctccgagattttcttttgaaaaatggttttgaaattggaaaggcggacactactctcttcactaaaaagtttaaaaaggatttattcatttgccaaatttatgtcgatgatataatatttggttctactaatgcctctttttgtaaagaatttagtggtattatgactaagaggttcgagatgtctatgatgggcgagataacgttcttcctcaggctacaagtcaagcaagcacaagatagtaccttcatctctcaaaccaagtacgtgaaggacattctcaagaagtttgggatggaggatgccaaacccatcaagactcccatgcctaccaatggtcaccttgatcttgatgaaaatggtaaatgtgtggatcaaaacgtataccgctccatgataggatccttgctttacttatgtgcatctcatcccgatatcatgcttagtgtttgcatgcgtgctcgctttcaagcggagcctaaagagtgtcatttggttgtcgtcaagaggattctaagatatttagttcacactcctaacctaggcttgtggtatccaaaggggtgtgggtttgagctcttgggctattccgattcagattacgccgggtgtaaggttgatagaaaaagcaccaccgggacttgtcaatttcttggacggtcctttgtgtcttggtcatccaaaaagcaaaattccatagccctatccaccgccgaagccgagtacattgccgtcggttcgtgttgcgcccaactcctttagatgaagcaaacacttaaggatgatggctactccttctccaaaatcccactcctatgtgacaatgagagcgcaatcaagatagccaacaatcccgtgcaacattctcgaaccaaacacatagacattcgtcatcattttttgagagatcatgaaaccagaggagacattaccctcacccatgtgcgtaccgagagccaattagccgatatctttactaagcctctagatgagaagagattttgtgagcttaggagtaagctaaatgtattggattctcggaacatcaagtgatgggtggttggctgaccaatagccaaacatgagttactaaaatgtaaattaaaaaaaaatatattttgagcccttgtgtccttgagatcacttccttcatatgaagttggccttgacaccaggaacaaggctcaaacattccctctatcctcaaaaacccatttgtcaaaaagtttgcgaaaatttttgtgtgtctttttattgcgaaatttggtttttatcttctccttatgatgtatattgaccattgttttgtattgattgattgattggctggtcatatacatcataagcctctgcatgtccatagttttccattcctcagtttgattccttccctttaccttgtttttgggcctgactgcccattttctgtcaggccagaagttctgggcctccctgtccggaacctccgggtgttggggagtatatatactcagggggagttagaaccctagtctctctcctcattcttctccctccccgactccaatccctgccgccgcctacagtaaccctaggggcgatttccattttccaccaatcaaattcgctttttctccgtgaaatcgtccacattggtggctgggagcttccctctgcgattgattcgcagtttcatctctcaaggtagcactttttgattccatctctcggttcattgtgtttttagcccgatctctaaatctgtgaacctagggagaaaaccacttggatagtcttgtttctgctaccttgtagatcaccgatctataggatttgttcacatgcactagctatttttgagatcactgttcttctttttgctggccgaaagttccggtgttcttgcacccggaacctccgggcgctatccagccagcctgccattcttgattctctcaatttttgcctaactactgcactccaatttgttgattcctgttgcagtaaacattatgtctcgtgagaaaagacagaaagcctctcaggatgtgtccggtgatgagagtcctcctattcggttccctcgaggtcgtttgggtaaagagaaagtggttgagggaggcagtggcagtggtcctcgtacttctcccaggttcacaaggcagtccagcaaccgtcctctttagattcgggatgttgacggtggtcaaggcagtgatgcttctagtgcaagaggtcgtgggagaggtagtggtcgcagttctggggctggaagggcatctcacaatttccctgtaggatctcgtgagaatcccattcggctctacaagtctcttggatttgacaccactcccatgcaccacattggtagagccaagtccaactatcttcatcagcttgccaagtgtagaagagaccatttgattgatccagagacacagcctgaggagtcacaggatcctcgcttcaggaccttcactcagttggattggtataactcagtgattatggctagagaaaatccagtggttgagatgaagtggattgattgggcctacatgaggaagaagagcctagttctatgcgacagcattctttggtactactaggaagggtactccatgtgtgaagtggttgactgagggtgttaggcacaagatttccatggcacagcttgctgagatgttgggtttggaggatgaggatctcaataggcccaatattcatagtgaagcacccctccccatgatcaaggtgttgtactccatctttcgttggtccttgcttccaaaggttggagatgccactgctttgccaaccaagcatgctcatcttctcagccacatgcgctacaatcagcctcccttcagtgtgatgaagtttatttggtatgagattgctaacaccatccttgagcctaagcagggttgcatctatgctccttacattatgaagatgatcgagactgttatcgaggtgttctacatcaaagatgggcgccacaatccttttcgccctcgtgctccatcttcctcttctccagtggtgcctagatccattccttctacctcagctggtccttcttctagtgccccacagagttcctctagttcttctcccatcaagaaggctcttcacgcaattttttgcatgtatgctaagactgccaagaaagtgaagaagatagaaaggcgtcagaaggaagatagaagagaggctgggaaagaagtgtcagatgattctacagatgaggtctatgttgatccatttgaggcctatgaggcggcccgcaacattgctggtgaaggtccatccacctacttccatgaagaatcttcccattcagatgatgatgatgatgatgatgatgatgatgatgagggtatcaccgaggcagctgctaaggatgctcccacttatgttgataagggcgactccgctgcacagtccgatacgtctcatctctccggtgataccgagattgttccctctgatggagatggagatgagtgatcctcttcttctcttcatggtttctcgctttttggtgccttgatgccaaaggaggagaaattgtgacgtgaagggggtcatttgaatctttttttgctgccctgactgctgtctggtcatttggccggaagttccggctcttgtgacccggaggttccggccaggcagatttcccctctatcactactttctatatggacatgtaatcgtattctattatggttggatgtaatgactgttagatgctttattattttttatgtcagtcagttatctcatatggttgttgcattttgttgtgatgtagtgttcttttatctttttgagtgattgccatgtcatctagtcattttatttgcatcactcatcattcaagcatttacatctgcatctcttatttgataagtgttgtgtgaagtctctcttgtgctttccttcatgttatgcatattgatttcatatcatttctttatatgcatatctttagggggagcttcacacttctcaaatcattccaaatttaaaattctattatctttttgtgtgctttaaccatattgtcatcaatcaccaaaaagggggagattgaagatgcacttaaatcccctagtgggttttggtgattaatgacaagttggttaaaggggactaacgtgtttatcaagttttatacacaggagtttagtcccaaagtatgttgtgatggctaagaatacatggagaccccctaatttgaatgatcttcatgcgagaaggaccgaaagtggttagactaggttttacactttcaaaattgagtttaggaaaaaccgtactattaagaggggtttcaagtgtggttctagggtatacaaagtgctcttagtcatatccatgagtcaaaagatttttggaatcatttttgaaaaatgattttctccccgggacagagaggcctacccggaggttctggccggaacttccgggcaccgaggtatagcgagaattttcctaagtgctgcccggaagttcctgacatttttacccggaacctcctggtaaccctctagttcaaatctgtgagtaacggctagatgacgtcacctagccgttatatatagccaagtcgaccccagctcattctttggccattccacttcagttctttcatgttctagggttttctagcctctcctaagctccctttgcttcctccactcaaatctagagcctatcttgagagattgagagaatagatgagagtgtaggagtgttttggagatggcttgaagattaggtttgattgagcactttggataccttgtgggctgtcacttgagcttattactcttggagatcttctcctagacggttaggtgtcacccgtgagcttccaaagatcttgtggatgtcccgggaaggtttgtgaaggttttcctcacctccgcaaggaaacaaggtaagtgagtaaagttcttgtgctgagctttcagaggttgtcctaggtagagcaacttgcacttgtggtcttttctagaaggaattgtgagttggatcttggtggtcactcaattgtagaaaataacctagaagtgttgagttgaaggctgtggacttcctctgggatctttgcataagtgaggcaaggggttaatcgagacctggctctttggagcacctcaatggagagtaggattcgtgtgatccgaacttcgggaaaaaatctcctttgtctctcttgttcatgttctgtgattgtgcctactagtatcttgtgaaatgtatcctgtgaatctctatgcttgttgtagcttagctagaaactcattttactcggtgattttgatattctctgttgcccggaagttcctggctcaagaactccggaagttctgggctactcatcactgcctggaagttccggtgttcatcaacaggaagttccgggccctggtaaatttgaccgctgcgattgtttttgaaggagttttcagcaacgcctattcacctcccccccctctaggccatatctctgcccgttcactcccatctcctttctctaggagcccacgggtcacgggaggttcggtggctagcggcggcagccccaggccacggccagcggaggtgctcctgctccggcggctacccctgccactgcctccacaactcgcggatcctcctccacgtgcctcgtcgcgctcgagctccgcgcaccatggccacgcgccagcagctgtagcgctgtctcctcctctactaccgccgccaccggtttccccttggcgaaggcgggcctcacgggcggagaagcgtggccaccgccacgccacgggccccctccctccgtggcgttcaggtcgttgtcgtggccgctcccctcgcgccgcaactgcgcggggacctcgtcccttccgccgccgacaccaatggatgcggccgcgcatggcgggtggcccatgaggaggcgatggtgcatggaggtgatgatctcccacgccggtgccgtcggtgagttcaacattatcctcggtgcccctctcccttccctccaccactaccaccgcaacccatcgcggacagcgccaccgccaacgacgacctgaacgccgcggagaggggcccatggcgttggcagtggcctcgctcctccgcccatgaggcccagcggattgccgccattccgcgcgccgctgctccagccaccgtcgcgccactccgcccgctgccacgtcggcttcgcgtgctgctgctccgttccgcacgccgccaccccagtccacattgtagggatgaagggaggggagtgacgatgacacgttgggcccgctatttttttctgtgaagctgacatgtgggtcccatggttttgttatttttccggatcgaattgtcacgtaagcgtcacgtcagtgccacgtcagatgaaaaccgggtcaaaatagccacgtaggcgccacgtcagccaaaaccgccatctaaaccgctgagggaccttatctgcatcggttttgataattgagggacccgttatatctggttttgaggttcaaggacgaaaatcggattcgttgacgagtcaaagagactagaacgggattgcgggctgcgtgacgagcatcttgggctaaatttgttgataggcttctgatgggtccaatatgcgccgtacaaatattgggctgaaccttcaagtgcggtttagaaaaggccgaaaacgagatggtcatgaatgcgccgggtctgtatctctctctctttctcgaggttgaaaactggagtagtatttttctgtttccagttttctgcttcttcgcttaaattctgtcaagtcctctctgtcaattcaactgtgaattgttctttctgaaaaagaaaaatcgaaatacatcaaaaggaagcgccgtgaggcgcgggcaactactgtgtgtcagtgtcaagcatcctgttagggcaagtactggaagcccctacatattgcccctaaatttgccatacataattagatgatgaggtgtatgagattgagccacccctcatgcaaggggcaacctttacacaatctccaagaaaaaagtgtaagatgatgtgagtgtgagctaatattggagtttgtatattgggagcgtatcttatgcacacatgccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattacaaccttaaaactgtcagattttttgtttttttttgttacggctaaaatataatgaatttgacgttaagattttaaccctaggtgtaatacaattgaaagtatgtgtatgatttttttctagaatttttggtgacattttttagttgatgtgcacgtgtgtacacgtgagggcctgtgtgcataggatatgttgccttgtatattagatgtgatatattatactccctccatactcataaaggaagtcgtttaggacagcgacacggtctccaaaacacaacttttgacttcttttttctataaaaatacttattgaaaaatgatacatatatacttttatgaaagtatttttttcaagaaaaatctattcatataatttttatattttcgaactcaacaacttgagagttattcatttatattcccaagatttaacttaaacattgtcataaacaacttcctttgtgagtatggaggaagtatgtgttacctcttaattaatgagaagatgacatattctaaattaaatgtgacatctacctccactataaaacaacttgcccttacgtgccttccctctcattctctcaaatctcaaacccgacaccagcaagttgagacagtgacaaaaggtagtactagattttcgttcaagactgaaaacctctagccggttggttaatcctcgtatcacaggatgggtgaaaattaaggcggattagttttacacctcaatcgtgtttaaatctccccttcaatcacccatggcggacggattaaccaagtactatctctgttgcaatatatatgcaagtcgtttagctctctgttacaacgacttagtacatttccgtaacagagggagcatgtcaaatgtgtcgttcagtaagagatgcaaggacaggtaataatttgatgcccacgtcgtattcaacattctatcgtctccgtttccacgtgtacaaccaaacaattttaacttaccctgaaattgttaaagtttgtgtcgaatatatatacgtagtcgtttacagtttagggcttaaaattgtactggtgttaggactaaaataagagtcggactctgtcataggctttctcataaatagagaggcatgcctgttgtatctgcatggcacctacaatatagcgtatacacgcagggagatgataacgatgtggccatggactcgtagcgactaggagatatattagatcggggaggagcgcccgtaatcagtgccccgagatgtagacatcggctgaagctcgttaacaaatatcatgcctcggtgtcgtcttcatgtttggatcttctatgatgtttctttcacgttcggttttcgaatttatatcgggccggttttataacagaaatagtgctagattagtagactatatagccattaatttctctacccctttctgagctatatattttcgagagataagatggtcctctgcagtactgtatatgcagtagtactacttgctgacatgtgggccccacaaatcctcataaccaaatgtaaataagcagtattagtatatgcaatacggcagagaatctcaattgcctaatggttactgtagacgtgcatactgcatgtgcagtagtactactcgctatcacgtggaccccacagaccctcggaaaaatgtgaaccttgcagcggctgcaattgtgcagctgcatgcccataaagatacctcccatttaggggcggatgtaaccattaggtaggatgggtcgaccgacccagttacgacccatgtcgtccacaccccacatttaggtatagcaaggcgtgaacacccaacagattagtccatctcttcacaaggcacgcacgtcacaaacaacgattgaggcagttatgcgattgaactataatacgatatttgttgtgttagattgctgttatcgagtgaatatctcccttctctgttccatctatcttttaaagttgtgtccgccagtcccattgtatggctgccgagtccacagtcaatttggccacatacatagtgtgcatgctcgcccatttgtacaacatgatttctttgcaagcaaattaagtctttcttgccatcccgagggccttaccgaaattttgtcatatttctttcaataaattgtttagcatgcaatccatgctttttaagaatgcacagtacaacgacacaaaatcaacatacaaagacaattctcggagaaaaccaaagcgacaagagaaagaaagaatatactttatgtcattgagttgacattgtccttttttataatatgcccatgagtttattagttcttctataatatgcaattgggttgtatcttattttcaaaaatacccaaaatacccttatatacatataaggttaactattcatttatcctatcagaagtttcaaaaaaaaatatgaatgtttttagtctctttcatgattcttacatttctgttttttttataaatataatttatctgttatatgttatgtagaatatttttttatgttttaaagtaaatcatctttcttatgctacatattttttttgtactattgtatttttataagctattttactctcatatatcacaggaaaatgactttctaaaaaaatattaaaaaacttgaaacttacataaaaacttttatgttgtctaaggaggttaccataaaaaaaatctgtatattttttaaacttctaatgcgattaatcaattattgatcttgcatgtttttaatgatattttgggtgtttctgaaaaaaaaatagcatgttatagatcaattgataagctcaccagtatattatataaatgtgtaatgttaatgataaattattaaactgatataaactcaatggcatagatcgaatgaattccctcaacggaaaaagagcgtagaacaatgagctacaagtatgtgcgaatatagaccccaacggcctcaacacagggccctgcacggccgaagaagccaacaatgctggcagcatcctccaccggaacaacgaatggagttcctcctccttttccataaggtccataggtgcgattgagattcgtcgtgaacttaagcgatgttatgacattttgtagcatgccaaatgaaccgactgttccagacagcccctttatatgctcaaaagctccaagccgaatctgcgtcaatgaatagagatttttttaaaaagaaaaagtagctaagaaggtattgagaggtattatattttcaaattatgtattatgtagctccaggtaactctagcccacagtccacactagaaaagaattactagaagctaaaggtagtacaccacaaattaaccctaaaattataccttttcaaaaaaaaactaaaattactcaaataaatactccctcgattttaaattaattgttattttaacttttcttaagtaaaagctaaaaactatctttgactattatttttttaaaaaaaaaatccgtatagtttaacagtttgggaatttcataatgtgaaagcttttctcatagtttgtcaaaatcgatgatcaaagatacaagtttaatttgacttagaacaaaactagattgaagtaatttgaaatggagagagtattaggctacttcagtttttacaaaaagacaaaacgatgacatcacacctgtccaataatagaatgtgttgaataaaaagcatgcatgaataatcttctttcaaaagtaaaagaaaaaccttattttaggattccttcactcaccgtgaaagcagcgccaccatcaccgccccatggaccaactgtatgttgcttcccattatggtcgttgtatgagaaggcaagcgagttgatgatatctgcactgcaaattgtcaagctttctaaacggtgaggtaccacctccatgtcgcgatccatgtctccgctgcctccccacggcccgaacttggtaagtgccttaccaacacaaatcaatcaagtaaaaattggtcagcctgtaaactttgaggatgatcttttttttttagaaaaaaaacttttaatgatgacaattatgataaattaactagggtgaaaaagaaatagtacatcatcatccccttttcctctttcctcttgaattgtctcatgctcggagtttacttgcaacgcatccctaaaatgtctgctcaaatcaagagttggtcgattgggactaacatagacaccgatcgaatgaagaaaaccccctgcacgaccgaagaagccaacaatgcttccattgctctgcgaagtgtggaaagcggttccccctccctgtccaaaaggtccgtagctaccactatttgtgaccaaggtaagtgattttacgacatcggccactgcacacacatatgggccagttgttcctgaaatttctgtcagaaattctgatggcccaaattgaacctacaagaggtaaaacaaattgttatgcttgcagtattgtggagatagttaacatcatatccagcatattttaaaaaaaaataataataacttttgggatagatatgttttcttagtattaggatgtgtcacatatagtcctaaattcgtttttttttggacggagtgagtactcactggtggagaaaccatctttggtcggtcgaccaaattccacgatattcccggttgcaataaaaaccgggatggttgaaaaggttagagctactttttaatctttagtcctggttggtgttatcaaccgggactaaagattatttttagtcccggttcaaaaaaggtaggtgatgtcagaccccccccc

SEQ ID NO: 60581 - DNA, 8063 bp, Oryza sativa
tctttagtacgaactgggatctttagtaacaccgggaaaaaagatcggcatacgcggagagatcgaggcgtgtgcgtgaatcggatcgagatacatatctccttctccctcccggttctatctcctcctctcctcacaccctatctcttcctctcctcccccttctcctctcctccgatccccttctcctccccatcttacgcgcgaaggatcctttccttctcctccccctcccccctcctctccgatctgcaggcggcggcgccggcctgcacggcggcggccgggcggccggcggaaggcagaaggcggcggcctgctcagcggcggccgggtggtaggcggaagatggcggcttgcacggcggcggccgggcggtaggcggaagatggcggcctgcacggcggcggccggcaaggtgcagatttgttttgtttttttttctttgagaatttgtgatccggatctgagatgtatttgatttgtgtgtgatgtgaatatgtgatgtatttgtgacgaattttgtagaagttgtgatgtcattttttttaagattttgtgatgtatttggagatgatcaatttgagaattttgaggtgataattgatttgggattttagggatggagatggggatggagtgaaatcaatatattaaaaacaataaagaaaagaaaagaataaatgagcaactgggatcagctggactctatctttagtccctaaaaaggctctatcttcaaccgggactaaaaatgaatttttactcctggttatttcacctgggaatctttagtcccagattcgtagtcccgattagaaaaccgggactaaagggggttaagaaccgggagtaaaaactacttctcccctactgactccatatatcttggaaaaaacattcccatatgagtgttgttcactcatcaaaattttaatcctgatgctcatggttacgcacatacatatgtgtttccaataggatattattcatgtcacatttgagtttgttagtctatgtatttcttgagtgctagttaatgggtgtgtacttgttggtacgtgcgtaatagtgcgtgtgaatgtgcgattgtgggtctcaatgtaattgaaagagaaatcccaattgtgaatgtcaacaaattactcataaatacttataagataagattagttaggagctcaccgtacgagcacttccaccagggccaccccacgggcctgcttggtgcttcgtcttccctttaaggtcaacgtaagaaaatgcaagtgcatcaactatatcagcaaaccagactgtgacacttagcagacgatgggacgccaccttgatgttgtgagctttccctgcatttcctccccagggcccaatctttgcaagcacagcctggccagcatagatcaaccaagaaaaagaattagaaacatagtagagacaatgtgcaattaataaacaattaaatcttgtacaagaattagcacctcctggtcatttcctccccctcttttttcttctttctttggtttcagcttataccttgcctccagtgtcgtcgccgcactatattttgaggtgcttgcgctctatacataggcgtatcgaatcgagagatgtcttagattcacagtgcatctcactggtttgtgcatatgttgtatattgacttatattgggaggggatatataaaaaaagactacatgtacgatggtttgtacttgtaggggttctagtaaaagtattaataatagcggaaacaatctaagttattttctacgactacaaggggcggatctacagtagtatgagcggtgtcaggcgacaccgacgactttcatcaaaacctatagcgaattagcatactatgacaccgataggcatgttatgacaccaacgaatcgattttctggatccgccactgatgtcgactactaggatggtggtctaaatagatatatacatgttggataagaaaatatgatatcgatatgtctagatttattctactactagtataaactattataaaaagtatagaaaaagtagataacaagtattgccagtgttctactaccaatattatcgtcaaacaaaacaatctaagccattgtcttataagttccaccactagtaaaaaacaattatggattctaatccttcgaagaatatcctctcatataccttttagtgaagtggtatatgcatgttgtacacaacacattttttacattttttagaatttcttataactacgtggatgatatttgaaatgaggggacatcaccttattaagggattaaaatagtttcccgttgagatagcagtatggtgacccgtgcagattgcacggctagcatcattatattttattctcatacaatagcatatatattttctcaatgtattattcaaatatattaaaatgacaacataattttaaattttgtactacctttacgaaactattaatgtataatattcatattgtattttatatacgtgttattttatttattaattatttttaatattcatattgtattttatatacgtgttatttattaattaattatttttaatatcaaattttagttatttgtaaattatattcctatatagactctagactcgtcttttaatattttttttaatttcgaatttttgttatctgtaaattatatttctatatagactctaggcacttcttccaatattatttatttttaattctgaatttttattatttctaattgtattcctatgtcgactctaaactcatctttcaatattctttaatttttaatttcgaatttcagttacttctaaattgtattcttatattgactttagactcttcttcccatatttttttaatttcaaattttagttatttttaaattgtatttttatacgaaatctaaactctacttttaattttattatgtttattccgaattttagttagttttaaattcttatatggactctatactctacttctaatattccttatttttaattccgaatttctattatttcttaattatatttctatatggactctatacactacttctaatatttcttatttttaattccgaatttctattatttcttaattgtatttctatatggactctatactctacttctaatatttcttatttttatttccgaatttctattgtttctcaattgtatttctatatagtctctagtctcctcttgtaatattccttattttttaattccgattttcaactatttctaaattgtatttctatatggactctgtttttctttttctccgattaatatgagaatttctaggccgtgagagcgaacgtggagtctcatttttctattcctttaataggttaatagatgtttcaatggatgaaaacaaaaatgaaatgtctatattaattctaataccaatatagactattgtaaacattatctaaatataaggcatctcacactagatttttcttagacaaatttaaagttagaaaatgcaagtttaggcatttacatttttcacaacacaccttaagcaagtaaagttacgaatcttggcgaaaatagatctggcctgcaatgactctgatcatacctggtctccagatgacaatggatcaattggtggcttataaagtaaaagtgacggtgatattttgcgaaccatatcatctagtatattcaatctgctgacaacctcggctatcgtaggccttttcagtcgctgggcctccacacactgcaacgccatttctatacatgtcttcatttgaagtcgaagactctctacttcctctgatgtatacatcggggttgcctgctcaaatcttcttctccaattttcatggacctgagaaattcaaacataaagttatagtgtgtagaaaattatggataaagctagatagaaaattgcttacgagttcgatgaattgttggggagacatgtcagcccgttttgacgtttccttagttcctgtcattatctcaatgattatcacacccagactgaacacgtcaaatttctctgtgatatggcatatctgaatgtattccggtggcatgtatccgctgcaaaatcgataacatcagcacatgttcgtatacacacttacataaagtgtgaataggtatcaagatgtacaatttaattacaaaaatgtaagtgtatatgaggattaattgtcgtctatggtctatcaacttacactgttcctatatacttttttgttgtatgacgggttagtgtatcagaaaagagtcttgacagcccaaaatctgcaatttttggcatattgtttttgtccaacaatatattgccaggttttaagtcgagatgataaatatgatctcgtcgtccattatgaaggtagagtttacaccctcgcagatccccttaatgattttgtaacgtgtgcaccaatcaaatccactagattcatctgtaccatatatagagacgaatagtcattatctaaaaaaaagagacgataagtcaggtcatttccaacccaatgactagagtggtgtccatagcattaaataaaatgccatttaagatgaaagatgatatggcaagtgaataaatgaggaaagagaaggaaaccaggtcttgcatgagatatggtttctacacaacatccaagacatcatgtgagataagtagcattaaatttaagtatggaaaaatggtatttgcattgaaagagtggtgtctactacagtttcttaattatgtggagtttatggaaactatatctagtgtcttgggttgggactagcctgcattcacttgagacatcaatttgggttaccatttttttttattgtttactgcaaagttattgggttaccattttttttattgtttactgcaaagtgcaaagttatgtgtacgtccaaccaaaaactatcataccagaaagatatttgtcaaggcttccacgctgtaaatattcgaagcagagagctctttcctccacatgaacaacaacatacttgccattgtgcagtacaaccttacgtcttgtgtcatagcagtagccaactaattgaacaatatttttgtgttgggcactcataaggttaacaaattcattcataaacttctcatcatcgagtgactctatgtcatggagcttcttcacagcaatctctttcccattctctagtactccctgttaacactaatgtcttgttaatatgatgttatcaacggaaatatagaaaatatagggtggatagcccatctagtctctcaaattttaccaaaggcttcatttggtcctagcttgaggtttcatttcgtccatacatctacctttaaatcatccttgagaccttaatgtgcaacatatagctatttctagtccacattctatttagaaaatgtccctttacccataatttgcatatactagaactaataaataacattgtaaatatactccccattatttcaacacatgagtgttgagctctaattaattagtggccaacagctggccatagtatacttttgcaagtacatgattattattttttacataaattactacgcaatacctattaggagtacgcaaatcacaatgaaaaaaacatcatataattataagatgtatgtttgataggaagttgggttttttactggaatatgttgggtctttagggggtctcatcagacgatttcactgcctgaatagtactccctccgtttcataatgtaagttattttaacattttccatatttatattgatgttaatgaatctagacatatatatctatctagattcattaacaagaatatgaatgtgagaaatgttagaatgacttacattgtgaaacggaggaagtaaggcatatttttctcattttttccatatatatgtgaatgagtggtagaaaggtcatttatcaagacagatggtgattatgtttacccatgtggcttcctatgtgggctcaagtatgagtttgaactaaaataaaaacatgaaagactaaaatagattaattgaaacatcaaagaactagaagtttggctattcacccaaaatatagatattaatcatactttgtatactattccatacccaccatggccaatttgattcttcttagaaaaatcatctgtgatacgttttatcaaatcgaacgtaagatccttgggcattgcatctgtgtgttgtaactcgtccgccatgctctcatgtatctcctattggacctagcttctgtgtccttgtttacagtaaaaaaagagaacagttctattacattaaggtaagtgaatacgtaacaagacatatcattatcagataaaaatgagctcttttaagaggtgtggcaggctctaacaaaaaaatatccaacggtctaattttcaacgtacgcagttgaggtttgggccttgcagctattgaaattataagcacataatgatttaatttattccataaataaatcatggcattgcatatgtaaactaaaataaatgcatcattggatctacacatgtaaactaaacagtaaaacatgaacagatcgaatatgcgcaatatgttgaacatgtaccgaggttgccgaaagatcggttgctcagcaggaattactcgcgagccgtcgcgaaagatcagttgctcagcaggaattactcgcgagccgtcgcggacgaacagggagcagtcgcgcgaagcgcttctcaaaaaccttattgtcgccttctcaatagtctacgagctagatttatttcggttgctcagcaggaattactcgcgagccgtcgtggaagcgccgctagatttatttcggttgctcagcaggaattactcgtgagccatcgtggaagcgcttcccaaaaatcttttcgcgtaggttgcgcgcgcgtgttccccctcttctctccacctcacatacttcaagtggctaggaggacattctcccttttaatgaggtccccctctcctagaataagcaaggtggtactaaactctccattcataccattccatgaggtgggcttttgtgattttccaaaaaattaatctttaagtgggctaagacccatctattaattccaacggcggcaacaagcactctaatcgtgtagtagtgtggttgagacatcgtgaaccacaatagtaaaacatttccgttatcttaaaaaaaatcgtgaatcgcgagtaacctagtgatacatggagtctcaggttctcactgttgaccaaatgatatccaaaattccatccccaaaatcctgttttgagaatccataaacttgaatatattgattcctccaagagatggcttaaagttgtgttcgagaggaggggttgggagcctctctctccgatacgcaacatgaagcacatattagcgtatgattaattaatattagcttaaaaataaaaaatagattaatatgatttttaaaagtaactttttttatagaaaaaatgtaaaaaagacacaccatttagcagtttatatgtagcatgcacgtggaaaataaaaaagataaagttggaaaagtatattaaagaacacaacctaaacgaagtttttaaaattttaaaagtgggccacctgttaatccactcacattaatatctgttgttcctcccctcaccacccaccccccccccctcccgcgcagggtgatgagcgcgtgagaggcccaaggggatcctgactttcggattcatgtttggggcggccattgctggatctgatattttcagcaaagctcccaaaaaattagatagggatttgttttgggcctctctttgtccatgctctaaaatgtacccatattaatcccataaaaagtagggccattccgttctatttctccttgttcaagattcaaatactatcttgctacttccgcagaatggaagggaccataccaatgaaaaacctggagaatgccaggcgagtccggctcaagtgcagggaaccctgcacatagtaatatacaggccaaatcaaattgcgacacctgtccagggtggccctacttaattacgcctgcaacggaggtt

SEQ ID NO: 60582 - DNA, 2952 bp, Oryza sativa
tttactatatactccgttgcaacaaatcattcatatattttggaaacactctattaaggaaatttggtttattttttgttccaccaaaaatgtttcacctagtgcactcacaatgtttcactatgtatagatctaatgttacagtgaactgaaataatctattgcaacaaaaaaaacccacatattttggaaaccccctattaagggaatttggtttattttttgttccaccaaaaaatatttcacctagtgtactaacaatgtttcactatgtacagatctaatgttgcagtgaactgaaacattctttcgctatttgctgaaatattatttttatataaggtgagacaacgtctgatttaaacgattgaagcattttcgatctacttagtgaaacaattccgatatatctagtggaacatcgtgcaataattaaaaataattcaataataagttaaaaaaaattcgtcggaatatatccatgtgtggtcttgttttgaatatttaattgcaacgaatttaatggtgcaatcggatcatgatttggataagtaatttaggagaaaatcagtttaaagtagttttgcatgtaaatcggacgctgacgtcatgctgacatcagcgcccgattttgctcctagccgatcgggcgcccgatccgtaggttcgtccgaaaaaccttgtcaaaatttttagcagtagtaaagccatcaattactgccatttcgggaccattgcataaaaatatactacaaagcatatcaatggggtgataaaataatgaacatgaacgttcgcagcagaccatcaggaatataacttatcatcttcatctggttcttaaaacagaattactagagaagaaaagcaaatgcaaaagttgtaaacctggagaagcttctatgctcgcagctccggccgtatagaaggcttggtccctgcgatggtgctctttatgtcgtagttatatagtactgagaaatacatgcacccaatttatttattattcataacactaattattgatatgctggtgtctaacacctaactcttcggatgtacgtacagctagctgatggtccaagtcgtggcgtgtctaggcagtggagacggcctatgggcatagtttagtgaagacaggataggttggcacagaagaatcatctttaaaatgaaattccaactggccaactgtatggaacaaattgaccattttaatatcaagtcaactgttgtggctataaattaatgaagaatggatgatcctctcacatcagctgcctgattacgacttgtcaggatgttaaacgcaaaacactgtagtgtcaccataaaaggaaatacataaactcaatcattaatggggagcatggaaacctggaatggttttcaacgaaattacaaacaaaattacccttgaagatgttgaactttttccgtggggtcatatatttattacaacttgtgctgattactcatgcgctgcgattaataaagcattggtttgacacattcagagacctctatgtagactagatgcatgcattgggtggctagcaattggcccgacgacgactactgccaactgggtcaactcatgagctatgccgtcttgagctatcctaaccttctgtgtcacccggaggtccctacttgttatagcacgactatgggtgcctgcataatagcctcgtatagatggtccgtaatatatgataatgtgatgaaactttaaatttaaacttttacagagttagaattataagtatgaacggacctatgattccaaagaaaatctgagattgacccctttgcttcttgatgcaaatgtgtcacatcaaatctgagatgaatcatgctagaacattttgtatacaagactgtccgtgagattcatcaagcaagaacattttgtatacaaaattttcaatgcgatatcttatagtattatgacgctctctctcgtggcccgatcttctggtgaggggataactctcgctttgatcgagtgtgacgtttgcgacgtggctaccaaccagaacaagtccaggacgtcgtgcaatcgctacaccacaaacgatgtcgtaccaactgtgacgcgcggttgatgatccctacaatgcaaacgagagaacactacaagaataagataagatgcaatctaaatattgcgaataggtgattaagcataaagaaatagttgcgattgaagtggtagatctaatcgacccggcaaatcaacacatcaactattgggggctctaaatcaatagtcgtcgactaatcgagcgagggactagagacaaggtgaatggcacttggcaaaattcaattaaacaaaacccaattgtttttgaggatgtacaaagctatttatagaggaaaataaagctagggttaagtgctaattcgtggaggtggagggagacacttccgagatgggtctagtctattacaaggcctaaggcctaaattcagtttcagcagcagcactgtcttgttttgacgattcccgtcgactcagaatgaatttggatatgagactggatgcgtttgaaaggtagcgagataagctttccacgaagtctaagatcacccaaatcggagttggcatgaaggcgctaggtctgtttgaagtcagtgctgtctccggaggccgaactgaacttggacttggaattatcattggaacatgtgaagttatgtgcgtatccgatgaagtgatgtcttcatcatagtatatttttttgtgaaagaaacatttaattatggagggaaattaagattcaccattgcagatgttttttttttattttgcttcagcattcttgtatccactcctttgaaattagaaatttgcattgatgagggtaatcattttttgtgtccttgtcatagctatttcatccctcctttctgaaatatttgaagtttaagaacagacacgttgag

SEQ ID NO: 60583 - DNA, 2768 bp, Oryza sativa
aaagtgaacttattttccatacgattctgacgagtccaatacttagaacgggccgtccttgtgctctgccaaattggactgaatctcccgataccgttaaaaagaagccgaatactcgattgccatttttttagcgacgcagccagtggccacggctactctcagttactgattgctttgctaggagccttagtgcctcacaactaattataccctgccaaaataccacaaatatttttcgcagaacaaaattataacaaatgtatcatcaccatcatgtcattttgtgacagatccaatgcattatttcttttcaccatgttcatcatcagcatacaacaatcatagattgaagcatcatccacatgtatgtgttcatcttaacaaaagagacgtttatttcgtcatcattaagagatatatagttcatcatcccgttggtatacaaagatgcttaacaagcattggaaaaaaaaagtactctcaaactaatattaaagctgggttggtgaccactccaagatctcaaaatataaccaaagctggtgcatggttatcaaatccaaactctgaaaatactttgggggtcacaccaagacccaagcgagggccaaaaaaaaagaaactacagaagaaagggaaaaataaaggtgatttccacggctcccatgataaatgtcgcaagttcagtagcagtattgttacaatgttactgattgttttgctcacatgctggggcctttagaacatttcagacagttagccctgccaaaacataaaagctatatcagcacattgtctaaagatcaacattgtaatgatatattatagttcagaaataaattatggcttcctggaaaagagaagatgtaaagcatggcctgtaaaaactgtgggttgcccatatgcaaagagttttactatacattcatagttactaaattggacatattatagctatataagacaaccagatattagtatggtctgcaactctgcatactgtttttcttttcatcaacattatgaactgagctcttggataaatttctagttttgatatatgaatcaaatgcatgtaacaggcagaagcatcttacctccataacaacatcatcgtccttagatgtttcacctgtcaaaataaagaaccttatttttgtcaccaaggaacagacaagaaacaaattgcggtaagtgttatcaagaaaatatatatgtggtcacgagattaggttgtgaacctaacacttacaacagagtttgtgttcatgaatatattaacagaattacatcaacatcttagaaatacaatttcttgataactttacagataagaaagaaacatgatcttctacatcatcttcgtagccagttcaaattaatggtacattttgagttactcagtcaaacttggatcaatgcaaagctgtactagtgacccttattagaaaaaaaagattggttggaagaatgacaaagcaaagcaacgcaaagcatgatcacttgatcagtactcaagtaggcccttttgcacatacagctactgaagttttacaagatcacgtcaacatgaaaccaatgtcatgtcattttggactgcctctaccattcgttgctcacattctgtaaatccttcatcaaatattatgtggtaattcagagggtattttgttctgcctatgagcagcttcacttgatgaatattaagttatgaccagtgaccacaacatatggtaaaagcagaatttctgctacttgctctaaacctttcaaaatggtaccatatatatagaagatataacacagaatattctctttatcaaaaagcagaaatgcaacagaagttgattgttgaaaatattttttattgtagttcatttacctccagttagttctgatgtccacaatgccaggttctccttcaggagctgcatcataagcatgctgtccttgtaaccctccacaccagcagagttaatctcagcagtagcctcatcaagtgcttgttttgccacttggctagctctgaaaaaggaaataaaatgactaactcattgattatggtatatctttgaagctttgaaagactggtggatgatgtgaaatctggcatggcccaagatgcaactacacacaaattagctgtcatatccaaagtattggttaaataaaggcagatccaggaaacatttgcctatcctgttaagcatttcgcttgtggggttcattgatgcaaattggtaatgtttcatgatgccatcttatattggtactaagcttttctcgatcatcaaatttaatataatgaataatgccggcatgcttatgattcaaacaagtttggcgcattaggaatatcagtaaaatgggagaaaggggccattaatgatgcataacctctcaggagagttcattatctcaagaagactgaaaagttgagcgcaaggccaagcctgaattgatgggcaggagaaagctcactggaggcaacaaccatggcgtgctggagcaacatatgttagttttccaaaggtggaaaccaaggattaataccagaagttcatttgagcatgtgtactatatttaaaagatttcacacctgataggccataagggactgatcagtagcagccttcttttcagttccagtgctaaattcagccaagtaacggtagtagtcacccttcctgtaatttttttaagagtgatgtataaagcagattaaagaaaaaagatatacacatgagtatcgtgcgaacatgcac

SEQ ID NO: 60584 - DNA, 2649 bp, Oryza sativa
cctattatggaaaaacaacttagcaaagcttcataagaaactatgctcaggtataggctaaaatgtagaacaatccaggtgtaacatgatttaattaaagaccaagactaagaaaacagttggggaatcaagaggttcatctcatctttaggtcttgtttccctttccttttctgaagaataccccaacactacaaatggtcgtgcactaaagaaaaaaaaagtacttgcatttctgtgcagaattagataaataaacaagttaagctaatgtgctggcacagatcagctcttcaactccttgcttatttagaagccttccctttatttatcagtatatatatgtatcatactgccctttaaattatgataatttagtctttattctgaaactttaggaccatgtgagcaaaactatatgtcatgaggttacctataagtttttggatactgtgagcaaaaaaggtcagcatagttagtccctggaggaatgacacatgagtcatggctggtatgtttaaatctttgattctatgaaaccttagcatcatttggtaaaacctggttgatgtcaaagtttaaagcagagcaaagtcaacatgtttgtcaccttctgcaattctttggaccaaggtgttcagtcaagcatttcttaggaagagaatttagcagaaagtcagaaactcatatggatgtgttatgtcaatgctattcaaaacactacatgagctcaaagttgtgtattcttctacaaagaaaaagattgcatcatcaaaatatgcctggataataataagatgtttgtttgggaataaattctgaatgtaaccattaggaaatagaccgatatgaagtaaaacacaattgagaagcaaataattgacttgatgaacctgcacatacatcttataaaagaacacgacattttcacccgaattggccaatggaaggcaatgaatagcaataattgataatacttcattgcaaactgcccttagttcatcctctactttctttttgtagccatttattgttacacctggttggtcaccagctgtcaccttctgctcaagtgattcaaggattctccatgatgctctcctggcaccaatagttttcttaaaaccaactgaaaataaaagcctctcttcagcactcatatccacatccatcctagcaagtgtcttcataaattccaccatatctgcaggaacaatcatgcattgagtgaagagtcacttcaacgaaacaaggagaacaaaatatgtgtatagaacataattgatctggttgcgtcatgaaaactctaagcagaactgaaagatctgttatgcagcagaacagattcagttattaagacatgctacttcagaagccaagatcaaggcaacagagttgcaggaaactgagtcaagcattatgttgcctaccacttcaagtggggatatggaagccaagaaggctaccagaacctctatgcactatgaaagtggtctatgaattagaaagacttttttgtgttttgagccaagacgctaggagccaacaaaatggctgacaagttcagatcaacaatcatacagaacatagtggcatatatactactaagttacaacagatatgaccatctaaatatctaattgtggacatattatccaaaggtgccccccaaattatgggcaaagggcatttcaaatagtctaaagttatttagttctagcaaagagggatgataaatcaaaccacactagtacactactttatgcactgctaaacctcttttaacctaaaataaaaatgtgaaccgaaatggtgggttccacaagttccacatattccagtagatcatgtagttaggtcataaagaaatggatagaaatctctaactgtttacccatcctcataacagaaaatgtgtcatccatgattccaaagatattccctttttttcctcagaagaaaaccaaaacgcaacagaaagcgactaaggagcacccaaatcatagagttggcccccacaaaccatcacaaacatacgagcaacaataattacaaatcatccaagatatcattcatgatctcactatccccttttcaagaaccactcaaaccccacaaactggcagctaaatatcatggaaaagcaatatttttcatcaaaacatgttcatatcgcactggatacattcactcaaattggctcagagtaataatcaagaagcagccttttcgggtcaaactgctatacatccaaacattctgctcatagattttcttttgacgcaaacataatgtgcgcaatgcccggcctccgctgttcaaccaagcgaccaaaagcaaaatcatagggcagcaatcccagaagtcacaaatgaatcaagaaccccacaaatccttcctatacttaaccaagaacagggtcagcgagatttccccccaacccccaaatgcaaagaaccaagaacaagaactgcacaacagcaacgcgcaatcgaacaatccagcaatccgagatcccatcccagccataccgtcgtatctctccgcctgctcggcgagcttggccagtcgcaccaccttctccctctccttcatcttcttcacttcccagcaatggatttgtctgcagcagcagcgcttgatggcttct

SEQ ID NO: 60585 - DNA, 32568 bp, Oryza sativa
  unsure (1)..(32568): unsure at all n locations
cacctctagcaagcttttctaaagattgggacattggggtgtttgaatgaacaaaatttgttcttcatatatatagcactaattatggtacttaagtgattaatcagttttgacttttcttgattatattttattattttctgttccttccttgaacagtttactcttgtcaactaaagaaagataaacgaaaacagttaatgactaacgccccattagttgccctactaagtcaaaacaaaagttaatttgaattttcaaaatcaattttgaagttgatttgaaaatattttcaacatagtttttttttcagtattagcttttaacccgctaaaaacacatctataaaagtattgtctaagaattaaattttattatataataaatcgttttaacttattaaggaatatggaatcgatgaggacctaggaaatggaactggagacagggattgaacactaatcaatcctatccatctgcttgacctgtcattttgtttgtgtttcaaagctcactttttaaattatcttcttccttttctccatgcacagctatcactttgatgatgaccacagagggtagcattgccaccttttgtcacctctcaatttcttaatccatggaaaggtggcctagtccatcatgcagtttgctttcagcaatactctacctctggtaactcccttagctggccaagagattaggattaattaatttcgtaatgtggtgaatggttttttctaatcaatcatggccccatattttacaacaaacatggtgcacgtgttaggcgatggtttaacaggtgttgatctcaacaataaaggagaacattgggaccaaaggaaactaggaatcactggcttttcttctgttttaggactatagttcaaaagccgtctggcccatatcttgctcttttgtatctaattttgtaaatgtaggtgtttcattgtcattggttggacaagtcctttttttccttttgattgagtaagatgtttagtcatgactgacagcgtgacataaattaaatattttaaaatataacttgacaaatagtttaaaataagtggtctaacaaagcaatgcagaagaagaattttttttaaggaaatgaaagtttggaagcgtggaccaaataatccacagcaatagcccaataaaaataagttgaaatcaacgagaacactatttccagattacttgtgaagtcctctgatgttatttacgattagggatattcaacttaagtttctttctcatcatctaaatgaacatatgcttctttcaaactgcataaaccattcagcattcagctttctagatggcagagtgacatccatcattgtgtcaaatttattatttcttccatctcaagaaaatattgttgcctttaacatttaaaatttaccctaaaatatgtaaatagctacttcgcatattctctcatctcaactaactacaaccatcaaaataaaaaactaattacaaccatattatatttttttgtctattagtttttttcagctaatcataatattcacctttctatcaaaaaataaaaatagaacataaactttccatttaaatttatcgccctctccttaatcccttaaaagtttaaagatagctacattctacaaatataagctttacaagtatttaaaatttgttcacaaatataatgattcaatgagtaccacttacccctcgatctcacttctcatttaagttttttcatcttgttttcaactactatatctcattaaatgaggaatataaaagtattttctgatcaactttaatctttgttagagaatatagaaactttaaatttaagaatggagatagtaataaaactatacggcttcataattgtcaacattaatcgtccacctatatatggaggttatgccggtgttcaaagtcgcacgaagcatgactacgtggctagtcctagtgttgacagaaatttcatacaagtactacttttaataattaatcatgcatagtcacacgtacggtgtgctaagtgctttttatgagaaaatactccaaatactccctccgtcctataatataagagcaggtataatagcaggctattaaccagttataaacatattttaatgagatagacgatgagagagaagagcagcgggctacagatttatagctagctgcaacacggactccaagacaaaatgtatgtatgacaggtggaactgtatattaatagtatagtaaacaactattgtatgaattgactatagatgaattggagatagtagtgagctatactattgaacttgctctaagggattttgagtttttttttgcttatactgtttgaccacttgtcttattcaaaaaatttgtgtaaatataaaaaacgaaaatttgtgcttaacgtactttggataataaagcaagtcaaaaaaataaataataattctaaaaaatttttaaataagatgagtgatcaaagagtgaaaaaaaacttaaaatcccttatattatgggatggagggagtaagtatataggagccacatgaagatcttttgagaggacacgtaccttgtgggatatcttggcaggagagatggaagaagcacaagtgtccttcatgctgacccctactccatagagggtagccaagagcttggctgagtcactgcctcagcgggaggaggggttgggaaccgcaaaacaaaacacctattattattatatgattaattaagtatttactaatttttttaaaaaaatagattaatatgatttttttaagcaactttcatatataattttttttataaaaaatgtattgtttagcagtttgaaaagcgtgcgcgcgaaaaacggggagggaggttgggaaagggaggtaacgagcttaccatacccaagccaatcacacggtcacaccgtccccaacacagcctcgtcctggaattttttttcgagtaaagtccatcaccggtctctaaacttgtaccgttgtgtcatttcggtccctaaactcgcaaatcgaccgttcaggtcctcaaacttgttcgactgtgtcatcccgatccctaaactttcatatcactcatttaggtcctccaacttgttcagttgtgttaccccggtatctaaacttggatttgaatatcatctgggtcaaataggacggtctaaagactttatatttaaaataattcataactttttcatgtgaactttaataaagacaaactttatatcaaacttgtagccctcaacgcgatctataactttgtagttgatttttttattttaagtcattttttgtctgaaaatgtaattttaaaattaaaatttccaaatctataaacatgcaacaatattttgggaccctaaacagtttaaattcaaaaacttttcaactacaaagttgtaggtcgtgtcaagggctacaattttgatataaaatttgtctccattagagttcacatgaaaaaattatgaattattttttatataaagtttttagaccatcctgtttagagaccagggtgacacaactggacaagttggaggacttaaacgagtgatttgcaagtttaagaaccgggatgatacagtcgaacaagtttggggacctgaacggtcgatttgaaagtttatggaccgagatgacacagcggtacaaaatttaaggaccggtggaccggtgatggactttactctttttttttatgggccctgttcaatccatcgtcagaaaatattggtgaaattaaaacttgacaataccaaaatttcgacgaattcaagatgtgagagtgatgttcagtttgataccttaccaatttttttattgttttgtgaaaaagaagttcaaataccaaatgttggtaggaattgacaatattgtaatggtgaggtcttgtttagtttgttaccttactgagatgtggtaatgctaagtttggtaaggttaattttggtaataaactaacaagctttatattttagttttaagaatgaattcctttctcagcacctagagtcggtgccagcgtcattaatgttgagccgttggaccttaacgttagattcactgacgctaagtaaaagatagtacatttctacaattataaaatatataaggtttctaaaagaacggaaatggaaaaatgcggcatctctggtcggccaagtatcctctgccataaagatattgcttaatagtcagaggtggatctaagcctagggcaccttaaccgtggcccaaagcctaagattaccatgtaatcaccatacaaaacccaacttctctatgagttggtacaagtctttggatcaagtctttggatcaattctgaatccgtccttgttacttatatgcaggttctatttttctattggttcatatgtctataataacactatcattacatacaatgatactatcttatatacaattttttttagataacacattggctccggtcctggacacaaatacaaaagtatcaagacagcaagcttttaaagtttgcatgtcgtaatcttaaaacaactgtcatgcaactttttgtcaacttccgatgaagatcacaaataggatctaataattatgtactctttatcttgtgttggtggttattagtttgtgtttacttcatgatctggactatttttataagttttctttgaattgtgcgcgctttaagtgaattggtataataatcggctataactcgttaagcaaagaccgatatgatactctatttcattattaaaaaagatgtgaatcccacttagccaggggcagccaggattataccgaaagtagaacttaatcactagattataaactctttaaacaaattttaataagaaaattagtaaattccttgtatttttttctgctccgctagcctagacacgcgcgccgccgcggacacacgtacgcgtcggccacacgcgcgcggcggatatttgttgggtttgaataatggccaatcatgacttgccctgcatgcatgccatacacatacaggtacagcgnnnncgcacgcggatggatgatggatatatgcaggcaggcgcgcggcgcggctggtggatcatcgatcaggttccatgcatccgaagagagatcgatcagctttgcccctacgccgcgtcgcgggggtcctgcaaaaattaacaacgaggagacggccgctggctacctcatgctcatgggacgtgctcgtctctcggctgatgcgattagccgagttcgttagtacagggtacagatttccaaccgggtacgcgtggaaaacggaacggtctattagcacgtgattaattaagtattagctaatttttttaaaaaaaatggattgatttgattttttaagcaactttcgtatagaaacttttttgcaaaaaaacacactgtttagcagtttaaaaagcatacgcgcggaaaacgagggagatgggttaggaaaaggaggttgttcccaaccgaaacagtacgtacggaaaacaaaacggtccattactacgtgattaattaagtattagctattttttaaaaaagatagattaatttgattttttaagtaactttcgtacagaaacattttataaaaacgcaaagcgcgtgtataaaagatgaggggagagggggttggcttgtgcactgtgcagaacccacccataatctccgtttcttatcccgtgtataactaactacagggtactttgtcccaagagaatgtcaggtacacggagagacgtaccaaaaaaaacacccgaaaagaagaaaacatccgacctgccgggattcgaaccagcgacctaaggattatctgcaacgtactacagttatagtctaatcaattataactgtgaagatctgtttttttccaagaggttttgaggtttcaaatgagccaaatcttgggtgcaatctttgtgcgacatgtaataagcacagtccggatacacatgtacatacaaccacttgtttgacaaaagaaaaaaaaaatttgtaaatagaacagcccgtttcgacataagcgaacatgtacatacaagtagccttgttttcagaaaaccaaatgagctgaaagtttttatacataaatacaagaggtcaaccagacatatatgagccttgttttcagaagagaacgaatgagctgagcctttcagatgcacaacacgcctgactagatcgacgcatctaccaatatgtatccaattcttgtttcctgtcgatgtagaacagatagcaagtttagcaacaggcatattttttgcaacatggaagttccaaacgggtccttcgattcagaattgtgtactccagtatggcgtgtgtagacagttaatttactccatcttcagcttaagaacaagcttgttcggatgttcagcaatccggttccgcagatcttccttgagcctgtcatcactggaaccatgctcgtccttgtccagccgcactgacagcgactccaggtagcggtgacacgagacggcagaacacagctcctggatgtttttccagttgatgcctgaaaccccaagcttgcgcagctgcgtgagattcttgagctctttcaggaaggccttgccacctgcgacgccgacattgacgacgcccagcgtgtgcaatgccgtcagctcctcgatccccctgggcacctcaataccagagcaaggatcaccagcatgcctgcctctgcacagatcaggcagccaggatagcaaagcatgtgttgacctgcattttggttgtgtctctgtctcagcagctgctaggcttgcagatgtgccttcttcacccaatgtgactttggtgccaccacgaatgtactgcagcttatgcagcttgacgatgactgttggcaatctgacaatagaggtgtgcctgatatccagggtctgcagctgcctcaggccacccaaggagtctggcaagcggctgaccattttgcatcctcgtaaggaaaggaacttcagacgaggcaggcttacgacacgctcgaggtcgtcatttgttacatctgatgcattctccagatccagcactcgaagaagcttcatattgtcagagatgaagaatgattcccatttcccaaacactgtcagagaccgtagccgggagaagtcgatgctcatgaacacgatcttgtccctctcccaggtgctccctatgacaaggtgccgtcccgtgcgttggctggtcaggctgcagcgcccctgcagtgagaagatgtggttgtcgtccatttgctgcgacatgatgtactcatggaagaaactgttcacctcgcaccagactattctgttgccgctccgtgaggtctgctgcataatgctcaggccaaccagctttgcgaataacgtctagccattctcctctgcgctattgttggcagtgtccctggagtagccctcggcgatccaccgtcttatcaaacgcctccgccgaatgcttctgtctcgaggaaaaattgacaggtagaagatacatggcttgagggaatccggggaattgtgaaagtaggattgcatccaagcaaatagaccccgcaaactttcaaatcctgggttagtctgtaactcgtgcataaacttcttattgaatctcctccatagcacggcatgtttactccgggtggccataaagcgacctatagcaactattactttaggaagtccaccacacttctttatgatgagctttgcttcatcaatcatctcgggagtcagatcaatgttctgtttgtaaagcaggcggtcctggccatgcttctttagtaaaggagatatttcttcagtcatcccgggagtattcgccttacctaacataagccttaactctgtatcactcatgcaatgtgcagatccgtacacctattttcaaatatttcaagaattacatgtcattttttcagaattatcatcaatttgcacgtgttaagatgtgattattaatatccgttacaattggatttagatgttgcaaacaaaattgattatttgctgctaaatcacaatataccaggataccactcaaataagcaagaaggggaagagtaaatttcaaaaaagtgatactttgaccaaattgttgcaaaactacaaatttaaggtgatgtatcacaaaactatagatttaacaataagttcatcacaaaaactatatgtctaaggctaagtaccacaaaactacagatttaataataaaattatcacaaaacaaaaaattttagggtttaaatccttagcactaatgttatgttggagttataaaatgtccaagttttgttattaaattaaccctaaacttgtagttttgtgaaaactttgttactaaattggtagttttgcgatacttcaccttaaatctgtagttttgtgataaattttgtgttaaaatctatagatttttgaaacatcatctgtagttttgcgatagtttggtcaatatgtctatagttttgtgaaatttgctcaaaagagaaatatgacactgactaactacctagcatgtcttgtttgatccacaatgtaccactcttccattgcttccttcaaattaatgttttttaacatggataggacaaatactccctctgattcatattataagtcattttgaagtttgacttggaaaaatatcaaagcaacttacaatatgaatcataggaagtatttgttctatccatgttacaaaaaattaatttatagaaaaatatatcaacatttttaacacaaaacaaatatattatcaaaatatattaaatgttagttctaatgaaactaatttggtgtggtagatgttgcccaatttttctataaaccttatcaaacttaaagaagtttaactaggaaaaaaagtcaaaacgatttataatatgaaacggagagagtgctatactagataatgtttccaatattaagcgatagaaatagctatgtcgccaaataatccattattatctgagggcctcgaaattaccacattattcaagaaaatctatgtcgttcgtcgacatgatgcatccaaattataggggtgcaaagcgattgatatagttttatacataatacaattgctcaaaatgattcaaagcttgggattcccatttttggctagcattcttaaatttaggaactactttcaattggggtcttctcagttcaaggatgattctcagattatatttttggaagatatttacctaggaaatagcctgctaaaaacacagttgccaacattgcttaacatattactccctctatcccaaaatttaaggcacgaccgcttttctcccatgtctcataatataaggcatgcatgcatgcatgcattaactatcatctctaaattggtttattttaaatcctctatcatcaatcctccaattatattgcttgcatgtatggaggtgatacaatcaatgagctaattaaattatttcttggtctttgtgttaggagtagttgagccttaggtctcctttaatggttgagctagtgcactagctcatgcttgtccaccttatacaagagatagcaaaaagtctacctttccaataggttgtctcatagcacattgttcaaaatgctttgggttacacaatccctctcacattttctttaggagcttagctcttgaagaagagatagtgcattctctctccttatcttctttctcttccacatcatacaaaagctgatgtggagatttatgagctagctgacttatccttgttggaggaggccttatattttgggatggagggagtagaaagaagcatgcaacagagggcaagttcatgcgttcaatcctgcttaatgtctcctttcgtagagctctaacaaggaataactttattgcttggaacaacttggtggcctgccttatgaatgtttgattgtcacaaaagagagatccatttaaacagaaccttcatcagaatggtcaattttgcattctctgtatgatgttcttcctagcactagtatcccaggcacaaacagactgctgtggaagttaaaagttccactcaagatcaaagttttacgtagtatttacatcatgatgatgtgttgacaaaagataagcttgcaaaaagaaagtggggaggaactaaaagttcatgacaaggagactgtaaagttttttttttatggtcaccatgctcactttgtttggcatgtggtacaaccatacaagtgcattttgattaataataggctatgtcatcattgagttaatttagcttgttatagcacttttatcattctcacagttggtactcttgtacacatatggaactagctaagtagcaagattgcagaaacaagggcaagataacgcacctcttttatgaacagataaagggccgcatcggcttttagaccattgacgttaaacacgaaattgtcttctactgcacaatgtctagcgacactttcttcatttgtaatgacaatgataaaactttctgaatttccagatagtaaggtagattttatcaagtcccattcttctgtggactgcaggccatcaataacaatgaggaatttgtgcttgtgtagaagcttatgacactcctgaattgggtctttggtcctgaacatatcaatgtccttttcccctaaccataagaaacatctgccgttttgatgcaaatccaagagtaaactgcaagccaagtcccttaaattgaatggatgggatacattgacccaaccatacatctcaaattgatcatgtgagttgtagatagttcttacaaaagttgatttcccaacaccagcaatcccccacacagagatcactccaaacctgaattcacctctacttcgaaaaattgcctcagttattaaaaacaacagctgtttattacactcccgaaggcgtgtaaacatgtcatccaagacaaggcctgtttttgcatagaaagaggaaatatcatcctgtcttagtccatccttcattaataaccaatcaattaatatatcattattacagccgaaagtcttttcatctttacttctgctgtcacgataagatccctgcaaataagaaacagttagggggaggggggagcaggatgcaccacacatgaagtagtagatgccagagggtaatcacctgaaaggaggccaaacaaaacaagacggcatgcaaatgattttggcattacttaattcttcaaaagaaacttactaaaaggatttttaccaagaatatgagggtcaaagaaataagtttctagatcttcacagaatgtgaatactaaaaattaatgtttctaggttttcacaacatttatgtttttccaaaaataaatgcctcagttgtgagactcgctgaaactaatactaagcttgttggtattcgtttggaactttaatataacctcctaaactcctggaaatctacaggttgttgatacacatttcaaactaactagtattttacctgaaactttggaggcatttgaaaggcaaatctatctattatatactaaaagttcaacaaaattcatacaaacgctcctagaccgccatgtggcacttgtcgatgaaatgggaactagggtagccctttccctgggaccctagggtcattttcacattagtaccaataaaatgataggcttaaaactatcattagttttaagggacccgggtcctggcctaacccggacctgggggccacttcttatatgccaccctagggccattttcacattagcaccaataaaatgataggcttaaaactataattagttttaagggacccgggtcctggcctaacccagacctggggcgacttcttatatgccgcgtagcctcctttagggcatgaaagcgtataagacacacgtcttaagatggtaggccaaaggccagcctgggtcgtggccttgttctggggctcggccccgcctttgccctcgtaggtcacacgttcctcagtaagaggagcatcgagacatacaagatatgcatcttagaatacaagcggaggcaagcctgggtaccggccctgtcccaggacctaggcctgcctttgctcctgtaagtcacacgttcttcggtaaagaagagcgtggagacaggtcaaggtcttcctcggtcccgaccctgcctcgggacccgagttcacccttgtccttataggaaacatattcctcggtaagaggagtgtggagacctacacaatgtatctcttaggatgacaagctgaggtctgcctcagccccggccctgtctcgggacccatgtctgcctttgctcttgcaagtcacacattctttggtaagaagagtgttgagacctacaaaacatatcttaagattataggccagggtttgcctcggccccggccctgttctgggacccaggcttacccttgcccttgtaagtcacacattcctcaataagaggagtgtggagacctacaagatgtatatctctagatgataggctaaggattttctcggtcccgactctgttccgggacccgggcctgcctttgcccttgtaggtcacacttttttcgataagaagagcattgatgcctacaaaacataccttaaaattacaagccaaggactgcctccgtcccggccctacctaggacccgggttcccccttgcccttgtaaatcatacgttcttcgacaagaagagcgtcgagacgtacaagatatatatctaacccaacttctcttcatcaaagacacctttgaggaactacctctcaaaagggcgcaggggcatgaccgttaggcgtcgagcatcacgatctgacccctccgccagttgcaagccagtatgcatggctttagatgaagcataaccattaaggaagttgtcggttgcacaaagtcaaggtgaaaagacgggggtgctgagtcagacgcgttcacgcgtggcaggacgcgcgtcgtgctcgcccaacgccacccgacctcgctagttgtgcaaaaagggggtaccgtggcgctacctcagccaggtttgggggggtcccgggtccaccacaggacacatggtgggcagggtgatccccaactggctcaagccggtgcccgaagagcccgagacagcataaataaagtaagattctgaagctgaccaactggcaacgacaagacaacaacaagatgggtagttaagaaatgttgaaaatggcattgtgagccccttccttgagctataaaaggaaggggacacgccatggagaggggagggaattttttttaaaacttagaatctgatagcttgtacctgtctcaactcacacaaagaaccaaaacacatgagtaggtttttacacctccagatggcctgaacctgtataaacacttgtgtcaatttcttacttgatgatcgaccgggagagcccgggtcccttcgtgttccacacgacacatcgctctcgtcatgtgcaaggacaatcttccttgggtcaaaccgtctttttcacatcactgggaagggggtctctcttttcccagctaccggtggagtgatccccgacaacactgctataaacgctcctaggtcgtcatgtggcgctataataaatcgtagaaattctaagaaaaaaacatctaaccgtcaattttcatttaatctggtaggaccattatttttaactattagatctatcttaaaaattaccaattaaatttctctcaaaaaaaccacatcgctacgcgtacggtacataggtatgtacgtacgtatccccaaacccatatcccccaatcctcaagaaaagtacgtacatacttccttttcttttttctttctcgcttagattagttgaaaaatcaaactaataattcaagcctactttaactatgcttgaagtagtaaaaatatatgttatttcaagttgtattcttgctaggcgcatctcatcaaaacatccatgaaaaatataaataaataaaagttgtagattatataattgtatacacttaagaacaagtatagttaaattagacttgtattttcaaaaataaaaacaactccaattatgagtggcattctcaaaatttactcgctgcctactataaaaaatactaacatgtcaaaatgacattactaaatttatcatgaacgtattttgatgtactatgtattttctctattcatatattgttaaataaaataacaatcaaatatattcttttacaccgtgtcgatgccctttatctcctgcttaggcttcattcgatctagctcattggctgcgcttatctagggcacgcaaaacgacacgtcatcaatgaaagattaattaagtattaaatattacaaacttgaaaaatgggtttatttgatttgtttaaaaaaaaagcttttgatagaaaatatatgcaaaacatgcaccgtttagttgttcgaaaaacatgctcaccataaatggagtagccaatcggataagcactttagaactcacctttatgtactaaaatgcttaatatgtagtatataatatactttgtcaattaggaatagccaaatatatcaatcatatgttcctactaatcccatgtatataagttctatatacaagccactattcaccaatcatcaaatcatattgcttacaaggcattcatgagcggtgcacctaataattagttgatatccaatgtgcacatgtgtcatcaattaccgaagataaaggacaatactaagtgggcaacaatcaacagatgataggcaagtagagatactaccaagccacaacaaacaatagttaactacaagtatattgcgactatgagtaataacgttcctacacacctatatacactactaagatgccacgtgacgctctaataaattagaaaaaatctaacaaaagttacaagaaaaaagaaaaacaagtagacatcagtttatacttaaatcagtggatccattatttccaatcattaggttaaatctattaaaataatccattgcgactatgagtagtagtgttactacactctacaaatactcctaatatgccatgtgacgctctaataaattagagaaaatctaagaaaaattataagaaacactcatacataggacaaatactcctaagatgccacgtcacactaataaattagagaaaaaaatatattaaaaaacagaatttctagccattgatttgcacttaaaccaatggatccattattgtcagccattagattatattgatccaaataatccctcactcttaaaaatgggctaatccttccctatgtatgtacgtacacaagagatgtcaagaaaaagaaaaagaagaagagtgtgtctacaatcaaccccgtcaagtagttttccatttctttctttgaagctctaaggatttcctcaaattatatatatatgtagcgaccactcctgacgaggttgtcgaagaagccacgccgccgaagcgctgcttctcaccatcccgtcaattctcttgaaagtatttttttctagtaatgatgtaaaaggaaattgcagacacatgcagacacttactagtaaaattttcgagcttacctccttgaaaaacatgcagacacagtgataatatgagaatcgcctgatctgtgatacttggaacggatgtcctgtgcacaagcttgcaatttcgaccttctgtgtggacaccacaactcggcttccatttcgcatgtttggtagattcgatctgatggattcccattctgaaacggtgttcaggtcttctaacacaatgaggtacctctttttatatacttccgtcctgaacttagtgaaaagcttgacttctgctccttgtcgctgttgtccagagtttgtgtagaactgactccgcaaagcctggaagaactcacttagatcaaatggatgcattatctttatccaggcaagacattcaaagtttctttttatttctgggtcatcatacacattcctgatgatggatgattccccatgatcgccttctgtttcccagatggagatgacctgaaggtcaccatcattgttggtgagcaattcagcaagatcccctgaaccactcagctcctttgcgatgtctctcacctcaacgagggcatcagatgctgatgagccacctgcagctggcccgacaggtttggagccggagtcagagatgaggttgtagcgcatgttcctctggctcacatcctccactctggccttgatctgctttatgtcagccaccgcctcatccaggggaagaaccggcgcaaggcaggacggcagcaccggcgccatgaacgaggggaacaaccggtgccaccaagcagacttcttgtcaaggtggattacaaactcgatgcagtcctcgacgtcttaggcaaggttacgcacctgcgttacccaggtcctcaccacattgttgttcgcttgccccctcccgacgacgttgaggaaggactgcatcatctggaactcatccgtgatgaacaccaggtcatgctgcaccctctccttgagctggttctcctccaagatcgccgactgcaccttgatcaccgtcccctccaccaccgacttggtgagcccaagcacaatgtccgccattgtttcctcagcctctactctctgatgtgtctgagtttgtggtgagctagaagcaaatgatgccgctaaattgctagatcggaatcatgggtaggagctgcatctggggtcggtattaaaaaggacagatcagccattgaacaataaatttggacattattactgtattaaactagactatccaggtcaatgaaacaagctggactaagtcctaaaaaaaattagtagatttaatctagcgaaagagcccttacgttaacaaatgtggaacagctgatgccttgaatgattggatcagtgagccttccccaacccaatatcttactcaactggagacgtattgattggtactacacgctgtaacatggggattggttgacaaaaaataaataaaattagtcaaattatcacaaacaaatcacaccgtttgataaacaaagtgggagtacattagtacaagcattcctactaattcctcagtctttcagttgtttactatgaattggtttgctaatcagtctatgtctatcatccaagatcccaaatgcgaacgcccaacgcctaactctatcgcaatccaagttgccttgcatacctcgcggctcccgggcgtgggcgctccggttcgcccacgacatcctctcagcctccgacggtggccgccacaccagccatcctcctccgcgacggcgagatccggcggtgagccgccgccgccgcctgtgtcgcctcccatccatgcctaccaaacccaccagtttgctccatttcgacgcgtggaaggccctgtgggctgcaaaagtccattcggatgggccgggccgagaccagtacgagtgagttgggccggcccaatatgcgcaattttatacccgtaactccgtttttcttcaatattgacaacttatgccctctttgtttaggcttaatattattggcttagacttttaagtcagcttattagcttatatgatttataagccggtggatttaatgtcctaagtttaatgatggagtcatgcatctacctcatataagccaaaaaagcttcaccaacctagcttttggcttaatagtgttagaatggcttatggcttcaaaaaagccaaacgaaaaagccgcttgtttgtttagacttagacttttccgtttataagttggcttataagcctaaacaaagagggcctagaactttaattgacaactttaaactacttcctcggttcctaattatttgtctcataatggttaaccaagaaaaaaaaagagacttgtcgaggataatggagtaatactctctccattcatgtgataagtcattttgacttttttttactcagacttcttaaaagtgatcaagattacaaaaaatataacaatatttatgtcactaaatttattttattaaatctaaaatagaatatattttgatagtttctttgttttatgttaaagatatttctctattttactataaacttaacaaagctaaagaaagtttgacttaaaacaaaaatcgaaacgacttataatatgaaacgaaggtagcagtatatagagatcaatagtatatatggttacaaattatatcccttttgattatttgaaacaaaacatacatgggcttgaataacctgaatacaatcctatctagaaaagtgagggttttatccaaaccggggagggccaattcaaccatggaggcgaattctcggtacacgcaaagctctgtaagctcttacttgtcatgtcccaaatacctatctctcgccaactattcttatacatgtagacatactcagatgagtcatcggtaatgtaggcacaatttggctttaacataggataatccttggttgaaatgcacattgtgctattgtatccaaggaataatgcatgatcatccaagctcttcatcttcacaagttttttccgatcaaaatcgactctgaacacttcaatgtcagttgtcttgagctctagatatggatacatgtcatcattgataccaacgataggatctaggtcatcatcgtcatcgtccacctcaagattatttggatgctccgatgaagatgttgccatcaggtcaacatagctcctccatctccgtacttgaaggatgtcaccccatggcgcccgtaggaggtacatggccgaagggtaccaccgttgtggaactttgcctgtgatctgtctcacgataggagaatctccattgagatctaaggtgtagatggatccatcgaagcatagcgcgtagaaaaagccatcatcatcgttgtgaaagaagtcttcaaagccaccgaagcaagggtgtttgtccagcgagacccacgtccatcgctcatcaccaggccgggcgaacgagagctcgccgcactccatatgggcgagcagcgcgacacaagcgcccccaccggtggacgggctacaggaaaggaccacccgatggtacatgcattcccgtgcctcattcgccgtgagtaggagtggctctgggtcgagcccaggtgtcgaactcacgaagacgttgtacatcatggcaccgttgttgcctgcaccggtgaagctcttctccacatggtgaattccggtgataggagggagacaggcttgggcgccggtaatgggattgatgaggcggaggttggagacctcgtcggcggtgacgatccaaccgtgccccgcaccgaccacggagtgttcggtgaccacgccgagtgggaaagggactcggatggactcgccagtcaaggggcaatggacgacggcgttgttcggggagtaggcctcacaggcgtagaacagacacgggagctgcttcgccgatgatgggagagggaagcgggcgcggcggacggcggtagacgcggcgcaccatgaggcacatacagcgctggagcggatcaggtctgggatgtccaaccgctccataattattagaaggacgtcctccagcaactccgcccagtcggatgactccattatcctctcctcctcggtgtcggcggtacaaaaatttgggcgtaacacagtggccagcaacaaatacatagtgcgggtgtaccccgaatccgatccacctaacgtcgtccgaatccaaaaccgtcgcggccacgtcaccgagttatcttgggccgcctgatagcctggtggtgaggtggacggctgagatcgcttaaggagcacttcgttttctcctcatcgatctctccagcctctccgccgcgcgccgccgccaccgccaccgccgccgccgccgacgacgagtccctcttcccttcctctcctgtctcctcgccagccttcctactggccacacggcctcgacggtctcctctaaggatggagggagaggatgaagagaggcagcattctgcggggattcgcggctgcgcaggtgtggcagcagcgggcgggcttgagcgagacgagggaaagcggggaggtggggggggggcaccgtcggatgggaagatcgagaagctgagcgcggaggagcgagtcgccgcagtccttcaccacctggtcggcgccgtcgatggacaggtggacattcactgcttcccgatggggtacctaccaacccgtctcgaggtcggcatcccggcggcccggtcacccctcagcacgccggcagactgagcggttgagatatattcacagtacatctctatattccctttgtttgtttgtttgtttttgttttgttttggagagagctattcgctttctttgttgttgtatcatcaaattggtcaccgttgctactgcatatcatcacgagaaatgaatcaatgatgtatgcagaagctagtagcttcaatggtagttgcatcagaaaacagaaagcatactgtggttcctcatgaggatttaggcacgtcaaattaataagtctaacttatttatggaatccccttatttatactatgtagtatcaggcttgtgcgttttggaaattaatcactgcaagaagttttaaagtgttttccgttttccattacagctatcatttggagctccctgctttattagatggccagcatgctcatgttgggttcccccctggacaacagctgcaatagttatcaatggtaaacaatatatacttcctgtgatttattgcttgaagtccctacagatggaatgtcatttgtagcaagaaaactatatgaatatgagaggatgatatcaagtcccttaggtgccttatatgagatctcaaagaatttgatggatattagatttttttaatggaaagggtattagatttaagggtggagatttgtctcttgaaactgcaaaacttatgatcctatttgatgaaagtggaactccgtgcaatagttattgctattagaggaatgatgattgtttcattgttgaggagttaatgttgtcggcaattttgtcagctgcagaagttatatccagcgcattcccaaattggtgcattactcggtaggcaccccgagcctaatttatgtaggtctcgagagtttgaggcgtttgtgccaaaaatggctttgaattggatagttcatcatctggtcaacttcacctttcactttccagaatgaaggagaagttaaaagatgatcctgttttgtttaatattatcatgttttatgcttcaaagcaaaagcggccagcataatttttttttgcacagcagacatgataagcaggagggatgattggactcactagtcaccatgcattatctgtccctctatgtacacatttcacatcaccactttgaatatatcctgatataattgttcacagaacactgaaatgcagtaattgaggctgaaagatgtatctgaaacaaaggagatctctcttaggccaaaacgaattcaacattgcaccttgtgagattatacgtggatgctttacatgcctccaatttagtaaggatgctgctgaatccaaagaaaggagcgaagcattgtctgctgcagctaagaagtttaagctcccttcctctgaaaatcttggagagattgctgaacattgcaacgaaagaaagtgcgccggccattgtgcagaagaagctggtcagaagctctacatgtggacacttataaagaggaaagaggtactatgctccatcatattttggcttctgcagctgattttatataagctttgatttgaaaggcttctagttctagttctacttttgcagctccttgttgccgatgctatagttctggggctcagaacaaagttcatgtacgtttatgtgcccaaactaacggtatatatttgcctaacctcatgggaagcactttcttttgttgctgatcgttttactttgccttgatacgattaatcttttctatgtagatggaacggaggatacattatgatgaagttgagagcctatctattgagtgcttggaagccactggaatgttggtgcttgaagcatgcaggaacaggcctcctcaaaggaggggaaatcaagtgaactggtgaagtatagagcttttgaggaagtcatcatggtgatgaacccatgaagttgctttggtggttatttggttaacccgtccgaattgatgttatctgaagaaaatgagaaatctggagcaacagaagctggttgtgacactgccaagtcagttttgctgggtgatgaagccgtgaatgctctagttgccctggctgtcctgcctccggtgatacaattactcgagcgaagttcctgtggctcttcatgcgactctgcggtggacactggagtttttacattctctttggtgaacaacagtaataaaaatgatagaagagtagcatttaaaagttccttcagagttcatcaagcaaatatcaacttatagtgttgtagatgttccattgacctcaatgtcaagtagtcttcttttttacttcaggccacttgaccaagtcccagattcagttttgacagaagaaagactctgtatcggtgatgtatttgtcagttgatccttcatcagcttgtccggagctacctgcagttttttttatagtggtgaactcttacacatgtttgtcatgttgctttgttactctggtgaagaagaaaaatagtattgaagtttcatttgaatgaacatcttcaggctctttaaatcttgagcaactaccatttgttccttcaaaaaatcaaatctgagcttgagttgagaagcgaaatatgatagtaccacctcgaatatatatagatcatatcgtaaaaatgcagcttcctgtacagtcaaacaatctcagaatttctacccaaatcctacctccatgacatcacgaaacaaactgcaaatttctgtttctaacccaacagttgtctggatttctctgcacatcctatttctaacccaggaattgtgaactgtctaacatggattctaagcagagaacatttctaacccaggaattgtgaactgtacatctactcacagaactgtctgctgacccaaaaactgttccctctgaacatttactctcctgacccaagaactgtttgctcacttcccatggatgttcttcttatgacggtagtagtcggcaagattttggaagaagttgtggcagtaggagcattccaccctgtccttgctgcgcatcagcttgcgatggcaagtacagtagtggggcctcatggagcctgacgacaaactccgtggtttcgagccctcgaagcagctggtgcacggcttctcccctctccctgcctgatcgcactcgacgaagaacgagaggagagggccgtgctgcggaggtgtctcgccggcgacgatggagacgggcggctcctcgtcttcctcctgcaatgccgcagtcttgtcggtgtcggcgtcccaatcttgatcgaagccctcccaatcttgatcgaaggcgtcccaatcaggccaatcggcgtcgtcggcgtcatcgtcgtcgtgcattggtggctgcagcaagtgggcgtcaggggcggcctcgccggcgtgggcgacggcttcttgcagtggtggctgcagccaatgggcgtcaggggcggcctcgccgtcgccgacgtgggcgacggcttcttgcagaggtggctgcagccaatgggcgtcgggggcggcctcgccggcctgggcggcgacttcttgcgggggtggctgctcaccggcgacgaggagggcagcgccgcccttgtcctccaccgccgctcccgcaccctggagctgcctcccggcattgttgttggaggcgtcggggaggccacgcttcttgtcaccgttcttagcgtcggggaggccgctcttgtcatcggcgacggcggaggcccccgcaccctggagcggcgcttcccgatcgttcttggcgtcgccgttgaacgcacccttgccatcggcgacggcggaggcgccgacctgctcctcctctgcccccaattcttggagccaccggtaagcgccgtggccgccctcgtcggcgacgaggacaagcctgtccacgtcgtggggcggcaggtgttcgtcggcgacgcccccgccaccgcccacctcgtccaccatgctgagcccttcttgaatcggcatcagcgtccccgcgtcgacgatgccgtcgtcctcctctaaaacctcgccccgctcgacgacgcactgcttgatcacctcggcgaactggggaaatggggaatgcgtggtatttgatttcttgtttgatcctgacaccgaagcagaggaggggagatttatagtgagatttgtattgagcgcttgtggctttgtgggttcctcgcggatgggagaacgggagaggctgcaatggcttgatccaccgtccaagcgagatccgacggatataattaaacgatattggttaccgttaaacttagttcatggagggaaaagcttgcgtacctgttaatttatttttgttatctgtactttgtttaaggtagtgtttgtctaattcttgcacttggtggtttttgcctactcattttttaaccaggaaattaaccagagtagaataaaggaacgagtccattttataactcctttgttttgtggtaatatagaaaactaattctgaactttataattgaatatacttcaactttcgactctcaaaaccatgaagttttttacttgtgcctgaatatagagctgttttggttgatgtggtgtaaaccaaaaactaattttgagtttttaaaactatttaaagagtagaaaaaaagtatttctcgctaagtttttttttttggtacaagtgaaatagcatacagttggcttacgaacaatagattgaaagctaaataaacactattttttgaaatgggacgaatattctttatagcattgtagattgaatttattagtttaaattttcaaggcgaataagtctattgtgcctccctcaacttatgcccatggttgaatcgcatctctcaaccgcaaaaatgggtatagcccatccccaaactcccaagaccattgcaaatcgactccacgggtggtttcgtccaacgtggaagttcactcatcatttgacccttgccattaggtgggacccattcgtcagcagcttccacctcatcccatattctccctcacctctcttctcccctctctctctctctctcatctcttcctcctctcaccttccatcagcatagaggcagggcggcggcgatggcgcataggggaggagcttgctagccgaccggcctcgccgcgcgcgggtaggagctagccgggtgaccgcatgagggaggagctcgtcgaccggccgcacgcggggaggagctcgtcggcatagtggcagccagtaccctcgttgatctcctgcaacggcccgactcgagcacctagaggaggtgggagggcgaatgccaaatggaggacgtcgaagctcgaggaggtcgcaacggctgcgtaccggctccgtccgtgtcaaaccagcgatgcacggtccgcgacccccgcgctgcaaccgttggcctctgccccggctaccgagatcactagggatgtagacggcgaccggcatcggcgagcttgcaagagagcgatgctaggagcggtgttcgaaagctattccaaaaattgcctccgccgccgggcgagcttcggcttcctctgatagcctcgggggtctcgccggggcgcatcttctccgacagagggcggagcgtgccgtcagcgaggagctgctcggtctccatcagcagcacgccttgctggttgcggatccggatggtggcgacgtggatggtgcagacgacagggtgctgttgctgtgacggtggagatgagcacacccctagctcatcctaacacctattgagttgtgatccaaattcatttgcacataataaaggccagcttctgctgaagagaagcggagacccgtcgctggaggcttgggccggatatatatacctcttctaagccgtcgttcggcgttgtaacctcaccctgatatagtgaagatattttgctggctggcgctcgtggttttttctctcttgttttggaagggtttttcatgttaaatcttgtgtcttctgtgattgatatattgttatttatcgtttatttgcctatcgtttcctaagtcctaacagcaccgtgccccaagacgctagcacaaccagcaagtcgagcgtcgggaaggccagcggccgcgacggcaacaatggccgcatcggaattagccagtgcctgcgcttttctcagtggtggccacggcggcggcgttccggctccgtccatgtcggactagcgacccccgcgccgcacccgctggcctccgcgacctcacttcaccgttgcgcggttgcgccaatcccctctggcctccatggctgtctgcgagggaggagaggggaaataaataatgtaactaatatgtgggtcctcacctattttttttttactgtgagtgacacgtagaagccatgtggaatgaagacctagtcaagatgccatgtagatagcacataagttaaaaccgggttcaatactgtcgagagtctatttgcaccggtttttaagatatgggaggtattatacctggttttgcgattaagggatgcgatttcgaccaagtgcaagagatgagggacgtaaaatagacttattccttcctaggacaatcacgaagaacttatgatccattcagatttcaggcccaccatttggaacttttggcccatttctcaatattcacttacggccgaaacatttctaccttttgctgattctagcgtccatgaagttgcaacatgggttcattttcagttgatttagttacatttaagacaatttcgtcttctttagatttcaatcccacttgggtaatgttgcccccaatttggctgagtaaattgtaggagtttgaccatttgtgacacatcaaacgttgtagctcatggtttgccataggatgtttttcttcgttgtagctaactttatttttgagccgaaaatatgacccaattaaacaaagaaaaggtatggtaatttatgtattataggggataacgatccaaacataacgagattacaatacatgagcctaattttgaattcagagtgcaagatagtgggagaaagagagagaaggaaaagatagagctaatatatactagttgtacaatgaatttatagttagtagtgagttccgagacgtcatccaagtggcaccgaacaaaatgtaagtcagtgatgctatggtcaccgtcattaaaatgataagatggattaagaaaaacgttactaaccatggaattgctatcagattttcagatttgctctcattccaattctaagtaataacgtaagctagtatatttatgtcatgtatccaacgtttgcgttcacttcatattttttatttgttggtaggtaattacaacgactttggataattcaacataaaaatgataaggtataaaaatacatgtaggggatgtagctcagatggtagagcgctcgcttagcatgcgagaggtacggggatcgataccccgcatctccaaactttttaatagtaccttttgcattttttttcccttgctaaagaaattgttggtctcttcgctaatgttttttgcattttttcccttactaaagaaattgttggtctctttgctaatgtgctctttgtatagcccattttgaacatgctaatttggtttatctctcctccagattttatccatatagctgtaaactataacattcaaaagggttcaaaattttcaagaagagatattttaacatatacaataacaaatctacacccttagcccctaggtgattacaaccacgtactatactctactactaaccatggaacttcgctggtcacctcattttcagcctaattttttagcccaacgcaacactatcatatactaaggtggtgtttggaaaggagggactaaactttagtccctctcatacaaacataagttcttacaaaagagactaagggcttatttggttctctaccctaccaatttattggtagtgccaaagtctaggcaaaatttggcactaccaaaatattggtagggtaaaattatttggctaccatttggattgctaccaatataaagtcaaattctcatagtatagtaaagaaacttctagaaaatgaccaaatagtataagggaactaccaaatatttggcttcaatccaaaataacacatatactattcaatttgccaataaattggtagggtgtgtttttggtattaaaccaaaacggccctaaaatttttgtgagagggactacattcccaaacaccacctaagtgcgatattacgagcaatcaatcaatcgagtataatgcagcttaagccagccagccatcgccttcgtttggtgttgcacgtgtcaaatccccgggcgggccggacccaccgtacagtgacagatccagccactggcagttgggccgcgagcgggccaacgaaccaccaccccagcatttattactccccttgcaccaccacgcgtaatccacccaccattaaactctggccccacctgtcatccagcgtgtggtgccacgtccgtttccccttcccgggagggagcagcgtcctgtttgtgatttacccgtattggtttgtacccgagacactgagatgtggggcccacggtgagattggtggcttgcgcgtggtttttcttgtggtcgtaggcacaccgcccgccgcgaccgcccaactactcggtgagttgacttggtaataaagaagacgtatactcgtgtcatggaaattttcgtccaggtcctcgtgggacgacgaaattcaaaccggctccatgcatggcttactccgtacaccgccacacgtactccgtaacacgttacacgtctacgggtggcatgggcgagcgacatgagcggatcgctcattccattatacgttctgtttgctcgtcccatgtgtttgtttggctaggtggatgagcttcgatgaaagatggccgtccgaatttttatattgtttatttaaatggtatgatggatagtacggtctagaaaagggaatattctcttaatatgttggatgagtgtatccggccgatttgactggaaaaagtcatacaaggcatgtgtaatgtgtcatattctgattggctgtggttggtttgattttctgttagcaagctccaaatgatttttttctcctaaaccatttatctaatttatgatttgattacaccattatatttattacaattaaatctttaataaaatctcaggtgattatattttaataaaaaaaatatatatgataaatgtgacccactaacttttggcatatcccaaccatgctatatccctccaaccaaataagaaatttagtcatcctatatacaaatcaaacaaaaaaattagatcgctatataaaaaaaaatatatgaatggtcatatcccattcatgactatcgaccaaacatgcatgcatgacatcagccacacccacacacaccctaaatactctcccggtgatggccatatagtaataatttcattttcatccaagcattgccatctccataaaagtatggacatgaatggacttgtttgcaaacagtgctagagttaaaaacttagaatggacttgtttgcaaatagtgctagagttaagatgatggcaacgaccacccaacaccaatcgatcggctatcgatgtcacgatgcagcaatgtagtcctccggtccaatttccaagcttgtctcacaaagaccatagtcgacgatcaacgatggacagtgcttgccactcagctgtgaaaatcaacgttagtactccctcccttccctcatataaccatgatctcttcatttgatgtgtggtattattacatttatatatacaaattgagtttgcatacatgcatgaaagtatttgaggtagtaaaactcttgtttcttgtgcatggtgggtgttaaagggtgcgtgtttcttgatttcttgatgtttccgccgatactttgatacatcgtccgtatttaagtctatttttaagtttattcgtttttgaaaatacataagaagttgtataaaaaatcattttaaaaacatgctaactttgaatgaaagtcggactcctaattactttataattctcgccagaccattaaaaaaataacgtacatgatatatgatcaacatcccaataaagatttcgaattagatatcaatactatcaaaataaaaatcctatatatacattttagaaaagacaatctaacaataatacgattaaactagccctcacccgttgcaacgcacgggtattatttctagttataaatacaatataggaaagttaattcttccttaatattgataaaaaaaaaacttatacgatgatcaatatgaaatggagggagtggtactgtattagagttgacctctgggaattaggttgctccggcactccatggtactctctgattttcggcatatgataccgttaatttatatatatttgtttgatcatttattttattaaaaatatacacatattaaaaatatgagttgtgctcaaagctagtactacccaactaaaacaaatcacaccaaaataaataaaggttacgtatttttctaataaaataaatggtttaacatatgcctaaaagctatagatataatctaaagttaattttaagttataaactttgattatagaattagtttagggttgttttcatcagtttaggagttgttggcatccggctctccttttttccatttctacgaccgctagtaaaataatctaccaagatcctttaaagtcgaaatcactttgaaatgtaatctttagggattccaagtagattcatagttggctctacacaatttgtcaaatggtcacaaggtcacaggtgttctaaaaagatatttatattaacttcattgactcaatctagttgttagaacacactgtacatgggtctactatctcaatttgatgcatgtcgtcgcaagaataggtgctaaagtccctttttctccaattcaatggatacggttaaagttcctaagagacaacacgttgataataggtttgttgagacgagattatggcatctagatcttcttttagaattaaaagcccacttaaacggttcagtttttttacttagaatatgagaatacatagttgtaaaattttaaaaataaactagaaacccgaagttatttttttcaacttctctatattcttaccagatgaattctaaagttcttccaaacagactttgtaaaggagttgaaagtagtacccattgcattcaattgtataattgcatcttagtagtatccatgtgaactgttgaagcacaaatgaattaaaatgactttctgttcagtttaagcttttgattgaaacagaagactcatacataagttctaggagtacatattacttttttcacatcaaatggtgtatgctcctgttcatatattcctatgtcctcgtttactggtcactgttgacccgctagtgttttaactttgatcattaatagtttttaaaggattaagtattaacctatgattagtgaaagttatatagttgtattaatggtatatgtcatacttcaagtatatatatatttttttcagaaaaaacaaacggccaatgttttgaaaaaaaacaagtgacaagtatatacaaattttgctacatgacatcgtgaccacggtttaagtagtaaggcatcacacaaactgactttggggaaatacactattaagagtgtcttcccccaaaacttcgcgcggtgttaaaaccgtgaaatcataatgtgccataaaataacatgttatagctgctaaagcacaactgcacagatgaaactacccatcctttctattcaatttaaccttttggccgaaactaaactattcatacataatacctaaaatatttcttttccatatatccttttagtgcatgttactgtcacccatcctcctttttattatcactagacacaaaaatcccaacaaaatccaattataatccaaatagtaccccttcttttcttttttattttttacaggtcaccgttccaccacatcgcacatattcttcgtcgctaattagcttcacctgcgaccacacacacaccaccaccaccgccgcgtcgccattccacaccgcgtcaagcagcgcacgccatcgccgtctcctcctcttctccggcgtccaagaacccctcccgtgccccggccatgccgccgccggagccggacaaggacaagccgctgccgaagcccaagccgcccaagcccaagcccaagccgcccaagccggagccggagccgaacacgcgctcggcgccggagcgcgaccagacggccgccccgtacggcacggtgccccccgaccccttgtcctgcgccaccgactgctcgccggactgcgtgttctaccacctgtgcccttc

SEQ ID NO: 60586 - DNA, 3047 bp, Oryza sativa
cggcatcgggctcgccgtcgacggcggcggcggcggcgggggaagctgcgcggtgtgcctcaccgagttccgcgacggcgagacgctgcgcctgctgccgcggtgccgccacgcgttccaccgcggctgcatcgacacctggctccgcgcccacgtcaactgcccgctctgccgcgcgcccgtccagatcagcgacaagtccgccgccgccgccgcggcggcggcggccaacgccgcgccgggcgccgccgcggccgttcccggcggcgcgcccgcgccgaacccgcgcaacgcagctgccgccgaagccgacagaggagagctccagggctcgccggagcgcggcgtcaggcgagccgcgtcgatggtgacgctgccgaggcggccatggccggaggtctcgctccggtcgccggcgtcgaacagtgggcgcatgggcgagatgggcctcgccaagatcgctcgactgatgaaattctcggaagtgttggagatggccggcatcggagcgaccaggtcggtgtccttcggcggccacggcaggtccggccagtccgccgccgccggcgccggcaacaacgccgacgagatttcacggtgaattgctgctcttctgtgaagggatgaatcgctgaaggtttcagattttgggagacatggaggtgtttggtttggagagttttgtcacaagggaaaggtaaaaaaagtttatctttcctaaatcttatgtgtgattaagcaaataaataacatgagctttgtgcatacaccgcgaaacgtcagaaattgtaaatatgaattcctgacaaaaaggagatgtctttgtatgcgagtttgtaagatataaaagagatcactgctgcctgttcattacagttcatgaaattatatgaactatgtttggacttgtctttgcatcacctctcttctttacttccaatcatgcaagatgttaatttcaccaagatgattcatgactgtcggtgcaggatatggctgtgtcttgcctctttgatcttttatcaatctgtgattgttaagagattttgattcactcatcaagctatgggacttgccgacttggtgtttcttcatctctcttctttacttccaatcttgcaagatgttaatttcaccaatatgatggattcatgactgtcggtgcaaggagaagggttgtgttttgcatctttaatctttcatcaatctgtgattgttgagagatttttattcactgattcactcatcaagctatggacttgtgtttcttcatctctcttctttacttccaattttgcaagatgttaatttcaccaagaaggttcatggctgtcggtgcaggagaggggttgtgtttgattcttcgatctttcatgaatctgtgattgttaagaccattgattttgattcgctgaccaaacaacaaccttctcaaacctcatgttcttccagtttatcacaaggttgttgattgttgcataaaagtaaagcaagcaacctgcacctagttttaattccagtacttttcaatgtggttgaaacatttttgatgactgtgatcagaccaaagtacaggaaatgtgttgcaacttgtgaggaatttgttctgctgcaccaatccagaatgaactggatcctgttccaatcctgttcactgaaaaagaaaagggaaaaagaaaaaagaattcagcattgcatctggagcctcctgatttgctcatccaatggagtgcatcaatatggctgaggattctcaaggaagttgcaacgacaagccacctactttttttcccatgtcaccatcaagctactgacactgcattaaaaagatgatgctacaccatttggaaatgctaatggtgtgacaaagcaaaggagggatgcaagttaggcagttaaccttcagtcacctcacaaggcactagagcagtagtgagtagtgaccatcaattatatatcgacctaccattagttgcaggtcattgttgataaccaagtaatatggggttaagttagcattgtgttattctcaaggctcttgagaaaatggagtagtagaaagcaagtacctttcacaagttattcatgcttttttgttagatgaggggatgggatcatggtttacaaaaaccaaagaaaatttgtcggtttttgtgaaaaccggacttcttggactggcttaggaacatggaccgctttgtttacagatcaagttcatgaaaaatttaaactgagttttatttttcttataaaattttaccggattttattaggagtcaactgcttccagatggttttcatcaaagccatgaaaacctctaacctctggaatttttttttctcgcaaacggtctagtgaacctggatatgattggtgaggaatgtctgtagtacagctgatgtagtagcagacaccgacgtatgcatccggatccatatatcagccaccgctaaaatgtatcagtcttactacaaaggatctgcatccgtatgtgattggtgaggcaaaagtaatgaaaaagtttggcttggtttggtgtacctttcacaagttaatttaggctttaggataaggccatggatgattggacagtcttgtgtccttgtgtagagcctttagtagatattttggttttcttgaggctatgatatccctgtcattttttgctcagagtgagaaaaatgattaaacgagtgttgttagtggagtcccgacacgcacggcagatacttcactcgcacagtaccactgaagtgctgttttctttgcatgcttattcacactcgctcagtgctgtctttccatgcttcacacttgccagttgcctgtctctgtctacatcaaaacaaacaaacaaaaacaaaaaagtaaaaaagaagagtttttttattgaaaaaaacagtaaaaagaagagctgagagacagccttgcatcttcactgtggaaatcaaaatcttaaaaaaattggcattgttggtgacactgcgaatagcgcgtgaaatgcctgagtgcaaatatgctttctgtagatgactcacacagatat

SEQ ID NO: 60587 - DNA, 1819 bp, Oryza sativa
aatatgtaccgcaaggcgcaaacactggaaaatccattattcccccacaccgttttgaacatgaaatttggtctcaaatttctacattatactcgagaaattttcctcacgagagcagctagagggcattataactcacatgagcccttcaattttacaaaactcttgacaacatggccatttttgtacaagcgtgacaaagggaaggcctggatcttgctatgttcagcggacaggagaaatttggacagttctcctttttgaccctaagacaaaaatgatctcccagacggtatcacatatatctccagtagacgatcagatgataaattaagcgatgaaaatcagagcctggacaaatttctcaatgtagaaaccttgctaagagatcctctttatgctgcatatagtagtatgccaaaattgcaagaataataaccagtatcatggtccatatacttatacctgccagaacaaagcaaacatatttaggaggacatgcacgactggcaagtataaaaaacaataacaaataaagatgtggcataccacgactcttaggtgatccaattgaagtcaccctagcagtagaatcgaaggaagtcgacagcaaggtcctgatataaaatagaataccaacattgagaaatcacatctgtcacgtttgtaaactccaagcagatcgagagtctacggcatatatactgaccttgaatcttgagagaatgccaatgtagtaataatgccaagatgtgcctttttaactgttacaagcgaccgcatattttttgaacttagtacaataatgcttccttcaatagttccactggatatggaaatgcaaacaaattaggcttctagaaggtgcatccacataatctcaataagcttaatcataaaatgcagtaagctgttgattgaatttgctcacattgcaagaagtgtacaatcaggcgagacagcaaatgctgaaattgcctcacgtgttattttatttgacccaattctcgtccacgaggtcgtattccaagatattattttcccataatcacctaaggaacaggtttatgttactgtcaggacttaccctagcagatagtattcgatctataacatggttaaataaagtcttgggttaccttgcatcgctgtaacaaagaggatctgactgttgtcagtctgattagagaatctgcagaaaccaaatatttctccctggaaatgtgaaagcaagaaactcacttaaaacaaacacaatacaccaacatatgttttcaaaacacataaacacacacatactcactgcttctcttgggagattagctacaacttctgctgacttcaagtcccatactctacatgggccactgcttctgttcacagcaaggaaatgttcatcggagctaaaagcacaacacgaaacagaggaaacccatcagtatcacgcaatcaataatacctaagttgcgagaaaagaaagagaatttttacctgaaggttaaatccttcactgatgttttcgtatcgggttcttcaagaatggaatccatggaaggccatttgaagacccttaaatgaccatcctacataattgacagaaaattgatttggcaccctaagtagaaatcatcaaagaattcccaaggcacgattgtatagtacagaaatcaaattttgtaatgaatattttgccttgaaaaaagtgacaattggaaatattacagctatagacacaaattaatatagcctcgtaagtgtcccgatttgcttttaactaaagtgaaggtgaggatgctacacataaaacaacataactgaa

SEQ ID NO: 60588 - DNA, 11544 bp, Oryza sativa
ccctttgaccaacacaaagtcaccaacactatatacacttctggtaagtgacctcaatctctaatgaatcattataaatagtaaacagaggcacgcattgctattgtcaagttcccatgcgaattccacaatttggttctcttaatcatgtacacaaaattgttgctcatgtaaaccttatcataatttgcttgccaaattgtttctgcatgaagctctgaagtagatgactatagtttattacatcttctttaccaaagacactgtaacgtttatggcagtcagattcagaaagaaagtttttgtgtgcataagcaatggccagtaaaaagtgaaaaggaaagaaatttagcaaacgaaaagaaggcaataaacagggcatcttccaaagtatataggccaaagtacctatagggtaactggctacacgaggaatggaatacaaaaatgaaaaaagtaatgcataaagaaaataataatctctaatagaaagcaagttatatccacttacctcaccaccagtcgcaagtattgaaccttctccactgaatgacacagctaactgcaaaccagcatcactcaactctgtcagtgcctcctgatcagccctcaaagctatattatcaggtccctctccttcctgtgattcccatcgaaataacctatatagttgttacatggtcagaaatcagaattaagaagtgcaaaataaccaggaaaaattctttacaaaagttgaaccttctctcctaaaaagaagacatccactatcatcgcgtaaaaaggtacatttcggagctaatactaagatataatctagcaattcatctacagtaagcaaataacaaaaatatgacttctgacatgttatgggcgttgcccataacaaacaattcaacaagttaatgacaagacaattaatacttacaaaagcaggaactaaaatctacatgccccaattctagcttcatagtaaagcacggtctgtaagttggataaagaactccacaaacttgtacccagccgtcgttgtccaacctcatcataatattggtttctacaagcctctcagaccacacatatataatcttagtgtttacatttacatgattaaatcttagtaataatggaaaaggtctacagtaccccctctctcctctaattcttcccgaagttaagcttcaaacagttcaacccttaaactggataaaaaaaaacaccctcaattttcaataccaaatagattacacctaccgtaagcacaaaacaaggcttgttttgtgccacgtctactgccacgatggcaccaacacaaagcatgcgcagcagagggacctgcaagctgtaactacatttttctttccctctaccatcttcttcccacattcttcgttccctgaatccctaaccgcattgaagaggtgacatgaagagtgatcccccgtactcacgtggcgttcgttacggagaacctcaaaagttgttcaaaatgtggttgtatgtagacagtacgagttatctgagtcatgaattgaattgacaccttttgaagcattttgaacaattgggctaactagaattcatagccaaccaataccacccccagctggcactggcggcaccatccgcagtagtagcatgaacacaggtagtagatggtacagaaggacaaatttgattcgagaggagagtaacctgcagccattggggaatgcgcagaggacgccgtcgccgcgcgggtggacgcccatcctgtacggcacctgctcctccgtccccatcctcaacacctgcactccccacccccacccccaccaccagcaacgtcagatcagcacgggacgagatcgagatcggcgtggaaatctggcggagatgaagaaaccggatcgctcaccgggtcgggggacagcgccgccgccgcggccgccccagcggaggtgtcgagcgcggccaccaccagcgcgttgggcacgccgctccgcccctccccgccccctcccccgagcgccgccatgagcggcggaggcggaggcggcgtagcgggggactccgacgaggccgcgcccgcgtccgcgtccgcatccccctcctccaccggaggaggcggattgaggatgtgggcgaggggcagccacgaggcgcagtagatcgggaacccgtacgtctgcccgccgccgcgccgcgccatcgccggagttggaggtggtcggcggcgcaagcggatcggatcctctctgactttcgcgtgcggttgggctcttgaatcgaatgcgcaatccaacggcgagcagcgaacaccggtttattccggtttgcagaaaaaaaaccgagaaaatatcagttcggctttcggtttcggccgaagaaaaccgggagcacgccacctccgcacggccagcctccctccgtcgcgtgaatggctagaggctaattttcggttttatcggtgggtcggtttattagtggagttgaaagccgagccataaaccgaacacggaacagaagaaaaaaaaaaaaaggcaaacaacaaccgctggccaaaaaaaatcgaactcagaacaaccgttggctggatacacctggctaccatccaaacacgcccacgtattttcttcgaatttaaactccagtgcagtgtagttagcactagcatgctaagaagattgtgtttcatacaacttgatggtctttgattagatcttttggtgtgtgtatttaaaacagagactgaagatctactacttcatttcactgataaaagaaaagatacagaccgatcgttcacacacacacacacacacacacacacacacacacaagaacaccgccctacaagcacatcaggaactccctaaagctacactaaatactttctggaaaaaacaaaagcaaaattctagcatttttgtgccatcgtgcaagccacctgatccgatcggactgttaagctttgatacatttgctactcattacatgctgatcaactactgaacaacagatcatcctctgactcatcttctgacgatgatggcgaggccgtactgtcacaagtgaaacatgagaaatcagaatgtagctcacaaatcctatcttactataaagttaccccccactaactacttaagcttaacatacaaggatgccacatcatcatccactaacaagatgcatgccatatcatcatctactaacaatcatcacatttaaatatcatgcaaacatgttatatctttatagagcttttcaaagacaaacatgttaaattatcatccaatataattcacataatgtttcagtgtatatctttattatgttttatgatatcatatatacttatatagttcatcatcacttagttaatgtttaaatgattaatttatggtccaaattatctttctctttttttcctcaaattaagtcatatcacatcaattgtttttagcctttagatgattaatctacggtccaaactatctccctacttttcttcttccataaagtcatacctccttactttttacgtttgaatcaccattctacatactatttaaatttaaattatcataagccacattaatttacttaatctgatgttatctagctatcttacacgttatttttttttcgttgttatcatactaaattcccgcagcaatgtgtggggtttcacctagtactacaattttgaaacccagtcgctagaaaaatgaaattatttcgggacagagagagtactaaaataaaaagtagtgtagcgacaagcgagagacgatgaacatacattgcttttcggttctgccacgaccactgcagccacttcagtcgagtttccttcgaatcgaatctcttgaagacggtgcggcgtgttcgtgaccttagtagctctttggcaagatgatactgctccgagttcgcgtcaaccccgtcctcccttaaggtcttcagcatttgaagtctctcatctcgctctctctgaattctgttgattgattgttgaattatgttggatatgcgaccgatgtggtattcgatgaatgatctcttcttcttcttcttcggttcaaggctgtcaaccacttgctccttcgcgtcctgcaattcctgttcattcaggcaagaattttgaaaatacaatcagtagactagactacattttgtgatttggatgaacaaaatttgggttgtgcgtgtctgaatgcaattcgcacgaacctgtgagtaataacaatacttgatccaagttcagcaagactggaaaaaagtagcacatacaagggaacatgaaaagctagttcagtcaactaactacgtaccattctaatcgaaacaaattcatttttaactttaacaggaaaagctactgtctggttgtcttattttccagcaattcaattttttttttcaggtagaaaatacatcggcatggcctccacattccatttcagtgttgtgtatgggcagtttttctttcctcaatgcatagttgaaggaattaaacaaactattgaataatttgatccaatggctgcaagatacttgccgtagtagcgcggtggagacgacgagcaggagtcgaacgcaggctgtagcgcggcggcggtttaggaggcgagcacgacgaggtggaggacgccggcgagctcacccgccggcgtggtgcctggcgcaatctctgacggtggggaggcctcatggccgtcgacctttgtgatgccttaggcgccaacctctgcttgcaatgtaaatctgcagggaaagaaggatttttttttggttggtgattttggggctggattgtttgcagcaaactggagcaatgattcacctgtgcattttgcataatgcatcttatttactagtaatacacaatgtgtggttcatataaacaagttcagctctgccaaactgcggttgtactgaattaatggaaaacaaacttgggctgacacaatggctcaacattaactaagcaaagttgtgcactgtcatacattgatacatacattactgcgtgatgcaacttcaattggcactgaattaaattgtgaaccgatcgaaagaatcaagtggagcagaatcttggatctccagcaatgcacattggaccaacgacagagtacacatgcgtttctgccgaaggacaaaacgcttatcttgcctgaatggggtgttacctcgttccggctgggatgtggtcaccggaccaccggcgctggcgacggagcaacggccggcgcggcgttccgccgtcgagggaaagattgagtgggggattggagccgaggaggcgcctgtagcaatggaatggagtggtggtggcttcttgaataagctttgcccctctctagaagagcaacgttaccctgatacggtagattaccgtcgtatcagtatctgatacgcctccggatacggatacgtgcgggatacgtccggatacgtatcccatacgtatccctcatttttcttatttttagataattaaaataaatatggatactctcccgatacggtgggatacggacctgatacggggtaaccctaaatcgcatcgcacaggaacaaaacacgctctccttctccacccgcgccgcccctcgctctcacaagtcacaactcacgctgcccctctctcctcgcttccccgatccccatctcagcgccgccgcctacgccgtcgctgcgccgcctcgccgccgctagcggcaggcgccgcgctgctgcctacggccggcacagcgccccctcctctgcgctctcctccgcgactcctcctccacaaggtgccgcgccgcccgctccaagcctccaaccggcgcccagcaccgtgttggcttccttcgatcccggcctccgacgacgctgaggatccttaggtaagtgaatatcccctccaagtttgatctgcactgtgcgtagtgttccggttcaatttttcttagtataattgctgtcatctttggtagattcaatggattttagaagtggaagctcgaatgatagtggtagtgctagcaatcctagtggtaatactggttttgatgcatcgagaccatctagtgggagtggttcaacaatgggagggcatgcaaggagcattttgaatgctgctcgtgtgattccacccaatgatgatgaaaagaagcccttgtggaggtatgttgagctgctggaaaagacagggaaaggtcaaggagggaatgcaaggttcagatgcaggttttgtaaccaagttatccatgggagttactcaagagttaaagcacatctcttgaaaattggaacaattggtgtggctacatgcaaaaaggtgacagtagatatacttgggcaacttcaagatgaaatgactagagctgaagcaatctctgcaaggaatttgcctaaggacatcccactaccaacagagagtgtgagtagggggaagagaagggctgtttcagctattgagtcaagcttcaatttagatgctcgtgccaagcttgatgctttgattgcgaggatgttctatacatcaggtcagaatatagcatgttttttttcagttctaacattatcaattttgttttgtttatgacgtgcaactaattatatgtgtgcatttggtttgcaggtattcctttcaatgttgcaagaaatccatatttcaggaaggcttttcagtttgcttgcaacaaccaacttggtggttatacccctccaaatttcaacaaattaagaacaacacttcttgttcaagagaggacaaatgttgagcgcttgctgaatgctctcaagtcaacatggtctactaaaggtgtgagtattgtatctgatggatggtctgatgctcaaaggcgaccaatcttgaattttcttgcagtgacagaagatggaccaatgtttttaaaagcaatcaatactgaaggagaaatcaagaggaaggaatatattgctgagaaaatgtttgccatcattgaagaggttggcccaaataatgtcgtgcaagttattactgataatgcatctaattgtagggctgctggattgatggttgaacaaaagtacagccacattttctggacaccatgtgttgtccatactttgaacttagccttgaagagtatatgtgctgccaaaaactctagtggggatgcttttctagaattccaatggattagtgaagtggctacagatgcatctgccataaagaatttcattatgaatcactcaatgaggctctccatgttcaatgattttagtaagctgaaatttcttgccattgctgatactagatttgcatctactattgtgatgcttaagaggtttcgtgctatcaaagagaacttaatcttgatggtggctagtgaaaaatggaatacctatagggaggacaatcaagttcaagcacaacatgtcaaggagaagattttaaatgatttatggtgggataaagtgaaatatatcattgatttctgtgagcctatctactctatgattcgtgctgctgacactgacaaaccatgcctccatttgatctatgagatgtgggattccatgatagataaggtgaaaaaaatcatctatcgtcatgaagggaaagaactagatgagcaatgttcttttttctttcatgtgaatgagatcttacacttccggtgggcaaaaagtactacccccttgcattgcttagcacattcactaaacccaaagtaatgatgttctacctcttttcaatttttatgtgcataatttataattgttgctagcagctcaataatcttttttacaacatgtaggtactactatgagacttggttggaggaggctccaaaccaccaagcccctcatatggatgaggagatttcagatatgagaaataagtgttttagaagatatttctctggggatgaattgagaaagatcaaacaacaatttgcagatttctcattgtttggcagtgggtttaattcctttgactcaattgaggatagagcccatatgaatgcaaagcaatggtggggaatctatggtaactctgcacctgagcttaaaaagttggcactaaaattacttggacagccaacatcatcttcttgtgccgaaagaaactggagcacttatggtttcatccatagttcaatgagaaacaagtttagttccttctcttacttatttagtttcctgtatgttagtaatgcatgaaattaacacaattgcattttttttagtcttaggcctgcacgtgctgaggatttggtgtttgtgcaccaaaatatgcgtcttctttctaggagatctgaagaatactacagtggcccatcaataatgtgggatgttgcaggagatagatatgagttgtttgatggtggtgctgattttcttcaacaagctgaactgacacttgatgagcctgaccttgagagactactggaagatcttggtgcattggacatacaaggcgataacgggccttcatccacttcggttccaatggatgaaatcaacaatcaatttatctagtcttgcaatctagttattgagttgaatttgaagtcatggacaagttaattaattctaattagtttagcgctgtggtgatgctctactgttgatttatctactatgtgaacaattttatctaccatctatttgaagaacacatgtgttgtgattcctattttttaagtccatatttcacacttagtttttttgtatttttaaattgtatatatgtatatattcgcgtatccccgtatccatgtttttaggaagacggtgtatcccggtatcaccgtatcgcgtatccgtatccgtatcagcgtatcggggtaacgcagtagaagagtcggcggcttcttccagaatccacagacttctcgtctgcaagcagtcatagttcaaatttaaacttcaacaaacttaaattttaaagttcttttggttttttaatcatagttgattttttacgttaactttaataccagttaaatatagaaatataaaaaatttactgcaaacttttttcttcgtttatgggtgtgtttagttgaggaaaaggaaatttttgggtgtcacattaaacgtttgaccggatgtcggaaggggtttttagacacgaatgaaaaaactaatttcagaactcgtctggaaaccgcgagacgaatcttttgagactaattaagccgccattagcacatgtgggttactatagcacttatggctaatcataaactaattaggcttaaaagattcgtcccgcgatttcctccataactgtgcaattagtttttctttttatctatatttaatgctttatacatgtgtccaaagattcgatgtgatgttttttgggaaaaaattttggggaactaaacaggccctatttctcaacgataactctatctcaaacgattggggtatggtgacaaaatttgaagagaaagaaaaaaaataatttaaaaagacacttctaatattcgaaattgtttgtgacttggaatatggccaaaatttgtcagcgttgggagatttattatacaattgattaggtctataaaatgtcccatatctctctcaaaattcaaaatccatccatttgctccatcgttatattatttgacaaaattaaccatctccattcttttacctcccatcaactttcataactactctcaatcttaaaccagaaggacaagaattactctcatcatagtgattactacagttttattgtgccaacccttgtaaaccttcacaaattttttttttagagttgtcactcacacgttcatcaactatcaactagcaagcgcaggatagcccgccacaatcacctaaaaagactagagcccaaaaatactatatttcttcgtcccggaaaacttgtcgttttatggttgagtgaacaaattaactacaagtaaaaattaccatattacccttatttaatcattgcatttgtcacttcagataatcacttctagtagaccatctatcgcattgtacacacatagatagcactagtagtggcacggttgtatagggaaatagtatgccaaataaatcgatggaatagactaggctcagctcgttggtcaagatgctgtcaagatgctagaacgataaattttgtgggacattttttgaatagcggaatgacaggctttccgggacggaggaagtattccacttactaaataccaatatacctaaatctgagaaaaatataaacccatactagtcgaataaaaactacattttaaccctacattttatctgtttatcttactttttcatcacatcaaaactttcctacacacatgaactttcaacttttccgtcacatcgttccaatttcaaccaaacttctattttttgtgtgaactaaacacaccctagttcgaagatagaacacacaagctcatgggtgtgtttggctgcaaactgtggctagtagccattggctgtgcgccgcagccgcatacactgcgtgtagcagcagcagctgtttggaaacttgcagccaaacacaacccatatcatcagtacttgagtcggtctcactgcttataaaaaaacatgcaaatcttccccgacctctcattcaagagttgcctttatgcaataatgttggctgccataatcaattttagttttttttttgtctcctctcttaagagctatcactcatttcatataggttgctttattgtttctgattgcgttttataccacttctcttatactatactcagatatgaaatagggaagatggataaatttgataggtttcgtgatagcgatgtcagtaatttgacgagttttgtgataatgatatatatgtagaatgatgtgttttttttactaagacaattcattagtactccatccaatgtaagtcattctagcattttccacgttcataatgatgataatgaaactatatagatatatatgtctagatttattaacatcaatatgaatatggcaaatgctagaatgacttacattgtgaaccggaggaagtagttgattaattaaatgccaaattcatagtaagccatatgatagaagattgaaaatttgtgaaaaagggaagcaatttcgcctcgtttttggatgcccacaatcttaaccaagaacttcaactcgtgcgcccccaaaaaacccccacctttctcttatcccctctatccgccgctcgccggccatctccctcccccaccaccaccaccaccgccgcctcctctccggcgagatgctgacctgcggccgcttcctctcctcctccgccgccgcctccaccccctccctctcccccttccggaacctaaccctctccctcctccgccgtccccatctccggctcctctcctcctccgccaccgcctcagccgccgccgccgccgtagagccggacaccaagggtaaatatcctgaaccttcaaactcgagggaacacctcgcggtttgacagcgagagccgttctgagctgtgggtgtatgggtggtcgcaggtggcgcgggtggcggcgccggcaaaccgcagtggaaggcggc

SEQ ID NO: 60589 - DNA, 1196 bp, Oryza sativa
  unsure (1)..(1196): unsure at all n locations
gcaatacaagttggatggataagatttaagcttgcgctgtaaaattataatgcaaagctcgtgattcgcaagacttttaaactgttggataagacttttatggagcttgtcattgactcattgctgctgctgctgtttgtagtttctgattctgctcttgcgtgactgcctgcaatagaagttggatgaattaagattaagcttgcactgtgaaattatattgctttagtttgtgatttccaagagttcaataactgttcgagatgattgatagaaaaatttgcaactttcgtgtgaacttagacatgaactggttcttaactggcctattcatatggttaattcattggcatgtgttatgttactttctgactattagtgagttgtgcctattgcaaccttgtaattttgggggtagcaaaatattaggaagaaccaaaaattgaaactagaaactactctttttggccagtagtcatggctattaattggttatttcgttgattatattggatcactgattgattctgctttactgatcttgtgaactcaaaattactcatggcttcatggacttatccttgcctggacgacacttttgtttatggcgtaaatatgatactgtgttactgcgatttaacctattttggcatcaatgtctcattgttctaccgaagacacgtgtgtatctgcttgtgtgtatgcttgcagtgattgaacatagttggttatttaattctggactgagatatggtggcaacaattcctaattatgacagatggcaggaagttgaacggctccgagctgaaagaaatgcagttgctaataagatgaaagggaaattagaaccatctgtgcgtcaagcccttgttgaagaaggtagaatgtttatgaatttattttctaaaaaaaatgaaacagcgataccaacatagtaatttttttttataaaaaaattggattgttgcaggcaagaacctgaaagaagggcttattgccctagaagaggaccttgttcagctgactgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60590 - DNA, 14443 bp, Oryza sativa
  unsure (1)..(14443): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgcaaggagcgagaagatcagttcaaagtcgtcgttccgcgatgatcaagtgaagttttctcggagatgacctaaacccaatcctccccgagagggtagtttcgttagcttctagatcgtgtgttgcttgcttgtgtgtaggggtatggtttgcatcattggtggggatgcgaccatactaggttgtttgcttaaacaacttgaatcataaaatccattcacaacagatcaataggcaagtggtttagtaccttatctttagtaacccctctcatctccccctccctctcttgtgcccgcagcaattggtcagcatgagggacaatttcaacggatcaggatcccgtcagtttcatggatcaactcagctcacttctaatagtattccacgtcagcctcttgaagatcagcctcaaccccaagtcatggctaatcaaactcagacagtggaagagttgttacaacagatgcgatgtcggtaccaaatataccagatgcaacagatgcaacaacaatgtcaggagtcacgtcaatgtcacccaccgcaggtgcgagatcagatgccagcccggaacccgaatcagagtcagagtcaggagttcccaatatcggcaccgaagacccctgtcaaaatgcggtcaagatccccgaagataacgacagccaagtcaacgtcagaccaaaggaaagtaagtgctacctgttatgactgtggtgagcaaggtcattatgtaaggaactgtccatggaaggtgttcgccaggtcacctgaaaaagacgagaagcagtgcccagggagtaaccaagctccaagtcagtctaccgacaagaaggatggtactttgcagcgcaactctggagcgaataggacagtgatatggaagatggataatggcaggaccatcatcatcaccagttcagaatttactcctgaagatgcagcaaggatacccaagcgtcagagaggaagaaataccttccgaggagcgcgtcagctaacccgtcatctcataaagtacggtccgcccagacccgaagatgatgaatcaggagaacggttttctgctgacgacgatgacgacaacgatgatgataatgatgacaatgatgatgcgacccttgacagtttcagggaaagagagttgaagttcaaagcatgtgctagatgtgggatagtcggacacactgctagtttatgcctccccacctgccgctgtggtgaatatacccattactcagatgcatgccctttgaggaaggtaacatgtttcttgtgtgaaggaacagatcatgtgcctaaggactgtcagttgaacgcggtcatagctaagaccaagaaagaacaagggacaaccgtgcaacccattcgtcaaccaatgacaatcgacaacagcggtcacaatccttctgctctttctctaactccagctccagtggaagccaaccatggaagaagcaacgtcaccaaggatgttcataagcctctgcttgttcccgtttcagctgccaaagtgcataatcagaagcctgcaccccaagaccaagcaagtcgattatgtcgcaactgtcgtaagccaggacatcgtttcagtgattgtcctcttccaagagcagcaaaggcagttcgtcgtgattcacaagttaccagcactgcccacgacaccaaacgacacctgaatgtgcaacctccgccccaacggattatcgtcaagggcaccgtcaaaggtcgcattgttccaccggcaatcgtttcaagcctacaacaccaacgccagcagggtaagcaatgccaggagaacaacagctcgctacagctacaaagaggcggtacgctccttcgtcagcacccgcagcaagtgttgtcagcaccgggtcgcccaactgttgtcagttctagcaatgcacctggtattgctccaatctggaggcccatcgacaaatcaccgctcggtaaccccacgggcaagaagatcctacccgttacagctgacaagatagttgcccctccaccatcgaagatcaacaagcagagcaacgttcccggtgagacttctggtagtaggaactaaagaaaaaagtcagtcaggtttgaataatggaagcaatagcagttctagacaagacttctacttttcaagttcagtcgtgaaaagggcagttctaatcagcagcagtctacaattgtttgattttgtagtactcctcattgtacatatatgtttatggcagccatgtaatgaaaaggaaatattgaataaaatatgagtcagccagttcttctccttttatgattcaccttcagcatgcaaaagcaaatcaaaatgggtatctgtcagtgtctcaagaaaccaagggtttctcttctaactcatcgcaattctattgagctccaaaacctgtttgtgagccaatagaggaatggttaaccaacggagtgaaaatggttagaccctcaacactcgacataatgagatctctctaaaggcaacatcagtggtaccccaatgaaaagagggatggaatatttgaatgtgacatcatatagagactcttgggaactccctaaccttggaagctgttacaggatggtaagcggcaattacaccctagtggtgtgattatgaaacaagaatggtttccatagttcaaggcaaccgctataagttccagaaaaaaaaaatttctcatgaggtttcccagaagttgaaagagaaattgttccaatacatgggtcagaagatatagagtcgagtccagaaatgtgtagtcagtagggtatatggtagagaatcccttttcaacggaacatctttaccgaacatatgaaagcgaagttgttatgatcaaagaacaggaactctcggcagcatcaaagtcggtttccgatagttgttcagattgcagtattttccgaaaagctgttgcaggatctataatccgttaacccaggaagagttagcaaaggatggtcgaagaagtgaaatgtcatgccatggaaaggacctcttgagttggatctgttgggtgatcagtgcttgtttcaaggaatgttaactatgcaatctgtttaggcatatgacaccaaaaatcaagtcagaagcaagaaagttgtaccagcagttagaactggttggggaagtagtcaagagttagtaagatcaggagctaaatgagaatttctttatgtggaatctcccatcagcaactaaggattaagttccaaatcttgctgggatgaaagtgcgccgtcattactctattttgatgaatcggtgaagtttcagtttgcaaagtgagggcctttgtaagcaagagaagtgttggttatttttcaaggacaatagtccaattgttcctagtcaggagaaagtaagactactccctgtaaggggggtaggtctcggagatgagttttggctcacttcgtcgctgttttagttgaaggttcaacccagtgcaacaatccgggtagtacttgaagaagccagttgcaaggtgtcagcagagttacaccgatctcaagttatctgattgaattctgaggtacaccggtgaggccaggtcaatagctcagctttgagaagcagcatcagggacggttgcagttcagacaaaagacaggtcaagcaggtttcctggaattacgtgtcattcgagccaggacccgttcaagcggacgtaggatcaatgagttacaaatgccagatgcaagtcttaggaacaacttcacccttctctagccagcttggggaattgtcaggttatcagactgccagtatcaacagttcagatcaagataagtaagtttcgtgagcagccacagttctggtctgggtcagttcaagcagaactagccggtctagttttggcaaagcaaaggaatagaaaggtcgaatccagccatttcaatggtgcaggtttcatcaatcagtcaatcagccagttcaagatagaaaggggcagtgcagtgtgcagacccgtcagatcagtcagaccgacagcctacaccagctttctttctagccatcccagaatctcgggacgagattcctgtaaggggggtagatttgtaacgccccgattttcgttcgggtttaaaaatcattaaataatgcactctctagaaattaaataaaagttaaagcaatttaatcaagtgaaataatgggagagtttgaaattttcctttaaaaatcattggccgagaatattttgtaatattctttgtgccctaatatactctccgataatttcccgtgaattttcggagctcaataaataattttaataatacaaagttcattaaaccaattaaataaaaaaaagacaacgaattaaagtcctccttctttgctttgggccacttccggcccaagttcccttcccccccaggccggccttccctccctcggcccgctcggctctctctctcgaagtctacttggcctcccccaaccgtctcctcctctctccttccccccgagccgccgacaggtgggtcccacctgtcagggccatccctaacctccggctccctcagctgaaaccgccgccacggcctccccacgtcgccgccgattccgcctcctcctccacccgcgcgctcgccccgaccgcgggaccgcgtcgccccacctcctccactctcctccccactttccccctccaaaaccggcgccgaaccaccccacttcgcccacgtcgccggagcccactccgaagaccgttgccggtcgattccgccctccgcggccatgatcccaccgccccgagccaataaaaacgatccccgtggtctcctctcccatttccccaactttcccgagctcccggcgccctcgcccgctctcccctcgccaagccgagcagccgccgctcgccggagttcaccggccgctttttcccgccgccccagccaccaccgcgccgcgccgtgtgtgccgtcggcttcgcctcgccgtgccgcgccccggcctccactccttttcccccaaaccaccaccgaaataccaccccaccgtgaaaaccgagccgccgctcttccctccgtctccagccgctccccgccggcgataccgacctcgcccggtcgtgcggctgcctcccacagcgccgccgctccgtgccgcatcccggccaccggcccactcctcaaatccacccccgaagcaccattcccgccgcaaacccgagccccaccactaactgccgccaaccggccgcctcttgccgccattcccatctacctcacgccgcgccaccgcctccaccgcattcgctgcatcccatcgcccctcggccgtggctccgccgtggtcgggcgtcatcggaacgccgttctcgtcgcctcccgtgccgaccgccgccatcctttccgccgccggtcgcctctccgtggtcgtctcgcaaggaagatcgcgttcgcaaggataagagttcagaagatccaagtgaagaagcaaggcaagtcacacattctccttgagcatgttgattccaatttataaatgttttaccgtttacaaataaatatgcatgttttgctaattacatgggatccgggtattacctatctgttcgcttgtgccatgtttacttgatgtatgttctttgtcaaccttgggtaatgaatcaactagctcatgttacttatgtgacctagctagaactatatgcttagccatgcttaattaccactagctcagttgatgggataattacagtattagacctttttagtatcagaatgagctgcgtgctcaagacacctggccatgcttcatggtcataattatccaactaaaatgcgactgaatgatgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggtctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgactcaatgcactatagttcaggtgggttggttgggcctgttcaacgtggtgtagcgttgatcagtggagatttaatgttactttaattactcaacagttttactattttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagttgaagacgaagttagaagaccaaggctcagaccccagttgagttttgcctgtggagtggagctaaagccccgctaggatcgcctttttccgctgctgctgctttcgtttcggtgcgaggactaagcgcctcttttgtaagtattttacgctttatttacgtttggaactgtatattacttgtcgttttgtgtaccctagctggtcctggacagggatttaatacacaaaatagtctggaaatttgggctaaatttctgggcgtgacacacatcttcttagtaagccatcggagcagaccctttacagctatggctcatcccatatatgacggcgactctcgcatttcagcttccgttgattttctcccggtggtatgtatttggataccatgtagttcactatgttggcataccatgggttggagtcgcgaaccgtcatcagcatgtcatctctcaagaaatcatttatcggctattcctgcgtgttagtgatttgcagcctagacaaatgatccgctacgaaattttctactccctttttatccttaatttctaagtcaaattcttggagcagcaagatccatcttaagagacatggtttagcatctttcttagtgagcaggtactttagagtagcatcatcagtataaactatcaccttagctcctaccaagtaagatctaaacttatcgatagcaaaaacaaccgcgacaagttccttttcagtagttgcataattgaactgagctccggttagagttttcctagcgtagcagattgcatgatgctttttatctttggtttggcccaagaccgcactaatagcgaaatcgcttgcatcacacataatcttgaagggcagagtccaatcaggaggttgaatgattggagcggagacgagtgcctttttgagaatttcaaaggattttaggcatgcgttttcgaactcaaagggagcatccatagctaaaaggttggtcaaaggtcgggcgattgtagaaaagtccttgagaaaccttctataaagcgggcatgtccaagaaaactgtggatctccttgatgtcacaggaggaggaagatgatctattacatcgattttggcacgatcaacttcgattcctcattcggacactcgatgaccaagaactatctcttcacggaccatgaaatggcactttccccaattgagtaccaggtccttctcttggaatcattgtaagactttgtctaaattctgcagacaatgaccgaaggtgtttccatagacagagaagtcatccatgaaaacttccataatgtccttgatcatgtccgagaaaatagacatcatacacctttgaaaagatgcaggagtgttgcacagtccgaaggacatcctacgataagcataggtaccgtatggacatgtgaatgtagttatactttggtcctctggatggataggaatttgatgatacccggaatacccatcaaggaaacaaaaaaaaaagaatgacgttccaacatctcatcaacgaagggtagtggaaaatgatcctttttcgtagctgttgacggtcgttagcgatcagtttcgaccgtcaatattataaaaatagaggagaactagttatgcttgcaatgcatatatatactagaataataatattccactagtatttggttcagtaacccttttgcagagaataatcataaagtgaagtagaatcgacatcaaatcagacgatacatcaatcgaacgatgttgaggatcaaacttatgtatgaatgggttaagaactcagaattaacacgacgaatagctacgaagtgaagcaacggaggaggctgccagccaaaacttggacaagttcggccaaacctcccgtggcgccaatggatgcagggtttggatggacggctgggattgatcccgaatgatggttggagggtattaccgaccattccaaccgtcacaaccgtcattacctgcctataaaaggagatcctcttctcacttcactcacacacctcaagcaagagctctctcatattctctcaagttagtttagtgttcttaagctagtggaataggaatagagtagaaatcaggagtccggaagtcttcggaagagtttgggtatggctctagtatttagtatactcttctttatacatttatggtattgaaatactttccgagtatatgaatgtctactttacaatatgttcatgttatacagaatatgatgctagcttatctgggagatgctttggtgcgggtataatgtttgcatatgcaattactctatgtgacgatgatattcgagtagtatctggtaatttagacgtggtgtctagattacaggatatcattatttgggattatatgctgtggatgagaggtgggtcgctgatggtgacagctcagtacgggtattcctccgtgcatgtatatagtcctaagttaattccctggggagggtactcctccgtatttagccccggttgtatggtcatgatgggctgtcgtaaggaactcggcagtcaggggtggcttcttgaagtaccaggagggcatcggatcgagggtattagctagtatatcagataactacgatgtatgtatactatgtatactagaagtataggaatatactgtttttctcttttctttccacttagcttagatattttaatatgagaatgagtagcttcctgcttgtgtttcactctacccttgaattatcttttcccctacttagactatgattattacaagtaatatataaattattagtcaagttctcactaccatgatcttcccacgggattaaataaatacgatacccttggaatactctcgggggaaatgctacaatgatatatccttgcgcttgtggatgaactctgtaaccataatataccaggagtatttctgcgccattgctcggaattatatttcttgtaatgtcgttaagaaataccaacaagcatttctagcgccgttattgcctgggaagattcataatagagattacctgaactaatactttatatttacctctgtataatcactgccctttgcaagctaatcttggttgttttaacttttgttttggaaacagggtagtgcatgactggtttcaacttgccggaaaacttcaaagaaaatccagaagctttctttcggagcgtcagacagtgagtcgttgctccgcagaaaactctaccgacaaagaaaccagccgtaccaatgccaccgactttcaagactatggctgacaagaccctccgcgagttcactgctccctctgctgacaatgtggccatcgggccgcagatcaacatgggagacgtggatttcgatctgaagtcccgcctcatcacaatggcttaggctagcccattctgtggcaagcctaacgaggatgccaacgctcatctgtagcagttcttggagatctgtagcacgtacactataaagggtgtcagtccagacgctgtcaggctgaggctgtttccgttttcccttctcaggaaagggaagtagtggttttacgctaaccgtgctgctgtcaacacctgggacaaatgctctatggcattcctctcgaaattctttccgatgggcaaaaccaatgcccttcgtggaaggatttccaatttccagcagacgagagacgagtccattcctgaagcatgggaacgtcctcatcatgggatggacaactcgctaatcctgcaaaatttctataatggactcactacaatgtcccatgaccatctggacgcggcagctggaggagcgttcttctctaagacggttcgaggagccattgatctaatagagaagatggtctccaatatgggttggagcaaggaacgactccaaacccgacagcaaggtatacacacagtcaaggagacggaattactcgctgccaagctagacctcctcatgaagcgattggacgaccacgacaatcggccacaagacaccgtcaaggccttggacttacacgtcacgtgtgaggtttgcggtggcacgggtcattctgggaacgactgcccggaaacccatgaagaggcgatgtacatgggcaaaaacaacaacgagtatcgtccacaaggaggtcaggggtggaaccagccacgcccgtactatcaaggagaaaacaacaacagtaacttctctaaccaaccctccttgaaggatctcatttttgtgcaagctaaaaccactgatgctttaagcaaaaagctagctgccaatgacaagatcctagagaacatcaacgttcagctagatggtttcacttcctcttttcaaaaccaactgatcttcaataaaatgatagaaacccagctagctcaattggcttctctagtccctgcaaatgaaattgggaggattccgaggcggggaggtaagtccactcgtgatcggccgtatcctaaccctgcaggaactaatggggtagctagagaagcgccatctagtgactcggctaacaaagaggttcaaccagaaaaggccgtgccgcaagaatactacgacacacgattgttgtcgtttcctcaacggagtaggaaaccatcagtagacgagcagttcgctcgttttgttgaagtaatccaaaagattcacatcaacgtgtcgttgttcgatgctatgcaagtgccaacatatgcccgttatctcaaggatatactcaacaacaagagaccgctcccaacaacggaggtgattgagctgacggagcaatgcagcaacgtcatactccacaagctctcggaaaagaggaagcatccagggtgtcccacgatcacttgctcgattggggcacagcagttcaaccaagcactccgtgatctcggtgtcagtgttagtgtcattccaatggacgtctttgacaagctcaacttcacggtgttggcaccaacaccgatgcgcctacaactggctgactcgtcagtccgttaaccggcagggatagcggaggatgtgccggtcaagattcgggatttcttcatcccagttgattttgtggtgctggacatggacacaggaaaggaaacgccactcatcctggggcatccgtgtcacaccctaaaaatccaaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaattgaaaaaggtttttaaaagtctcttttggctttgggccgaaagtcggcccaaaaacctcccctctctctctccccggcccaagtcggcccagtccgcagtccgcagccgccgcgcgcgcgcgttcggtcgctgacaggtgggtctcgcctgtcggagtcgtcgtcttcctccggccgccgctgcccaaaaccctagcgccgctccgccgccgccgcttcccaaattcggccgcgcctttccttctccggtgaaatcaattgaggggaaacgatcttcgggatctcctctaccttttctcttttggaatctgtcgcgaccgagaaaaatacattttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactaaaggggggggaggtagagcaagaatgagtacaaccacagtactcagcaagccacaccggagatgcatgattaatgcaaggggggtacaaggggtaataatacaggggttaagttttgcagaaaacagcatttaaaggtcacttagttgcccaaagccattttataaagacaatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattccaatagattatactctgatcagaggtgtacatctttacccacaagacacatcttcctcacgtgtaaccacatgccacataccaccacggtatacggacggaagacgtgacatagtttccaacccatcctagccatagacaagagtaccgacccaaccccacctacggccggaacctccgggacaggcaggcaggattgagcccctagcagtaggacaccatccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaagtgatatgagaattcccaaagtctaaagttataaaaccacctaatgttgcctaattaatcagcgaagcatctacctaaattcatactagtggaaccatgaatagagtacccactagctagggttttattttcctagggtgaacaagataatagtaacaatagcaataacaatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttgttaaggaaaaattagagacttcaacggtccaattacgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccacgcggcagcctcacggtccacggtggaccgggcgcacccgggctcacaccggccggcgccgtgggccccacgcgtcagccgcacccgagggcgcgggcggctgacggccgggccccacgcggcagccgctaggcgcgcccggaggcggccacgtcggtgcgggctgcag

SEQ ID NO: 60591 - DNA, 1811 bp, Oryza sativa
attcctgcagcccggagagagagagcgacggcgcgagctcgattccggcgggaagagagggcggtgagtggcggaaacggtggtggggagctcggggagggtttatatagggttgggagtgagagagggcggtcggaggagggggaaacgggcgcgggagacccggccgccattaatggcgccggcgaggttaggggaggggtttccaaacgaatccgagggagagagagagagggaagaaatgggggaaagggggaggggatcccggggaataattccccccactttattgcgcgcggggacggcgggaggcggcggcgctagggcgtgggcggggcggcgggagcggcgggaggatagggttgacaggtgggccccacccgtcagcgagggtggcgggcgggcccgcccgtcagcggcgcgcgcgcggggagaggccgagtgggccgcggggagaggagggagaggggagggagatgggccgggccggccagagagagagagggaaggaaaaagagagggagggagacaggactttggccgcgggccgagagagagagagagggaggtctttgggccagacttggcccaaagggagaagggggattatttttagctttttctttttaataaactctgataattgtttttgttgcttaataattatttccggtgctctgaaaattcaagtaaaatttgagggctccttttagaccaaggagaatttaacaaaaattctccgggccacattcgaatttttctggcacgtattttagtgtttgtcaatttcttttcgaattttaattaattctattattccttttagaaaatgatttttatttcgggatgaatttatcaggacgtgacagaatcatcagctaatttcgtttggaaattcgaggattcgagttcgattcggatcgatctctctcctccgagccctagactttccttctcgtcgccggtcgccgtgggcctccgacgctgccttctagcccctataaaaggacccccggtgtcgccactacccgtcgccaccctcgccttcgtctctcgtcgtcggaagcgccctagcaccgtgtagccccgcgccaccatcgtcaccgtcgctccagccgtgcgccgccgccgttccggtcgtcgtcgtcgctcggggaggtcgccgtcgtggtcgccgtcgcgtcgccgtcctcgtccgccccttcgccgtcgttgaagaccgtcggagcaccgtcgccgtcgtcaagccgaagagtgccgccgcttcttcctcgacgccgtcgccgtccgttgatcttccgccgccgttttggtcaccggtgagttcgccgcgtcgccctctacgtgctggtgccctccgttcgcgtcgccgcgccgtcgttcgccggcgagtttgcaagcccgagtcgccgtaggtgatgacgtcatcgccgacgtcatcgttgccgttcgtcgtggtccggccgtggaccggtcgatctcggccgtccgttttggatggaaagatcttggccgttcgttcccgtgaaccgctgccgtgcgcccggtccaccgcaaaccctagccgctgacgcaataaacccctttttccttttcaagaataattcattattgcgtcataattcaattaaaatccatataagtgttttaatccgatttaaacttcaaaaattcataactaattcatcttagctcggatttagttggttcaagtctctaaatttttctaaaattgagatctacatgttaaaaatatccacatgtactgttcagcttgtttatgtgctgtttggtgattttgctctttcctg

SEQ ID NO: 60592 - DNA, 2478 bp, Oryza sativa
ttggaaaaatgtcttaactccctcctttcacttgcctttagatgccgcgctacaagcctgagtacttgtttggtgttgagggatttgtccaagagttgcgtacgatgtcctttgccataggatttgggactgcccctttttatgcccagattcctcatgatcgtcacgaagaaaagtgccgagtcaaagtcaccttgaacagtaatagtgaagatatcccctcagagatgttcgaagctggaggaagaaactacatccatgcatgtcaggaggtggcaaggatcgccataggggagctccgcgatagctacagtgatcagttggccgacactgagtatcgctaccatcctcgccaaccacagggaagtgaccgtggcagctaccttgagactgagggaattgagaatgatgctaccacaaggcatttggttgagatgctgtgggctatggatgaaacccgtgcggagactatgttagcagttcaagatcgtgaagatcggaatcgtggtaagatttgcaagctagaggacaaggtggatcgtttggagaaggaactagccgcgttgaagggagaagcaccaccgcagaaggccaggattcgtcttaccgcaaggaagagagctctatttgtccctcgctaccaattggcgccaaaggtccgtgtggtggaaaaagaagttaccccagccctagcggatcctccggtcgttaacgtaagtgatgatgaagaagaagaatccaagcacgcccattccaagatcgagtggggagcaactcaagatgatgaagacgaaccgaacgaaccttcaatcaactccgatgcccggaagaactagaatgccttgtcaagtcattgtcttagatcgttgtgttagttagtttgtttaagtttggttgtgtgtgtctcgcatgtgatttacatcagtggtgggatgtaagtgcatgcgtttgtttgctttcgagtgttaggtggttggtaagtttagtggtgtgagagtcttcagttttgtattaatgaaacacacttaagatcaataaaagttaaattaattctctgtcctaagtagttttccccggtttctcttcttgtgcttctgcccatgccagatggtgctcactcgcagcaacgggaatggccccaacaacaacaataacaacaacaatggagagaatcccacacttgcccaagtcctggctcaacaggcacagcttatgaacatgatgatgcagcaactccagaaccagcagaaccagctcaaccaaggaaacaacaatgctccgccgccgcagaacaagttagcagaatttcttcgtgtgaggccgcctattttctctagcaccactaatcctgttgaagctggtgattagctgcatgccatagagaagaagttggatttgctccagtgcactgatcaggagaaggtctcatttgcatcacaccagctgcatggcccagcctctgaatggtgggatcacttccgccttaataggactactgctgaacctatcacttggcttgagttcaccgctgctttccggaagacacatataccatcgggagtggtgtttctcaagaagaaggaattcaggtcgctcacccagggatctcgctctgtcaccgagtatctgcacgagttcaatcgtctggctcgttatgctccagaagatgttcgcaatgatgaagagcgccaggagaagttcttggaaggacttaatgatgagctttcttaccccctcatgactggagattatcctgatttccagaagttggtggataaggctattcgtcaggaggacaagtacaatcgcatggaacaaaagaaacgccggattgctcacttcaaggcacaacaggggaatagtctttaggaccccagtccatgccacagggaggttcttcgtctgttgttcgtccgcagcgtcagttcttcaacaacaatgctggcaacaacatccgtaatcaagctccacgccctgttgcagcttcgacacagcaacaacctgccaagaaggagcaaggcagcaagcccgtagtgtgtttcaactgtggagacccaggacattatgctgacaagtgtccgaagccccgacgcgtgaaagttgtccctgcccagagcaactctaccgcaccagcatccaaggctcgtgtcaatcatgttgctgctgcagaagctaaagatgctccagatgtgattttgggtacgttctttgttaactcagttcctgcaacagtgcttttcgattctggtgctacacattcattattatctatgagttttgcgggaaatcatgggatggaagtagaagatcttagacgtcctttgatggttagtaccccaagtaatcaagcactctctttgcaacgtagcccctctgtcagaatagaaattcaagaagtaccatttctggccaatcttattctgttagaatcctagggatggactggttagccagatataaaggtgtgatagactgtgc

SEQ ID NO: 60593 - DNA, 11054 bp, Oryza sativa
  unsure (1)..(11054): unsure at all n locations
accgagttcatctccatggggagctccggttatttttgtggaaaagaaagatcatacccagaggatgtgtgtggactatcgtgcactaaatgatgtgactatcaagaataagtacccgctacccagaattgatgatttgtttgatcagcttaaaggtgccaccgttttctccaaggtagatcttcgatcagggtatcaccagttgagaatcaaagaggaagatatacctaagacagcttttaccactaggtatgggttgtttgaatgtactgttatgtcttttggacttaccaatgcccctgctttcttcacgaatttgatgaataaggtgtttatggaatacctagacaagttcgtggtggtctttattgatgacattcttatctactcccgaacaaaagaagagcatgaagaacatcttcgccttgcactagagaagctatgagaacatcaactgtatgctaagtttagcaagtgtgaattttggttgtctgaagtgaagtttcttggtcacgtcatctcagcaggaggagttgccgtcgatcctagtaatgtggaatccgtaaccaactggaaacaaccaaagacagtttcagagattcgcagtttcttaggcctcgcaggttattatcggaggtttatagagaatttttccaagattgctaagcccatgacacgactgcttcagaaagatgtgaagtacaagtggttagaagaatgtgagcagagttttcaagagttgaagaatcgcttaatatcagctcctattttgattttgcctgatccaaagaagggtttccaagtgtattgtgatgcatccaaacttgggttaggatgtgttctgatgcaagatgggaaggtggttgcctatgcatctcgtcagttacgtccgcatgagaagaactaccctactcatgatcttgagttagctgtagtggttcatgcgttgaaaatttggcgtcattatctttttggtactcgtacagaggtatataccgatcacaagagtttaaagtatatctttactcagccagatctgaacatgagacaacggagatggttggaattaattaaggattatgacatgggaattcattatcacccaggaaaggctaatgttgtagcagacgctcttagtaggaaaggctattgcaatgctacggaaggacgatagttgccattggagttatgcaaggaattagaaagattaaatttaggaattgtcagtagaggtttcgttgcagccttagaagcgaagcccactttaattgatcaagttagagaagcccaaattaatgatccggatattcaagaaattaagaagaatatgagaagaggaaaggctatcggtttcttggaagatgagcaaggaactgtatggttgggcgagagaatctgcgttcccgacaacaaagatttaaaagatgcaattctaaaagaagctcatgatactttatactccattcaccctggtagtaccaaaatgtaccaggatctcaaggaaaggttttggtgggcaagtatgaagcgtgaaatcgcagaatacgtagcagtatgtgatgtttgtcagcgagtcaaggcagaacatcagaaacccgccggtttgttgcagcctttgaagattcctgaatggaaatgggaggaaatcggtatggatttcatcactggtttacccagaacgtcatcaggccattactctatttgggtgatagtcgacagacttaccaaagtggctcatttcatcccagtaaagacaacttattctggaagtcggttggcggaattgtatatggcaaggattgtgtgtttgcatggcgtccctaagaaaatagtgtctgatcgaggcagtcagtttacttcaaatttttggaagaagcttcaggaagagatgggttctaagctgaactttagtactgcttatcatccgcagacagacggacaaaccgaaaggtgaatcagattttggaagacatgttgagagcttgtgctttagacttcggtggaagttgggataagaatctaccttatgcggaattctcgtacaacaacagttatcaagctagtcttcagatggctccgtacgaagcactgtatggtcggaagtgccgcactccgcttttgtgggatcaaacgggagcacgtcaggttttcgggactgatatcctgagggaagcagaagaaaaggtgaaaatcattcaagaaagattgcgtgtggcttagtctcgtcataagagttatgccgacaatcgccacagagatttgagttttgaagaaggagattatgtgtaccttcgtgtcacgcctcttcgaggagttcatcgttttcacaccaaaggaaaattggcaccgcgttttgtgggaccttataagattgtcagtagaagaggagaggttgcttatcagttggagttacctcaatctttggcaggagtccataatgtgttccatgtgtcgcaattgaagaagtgtttaagggtacctactgaagaagctaatcttgaacagatagaagttcaagaggatctgacttatattgagaaaccagtccgtatcttggaaatagatgagaggagaaccagaaatcgagttatccgtttttgcaaagtccaatggagtaatcactcggaagaagaatcaacttgggaacgggaagatgaattgaagtcagctcatccgcatctgttcgccagttcttccgaatctcgaggacgagattctgtttaaggggggtaggtttgtcacaccctaaaaatccaaaatatataaattgttgtttaattggaattattagaatttattttaaaagcctagaagagaagatctaattttaattaataaattccaatataaaatggggccagataaaatttcattaaatactttgcttaattctacaattcctagatttttctgggatttatttgagctaaggaagtatttttaataaatggaattgcatttcatgaggggaaacgatcttcgggatctcctctaccttttctcttttggaatcatcggctaattttgtttggaaattcgaggattcgagttcgattcggatcgatctctctcctccgagccctagactttccttctcgtcgccggtcgccgtgggcctccgacgctgccttctagcccctataaaaggacccccggtgtcgccgctacccgtcgccaccctcgccttcgtctctcgtcgtcggaagcgccctagcaccgtgtagccccgcgccaccatcgtcgccgtcgctccagccgtgcgccgctgccgttccggtcgtcgtcgtcgctcggggaggtcgccgtcgtggtcgccgtcgcgtcgccgtcctcgtccgccccttcgccgtcgttgaagaccgtcggagcaccgtcgccgtcgtcaacccgaagagtgccgccgcttcttcctcgacgccgtcgccgtccgttgatcttccgccgccgttttggtcaccggtgagttcgccgcatcgccctctacgtgctggtgccctccgttcgcgtcgccgcgccgtcgttcgccggcgagtttgcaagcccgagtcgccgctggtgatgacgtcatcgccgacgtcatcgttgccgttcgtcgtggtccggccgtggaccggtcaatctcggccgtccgttcccgtgaaccgctgccgtgcacccggtccaccgcaaaccctagccgctgacgcaataaacccctttttccttttcaaaaataattcattattgcgtcataattcaattaaaatccacataagtgttttaatccgatttaaacttcaaaaattcataactaattcatcttagctcggatttagttggttcaagtctctaaatttttctaaaattgagatctacatgttaaaaatatccacatgtactgttcatgcttgtttatgtgctgtttggtgattttgctctttcctgtttagattccgacgtttccggagagtccgttttcgcaggagaagaatttgaagagttccaaggctagcaaggcaagtcacacagatcccaaataatcctttgagcatgttgaacccgtttaaagctactgtttctattcaactattgcatttattttcgaatgtcattgggtggaattaacctattgtttgttatagccctttttgttcttgattactttattccttgatactctgggttattaaaacctgactagttgggctgtatatattggttccactagatattagatatgatttcttagccatgcttagaaacattagcacattattgggataacttatgactcactattaattaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtacagcatggttcattgcggagcaccaaactgagaagtggcggagataagcccacgggggtcgctgaggagtccatgccttgtttataagggggtgattatgatccaggaatggtgcgctgtggtggattgtgttgtgcgaggggtactgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatatcattcgtgattagtctcacacctctcatcataataaaagatgctataactggtaataatttgtttagctcctggtttggaatggtatattcctggtttggagatagatctgtacagccggctatggttgttcagaaaggttgggcctatacaacagggtatgttgtatagcgttggattaatattgtttaattattacttaactgttttattaaattcttaaatatttcttaaatgctgtttatgcaaatgaaaccctattatgccatcctttgttatcctgtgcacttgcatatttgctgagtggcttgctgagtatgtcatatactcaccttgcaatcattcatcagaggaagagttctacaatgatgctgatggtgtggaggattaggtgtagccctggtcaagctgcctgtggggtggagccgtctgcgccgtttatttttttttccgctgcttagatctttaatgattgagaggaactatctacctctgtaatgacattttgttcgcttattaactagagtaataattgtactctattatcaatttgttattgtgtgcctcggctgattcctggacgatggttcacacacatgtaagcgtttggaattttggatggaaattccgggcgtgacaatccgttccttagcaccgcaggagccaacactgacgtgggaacaggaagtatccgtttccatatcaacgggaaggaggaaaagtttgagttccagccaaagactgaacaatgctccatggtcagaataaagtatgggccaaacctgcaaaacattcaaatggtcgaagtggagccacccaaaaaggacagcctggtaaagttcatgcagaatttcctggaaaaggaaacaacgatgcctaggaaccgttattggaaaacgccggtgaaatcaagcacaccggccaagaagctagaggagccggctcaaaggaagccttctcccgccccatcacctccagagacggtggaaaatccgtgcactaaacggaagggaggtacggtcttgcacgtcggacccaaaatgacgcgaccttcgccaacaggtaaattggtatgtatccacttatttgctttcaacaatttaaatttttgcatcaacacatgtttgaatttcaaatttgcatttaggatttttgaattttgaggaaacccttcaaatgaattttttagagcaaccaaaataaaattttcaacgaaaattcactgtgccatgaccacactgatcattggaacccaacggccgaaagtggggccagttgggttcaccaggggttcggccgaaccccctggtttggccgaaccggccaggcaacggtcagctgcgtcccttttcgaggcaacggctagtgggccccacaggtcagttttgaccgttgtgggagcactacttaagccaaccagccaggagcgggaaatccatcccatttcaacacattttcattccctctccaaagtttgctctcaaattcattcaggctttgatagtttccctcaaattcaaatacatagttgcatatatacaagttgctttagtgaaactgatcggcgggtgaaactcttgctattctaacccccgctgagttagtccgttcttgctccattgtgtagaatgaggaggcgattgtctcgtctgttcaaggggtccggctcttcgtcaagttgtcatgatgagtctagtactcattcatcagctgacctcgaccatgttcaagaggatgccgaagctccacgacgtttcctgaacgacaccgacctcgaccttatcgatgatcgggaaagacaagcctactacatgctgagtgaccgggagtatgctcacatgcgagaatactctccggagctgctgaaaaagataggtatggatgttgattttcgtgctatttggaaagctgttggttggcagagatttgctgtggtagataagcctagttctcgtttgcttactttgcaatttctgtgcactttgaaagaaatagaagatggaatttcctttcactttttccataaggaatacacatttacatggaaaggattaagtaaacttcttggttttcacgattcttgtaaaatcgatctccagaaaggaatttctgggttcgagaaaaataggttttgggaagatatttctggtgctccaatttgcaagaaacctaggacgaatgatatccataatcctgatcttaggctcatgcacaattgattgctatgactttgtttcctagaggtgatcttagacccattaggggggataaatttactatcatgtttgccatggttaggaagataaaaatttctcttgtgaaatgcatgataagacaatggttagaaagtatgaggttttctgctcctattgaatgcacttctccgattgctcggatagcgaaagggctgggggtcgttagtgaccagattgctttcatctctactgcttgtccatgtattgatgagaattatctagtgcaaggacatattatgaaacatggagtaggtggatctttgatatactttttcctcggttgtataaatgaaatcctattgccaaatgcggggtatcatttgtacaactgccatgaactaaccattccctgcagaccatagaagaatctcgtgcaggtggagcatacagggagacgcgcagcatggcaaggaacgaacgagaaagttcatcatcctcaacacccgtgcagatgtatgaggcaggttaggaaccaactgggcaagtgccagtgaggaacggtggcatgcgcctcatgacatagaatggggggacaaccaaccccccagatcaagtggtatgctcccatctccaagtgaatggcgctcaagttcctctcgttgggactagggtgaaatcaccaggagaatggatacccttgatgtgcagacgggagagatccaatataacctcacagaacacatagcccagacgcaagagtggcaacagactgctgatgctcaatttgccaacatcaacaacatgatccagcaacagcacgatgaccttcaagcgtacttccgcttccaggagttcaatccttatcaaggaccctaagcgtaagccaagcttggagggagacatctctccccctgctgagctaacttgtatcacattgcatatttccctttccaattgcatatttgcttcttacttgcctcctataaacctgaaaacaacataaaaatttgcaaaataaaaaataccaaaagatatgataggtntgagtcatgctaggtaagacaagctagctctctttgttgaaatgatgaatagttgctctgttttatatctcttatatatgggttcataggtaagtgctctctcaaagattaaatataagtagccaataaatctaggaacctaaggtaaatgagctgcacttgctgatcttagtctaagttgttgcaagatatgagatagtaaataagagttactatgatcctggtcctagtttgacttaaattccggatgttttgtttttcaaaatgataaatttggaagttcctcatttgatataaattcctaccagagccaaaaatgtgccatcataattgaactatatacattttggttgcttgtcattccattgaactttgtcaaactcttctgacttgtgtagatacttctcatgctctatgaccaagatcatacacccacatatatgcacatgctaaactcctacatcgggagctagcaatattccattccatttccatattaccaccaaaataaattctccatgctttcatatgctttcttctcctaaaaagaaaatccttttgaaaaaaaagagaaggagggaaatgcatggttatgaaaaaaaaaataaagttatgctctcacaagcatgggaatgatactgaaaaaaaatgttagccatgccctctcttaattaataaaacaaggatttttttggagaagaaagtaagcacaaaggagaagcattttctttatatgtcatttccaccatatatcacacacacactttgcacgatcttaatcttgagtatgtttagttatctgctttagtctgagtttttgacttagtaataaatgtgaatgcaagtatgccatgtttgatctctaccgagctccacatatcaaatcttagagtaggaatcaagaaggcaaaaatagcgaggaattcattttgatacacttagagagaatgagtgaatcatttgaggaacttggctttcttttgcaaaatcattttgaaaacttccgggacgaaagttgaataaagattgggtgattggtactctaattgctattctgtctttcaaccgcccaagacaaggagaagcagtgtctcgtgggaatcaggggtaagggtaagccaccgtgccaaagattatttaatctgagagagagtacatataccttgcacctgtacctttgagatatacagcatagtagcaacacctaatcaacaacaaagtttttgtttcctttcgtccttcactcgggacgagtgaagattcaagcttggggggttttgttgacggtcgttagcaatcagttttaccgtcaacattatcaaaatagaggagaactagttatgcttgcaatgcatatatgcgctagaataataatattccactagtatttggttcattaacccttctgcagagaataatcataaagtgaaggagaatcgacatcaaatcagacgataaatcaatcggacgatgtcgaggattagacttatgtatgaatgggccaagatctcagaattaacacgatgaattgggccaaaatttacaagtctacgaagtgaagcaacagaggatgccgccagccaaaacatgggctggttgggccggcccctagttcggccgaaccagggggttcggccgaacctcccgtggcgccaatggatgcagggtttggatggatggctaggattgatccgcaatgacggttggagggtattaccgaccattccaaccgtcacaaccgtcattacctgcctataaaaggagctcctcttctcacttcactcacacacctcaagcatgagctctctcatattctctcaagttaggccttgtttgtttcagcttatgattattataatctagattattaaaccaaattactataagctggattataataagctgacatagaataagctgtgagttgtttgtttgtccggattattggaggtatggattattgggtttgtaaggctgaagtctataataccctcagctattttggatgccttattcatccttgtcactatataaaacaaatacgtaatttaaataatgtcatctattaataaataaaacattcatgaatatgttttttttacaacagactgaacaataaattattatctcctagcaaataaagcatcggtaatattatcacgaaagatatttgcgtcgccctcttcgtctcccaattgactagcattccctcgagatgaaggcatcggcatatagttttcatcgttatcacaccgatcgaactcctcgtcactcaatttactatctcgaatgaaattatgaagcgccatgcatgcatgtattatttttgtttgcttgagcatcggataactcgtaagtccaatagaattctccatttcatcttcaaaacgccaaaagaacgctcaatcacgttacgaagagatgaatgtaagtggttgaacacctccttcttgccactaggacgtggacccgctcgaaactctggtaaatggtatttggtccctttatatggagctagaaatcccattcgatttggatagcccgagtcaacaaggtaaaatttccctgttgatataaacataaacatactttattagacatcactttaacactgaaactagtaagaaaagtgaaaagatatatgtgaaattacctggtggaggatgagggaagatagtggcatatttgcataaagcatcattaaacaccctcatatcatgtgccgatccgggccatcccgcaacaatgaatgtaaacctcatatcaaagtcacaaacagccaaaacattttgagtgggatacttgttcctacccacatgctgaaccacctttgatgcgggcacaacaactagtatatgcgtcccatctattgcacctatgcaattattgaaatgaggctgaaaccgatcaccatgtagtcttgggtgaatcgttgtgaagtgtggatctctaggtttgactagatcttttgagagaaggtaaacactctgcaacacttcctcaaatttcacgctgattgttccttttgat

SEQ ID NO: 60594 - DNA, 990 bp, Oryza sativa
gtggtaaaagtcttgaacacgtcacgatgtgaaaagatttcacaaataattgcgtagccatgaaatgctcggcacttccttctgctgccccacactccactaccaagtccatcacttccttaatagagttgtacctaaattcaccttgcatcaccttgttggcaatactacaattggtgtccaaagtggactgaatattcttcatcaccttaaccatggggttcttaaccttcttcagtggactattttcagtggtaatacaccctcgtttcactgatttgttattcgttgtgtatctatgcaatgagatgtccactggtgtgtcatcaaggctttgtacaccagcccctccaacatcctctccaggtgcacaagcagaagaaccatcaacagcaacctcagcaaacatttgactcaataaatcttcacaatccgggggaccatgttgtagcttcttccattcagaatgaccctagaaataaaggaacaggccgtgagtactaattattgaaaacactaaaaacaatttcatgaaaaggattattaccttagtgacttgcttccagtatttatcacttgctgaaactgttccttgtgtactatcccatccaagccctgtatctttgaggaggccaagccaaaagctatacaaggcttttagtatatcccatcggttcttcaattgcatcttgctgtgtcgtagccctgttttctgcaagtacttgacagcaatgttctggtaccccctagtagtcattatcccgataggcctattgccggcttcgatttgttctacgcatagttcacaaaatatcctagtgtttgtggtagaccattctgctttgtcaaactccttctatttgatagaacaaacacattgagattcagttttcaatgttgtcgtacatctatagctctaactataaaaaaacatgactatttagagctccagagcacatgaatagtattttattatagcttttagatatg

SEQ ID NO: 60595 - DNA, 10978 bp, Oryza sativa
ttggtctatggtggattggtggtctagtaggtgcaatttggcgtggctttcctagttggtatgaagccagcagcctatattctcattctcataaaggcacacaggaaaatactagcaactaaaccactactatgcagagctgatctccctggcttcttttcatatttttgttgtactccaatctgaagttacaaaattttccattagttcctttcaccccttgtttcatcagttctcaagttcgtgttttagttagagaacttggactctgccacatctcttaacttcgcttcagaatctgaacagccagtattgttggtctgtgaccattcagttttattcgtttattcagcttttcattagtacttaacaaagaataccaaatattcaaagacaataccggtccaactgagttgactgctgtattttgataatttcagcctggtttgtctagtgtcagaaataacaacataggtaccagttttttgttagtactaacaaaatacgtattagaaactatcatatgcaatgataccttcaaatttctatcttcttcaatgcattcttctagaccagccaatccaccaaatgcaattaaaaggtgcctgtacaatgaagcgctcataaatgacaagatagccatacacccacaatggtggtcctgtgtatttttcagtttatgatgaagaatagagtggattctactttgcctctcatacactatcatctgagtctagaaatcaaccctgaataataaaaacggacatcttccacccctcaaccaccaaaaccagtttaaaatatccccttaagagcaatacaatgtggttataaccaaggttctaaatagaagtgatagttacaacaatggtggtagtgggttactaccattaccaagactaggtagtgctacgaaatagcgcattggaacaaagcagctgcaatagcagctggatagcaacctcataagcaaaatagcagctgctattgcattgcacactgaagtctgaattatggagcttaaatttgtgttgtgttaactcttgttgattacttgctttgtttttttaaatagagtaaagacctaattaaccatatctctattttctttttcataccaaggctccaaaagcagctaccctaatgagggttaaaaaaaaaaagcagctacccaaataactcgacactggtaaattcaggccagaggcaaattatgtaaactatataaaatgatgaaccagctgttcaacaatcaaatcactggaaccatcaaaataagttaaccagtaacatcaccaagtcaatagctggtctgggttcaagaactatctgactggatcacatatattgttgtatggcctattttatagtaagagtctgcaaaacactccctataacaaaaaagaaatggacatgtttaatgcaaaaaaaaaaaaaatcacattcagtttgtatatgttcattttttattcatagaaaaaaatcctgagacactggcaaaaaataaataaatagtcatcataaattatgtcatagcatctagaaacaaaattttgcattcagcagaccaaacaactatggaaaaaactgaattgaattctgaaggtagtccaagggaagtgaaaacaatatacctaaaggaaggtaagatcagctcagatgaactaatgatctttccatgctctgaagtaccaatgatataatcatatccttcctaaaaatatgaaaataattagtaataagtactctttaccctgtactacatgtgattgagctaaagaaaattgtaccttgtatggtgaatcactgaaaactccacccaaatttgaagcataccggaccttatagccccaatacaattccatttcatccctgggagaggaaggggaaacaattttccttttgcaagctagatgaaaagtaaatgacaatatgtcattaatcaatatcaaaataacagacaaaattcaagttgtagaaggcaagagctaaaataactgaatggggatataagtatgcctagtgaacaggaatgataaaatgaagcgacgcattacgaagtgaatccaaagagcacacatgtgaactgaaaatagtcactctgtttttatgttacataattaaaaaatccatccattttgctctgcagaacaagcagaatggtttacttgaaatctgtagtaacgcatgggcactatattattcatatgagaaataaaatcctgatagttgttgcagattttaaccagtcattgcaaatggttaggaaggatacttcagggtatatggattaaagaacatataccgagtaattcagatactaaaaagttctagacgaagaaaaatcaatagagccacatctgaagcctgggtcaagtgaataaatcatttacctgttgtaatgtcacgattggtacccatggcaatagttactctcttccctggttctagcatttgctcaaccagaacattctgtgatgaaagacaattatagtaagtttattggatgagaacgtacattatctaatacatgatccacaaaggtgtatatgatacaatatacattacagaatctgagaatcaagtttatcatgttgagtacaaaaagatttgctcagaggcagacatgcaactatcaatataaagttgctagacttgccaaagcactctggccaggcagctatcagcattgaagctatcccatgctgattttcatgtttcaccattctcttacccttgccccatatgcagttatgggtaatggccatggcatgcctctttggtgcaaagatatctagctgacattttgacagcttacagttatgctatgctatccttgccaaaaaaaaaaaaaaaaaaaaaaaaaaaagcagtatgccctttgtttggcccagcttcagcgtatattgaaagcagccttactgggagtatagaaaattcaccaagcaaacctatattacagaaaaaaaaaaagaagtattttgttggaataacaaactatgaactcgtttgttatgtgtttggtatgacaccacccactagcttaactttttttcattcaattaggctaagtttacaggggttaattcctcggagtaaaggaaagataaagatagttgggtttatgaaaaggaaagggtttggttttttggaaaggaaggaaagtgtttgctctttccggaagtaagagaaggactaccttgggtaaggtaggacttctcggagtaagggaaagcaaggtgatacgtgttcctagcagtagttaagcgctattgttgctagggagcccatgtatgggggtatgcgcgtggaggaaaacgcccagaagggcaatttttgaagccctacggcactttagggtaggtttaggtactctgatacctaaaccagaatttaaatgcatttaaacgcatttctattagtgaattaattattcgattcatgcactgggttagtttgtttggacaataaccatattataacccctttgtttataactgaacagatattttatagtctaagccgtcaggttacaactgaacggatatttaattacacaagccacttgagctaaaaaatagtatgtgaaaaaaatttggataccttactcaatccgacatcaacaaatgtccccattgaacgatccccatccaatgttacgcctgtctaaattcattctactgtaagcattctgttgaatcacacatgaaaaatgtggtaacaaaaacttttccgataccagcattaaaataggaatgaaaaaacagtcgaaacaaatccaattatgctattagtactcatgttcctttttttagttgagaagcacaaaagggtgccattctaaattgaagccttaacaaagttgagcatgtgggataggcagtcctcccccaagaagtaattctacattaacacaaccaacagctcagccattcagtaacacagcaggatcaaagagcgtataaagtttatttttccttttagcatgaactacgagaattgataaagtccaaagcaaatgaattgcatattgtgcatgtaatgaatttctgaaagctacgaagaacagataaaacaactgcacaattcatgggcatactatataatatttataaaaggtgcagacatggccacgcatgacagaattattaaacatgatgaatcattcgaaataccaaacactgcatgtgcttatgcatagttcaattgatgtgctcatatacatatagtttcattcaaagatgtccctaactagttaaatatgaaatttacaacttctcctagttttctttttgaccgaaaaacagtagcagatctctagaacttgtcctaaattaacaagagaccgagaggtaagtcgcatagctcctataaatctaggaagacaaacttcatatttttctagttaggtaaaaaagttaaattacattggccatgtgatatttactttgatttctctctcctatttcaatccgatatactaaaataatggtaggagtgtattatagcaaagagaaaattcgctctatgcacagaaaaaatggcagtaccaaaaatagcacaaaacattcccccattcgaccagaggcacacgccactagtttttcttcaatttgtagcgcttccgtcacattttccgtccaagtgattggttagccaaacatgaacttgggctcctcggctaattgaacttgtccacggtggtggctgtggtggggtggccagcagcggaggagggggtgcggccgatggagaaggtgtttgcatcgctgatgaggtcttcacataggtgtggcttatggagatggagaacacagagaggtgcagcttgtcgtcgacgcgtagcagttccctgtttctctctagaaaaaaaatcagagaggaaggggccagtggtcatcacgcacagcaggaattgagtaagaagatgagacagagatgtgaagaattcagtgctcggcaatgcaaatcaatggtgtcctatggaatttaatttttgcaaatcaatgattgaacaggacacaacaaactagttcatcatggggttcggggatgggaaggagtcgttagccgccactgtcatcaacgaccttgatcccatgtgccgtcgcacggcgcaaactgccagccgccgcatgcttgcctgctctcccagccaaacgagcatgaactgatgaagaacaggaatggtccaacccaaccaatcacgtgtgaatacagagaggactaagggtaaatttgtcattttctgtccctattcacatggaaacactcgtcttgcactgcagttttggtggaagtgctatggatggaagaaaaacgagtggcctgtgctaccagtcgaaagcggaaattttagttccttgtttctgtgctacagatcgaattctctatagcaaatagccagaaaactagagtacccatggccgtgacatgattttagttccccacacaacaaatgccgacttcgccaaccatatacgataaaagcaattcaacgtggataccaatagcactgcaagaagagagagatcaccttcacgaaattcagaccactcatgcttgcgcaaatggtgtggtgcatcgagtgggggcagcaacccctgcatacaagaagcgacacggatcaatcagcacctccaggaaacccaacatgccgatgatgcaatcatgttcttcagcggtctcaccacaaacttcaagttgttgtgcatcgggaaaaggcgtcggcgcaggtattgtggagtctccagatactgtaggatgcgaacaaggaagcgcgcgccactctctacgtcatcgccgctgttctccactgaggaattgctgtcgaagaccacaacctcgtcgatgcggaagacggtcgccgcgcgggcgatttgtcctgccagctgaaacagggtaggagctagagccgcaagaactagcaagggaaggtgagaaaggatggatactgacgagggtggcgagctcgagggactgggcgttgtcgatgatggatccggcgacggcgatgctcaccgtggtcttccgattcggaaccgccacgtcatctccgttcttcttctgttgcagctgcttcttcctcttcttgtcgtggacgatttcttcgtcagccgctgaagcctctgcggctccgcagtcgtcctttcgcttctttttcttctccttcttgcaccgggccttcttggaggccgctgctgcctcggcgtctccggagttcattgcggcggcggcggcggcggcggaggcgtaggggggactaacacgagaacacctccaggttccaggagtcgagaggccgacgaaagtagggtagtgcgtaagggcccctcatgtgccggccttcggccagcgaaggggtttgcgtggagtcggactgttttcggcccagcgataagtctactttatgtccctcagtaccgtttgagtttcattgtatctctcaaccgtaaaaggtggagaagtagaaatagaggctcattcagattggtcgcccgatcgaatttgagaaatattgggcgctgacgtcagcgtccgatttacgtgcagaaactactttaaattgatttttctcttaaattacttatccaaatcataatccgattgcaccattaaattcgttgcaattaaattttcaaaacaagaccacacatggatatattccgacgaaaaaaaattagcttattattgaattatttttaaatattgcacaatgttccactaggtatatcggaattgtttcactaagtagatcgaaaatgtttcactcgtttaaatcgggtgttgtttcaccttatgtaaaaacaatgtttcaacaaatagcgaaagaatgtttcagttcgctgcaacattagatctatacatagtgaaacattgtgagtatactaggtgaaacatttttcggtggaaaaaaaatataccaaattcccttaatagggggtttccaaaatatatggatttttttgttgcaatggaatgtttcgttcactgcaacattagatctatacatagtgaaacattgtaagtacactaggtgaaacatttttgatggaacaaaaaataaactaaattcccttaatagagagtttctaaaatatgtgggttttttttgttgcaaaagaatattttaattcactgcaacattagatctatacatagtgaaacattgtgagtacattaggtgaaacatcttttgtgaaaaaatgggagggagaagtgggtgggcccaccaggtgatcacgtgggggagcgcccgatccggctcaccctgcgcgggtcacccggggtgaatcattatcgagtataaattgtccctcattttttattaaaaccagtacaaatcgataatatggaataagttcacactgcatcccttatgtttgcgcattgagtttaaatcacatccttaaaccacaatactggaaatcttaaacctccatattacaaaaccgggttaaataagatcctaagacggtacggatgattgttttggctgacatggcatcctagctagaaaaagaaaataaaaaataatatgtggggctcatatgtcggaggctttcttcttcctccaattctcccctctcttcccaatctcactccacaacggcaaccgctggggaaggaggggcggctgaagaaaagagacaaggcgatggtggcgttcgagccaaccaaaggtcgctctcgtggcgcaaacagctcgggctcaccttggttgctgagctccacctcgttggggaggccacaccgcccgctgggtacgacgcaacgacatggcggaccaacgccaaagatttcacggccacacaggggatgaggtggtggatgacgatggtgacctcaagcctatgggagggggggggggagagaaagcttgagcaggcagtggggatgaggaggtgaaggatgatagcgagctcgaggttgcagcagtgacacggggagaaggggggtgaggggtggaggagggagctcgagtgagccggagggaacaaggtggtgggacgatgtgggcgagctcgagacgtgggtgagcttgaggccacaacagtggctaggggagcctgagcaagcggcatggcctccccatgcgaggcggagcttggtgaccagtctggccgccgccattgccttatctcctctctcctgccactatgaccgcctctcccctcgctgccatcagccattgccgcgaagagagatcgggaagagaagggaggtgtggaaagagatgggaatagaggagagaatgattggaggaagaagaaaacccgtgacatgtcaacccccacatgttttcaattttttttttggataccacgtcaaccaaaacaaccatccataagcttctttcatatcgtgactgaaaacctacaatttttcgagcgcatgaaatctagcaaacaacacaggaatttaacaaagggagagatttgcacgtgtttgtgtacgatagtatgttttattgtgccacttccgtgtaatcggaaaaaaaaaagaaactgattaagcttcacctcacctctcatcctcacaaacagtacatgagaatatttcacctgtcataatcccaccacgtaagatgcttccacaaactgtacatgagcacgatgaaacaatcaagctgtattgcacaccctccatcctaaaaaaaaattaaagcacaatcaagctgtattagaacatcacaaaatatcgatggagaatgtaaatcttgcagtttatccatcaacacgatcacaagttaatacttcacgactgacccccccaaaaatttctcatatactcctaaaccaggaacgaaataatgacgtcgcgacttggaaaagttagatacaaacagccgtacaatgatttaaaaccaaaacaggaagttcgagttccttctttttcatgttcaattctctgtgtactaaatatatgatgtcacattattacattgtcacacattctgcaaaacttcaataatttcaatgtctaaagcatatacttccttccgtttgaaatggtcaaagacttgaagaggcaaaaagaaattctactaatttcgttctactcctggattcttgatggttctccaattgcatcttccatacgttggtaccagtcaccaatttgtgtatgctcaaccatatcttttccagctgtcaagtatcggataggtctcaaaacaccaaatactgcaagatctgccaagttaggcttggagccacctggataaatgcaagttaatatcagtgcggagtaacaaacttgatgcatgtggattttcacccttccaggctgttttttcccttttcccttcctttatggaaaaatatcatacctagaaaatcccttccatcaagggcttccatccatgtgttggcagcatcgtataatgaagcacgcgcatcagttatattgtacttcttctttagcttcttagacaccatgtacattgctgcagcaccagcatacttcacagcaaaccgctcagtaaaactgaagttgcctgcattacagagttcgggtgcacatcgtcaaatgttgcactaacaaaatcatgtgtcatttctgctcaaatgattaaaacagttagcgaacagagcaccacctctgcacccaattttacgtttttgcctagagatgaagaaatctagtgttcctggataagtggatagcatggcatcttgaacttttattttttagttttctagtttgaatataattggagatgaatcatatcttactataaagttatcccccactaactccttaagcttaacatgcaaaggtgccacatcatcatccactaacaagatgctacacatcatccactaacaatcatcacatttaaacaacatgcaaacatgctatatctttatagtttttataatttaagagcttttcaaataaaaatatgttaaattatcatccaacataattcatataatgtttcaatatatatctttattatgttttatgatatcctatatacttatatagttcatcctcacttagttagtacttaaatgattaatctatggtccaaattatctttctccttttttcctctaattaagtcatatcacatcaattgtttttagcctttttttactggaattgtttttagcctttagatgattaatctacagaccaaactatctccctatttttcttcttccataaagtcataccaccttactttttacatttgaatcaccattctacatactatttaaatttaaattatcataaaccatattaatttacttaatctgatgttatctagctatcttacacattctttttttattgttatcatactaaattcccgcagcaatgcgcggggtttcacctagtatagtaaacaagtaaccccttacatgaggggattttgctgaacagtgagcacaaactaatcttccctacactgttctttccatgcacctcatgttctctcaactaacctccgctatcagcagttcagcactatgttagtatggtacctcgacgattgaatttccctatatctcacaggtaaaatccctgttcagacacattatgcataatgcttttcatttatggggcatccattgacaatcacgctgaacagtgagcattcaccaaattgtgttatctccaacatttagaaaattaatgaactatgaatggagagcacctgggttcacaaaatcaaaatattcatgccaagtatgttccagagagatcctatatgtaacctcactgtaacaccctaatttgcaaggtgcaggccccatgtacacactgcattccattctagcttcatgtaaaaggttaacctgaaggttctatggttggaatgtgtaggtttatttgttatccttaatacatctaaaatctctatgtgagcctaatctcaccaaaaatacaccacgggtcacacaggcctctagtacaaagctggggttcattcacccctttctttagaagctgatgaacttgtcag

SEQ ID NO: 60596 - DNA, 1108 bp, Oryza sativa
gggtttagcgttaatgattccactcactctggtctcaaatacttcttattttgaataagcatctagtcaaacatttaaaagtagtgtcaacatcttttaaagattatttggatacatgagaatcataaatataaccaaaagaaagaaaatatagcagcacacagacaccaaagttaaaagttccaaggaattaccatgttttgaaatataatcaaaagattccaaggcctctgaagttgtccgatatatatttggcgacaagacatgcacaaggtgctcatcaacccacttaaaccaataattcaagacaaattatgttaccgtagataaactccagtttgtaagaatgttaagagagtaaaatgttggtcactcgtgcagcagggttcgccatgctacttttaaaggaatccagctcactccatcaagggtaaagcctaaatgcagccaatttagtggtagtcggcttttttgtttttcatctttcagtttgtgaatcctaccagaaaatgcataactacccctaatacaagataataatggacttactggttgtctctagccttggaaacactactatgaccagatccagagaaaaagtctataaagtaatcatcagatcataacggataagctcttagtttcatcaattaattttagtggtaaaaacacaatgaaataaagcaaagaggatagttgatggccatactgattctgcctggccttgaaacattatcaccagatccttgggaaacatgtaactataaactatcagatcgcagaaaaaatgtagtaatagtgatggctatgctgatcctgcctggtgttggaacattacaatgaccagatccagggaaagaagtctatcatgtaactatcaatgcataaacagaaaaactgatggacaaggtttttgttcaccgattgatttacattgtaaaacaatgaaacaaaagtaaagaaatactataaaagtagaacatattgcacatactaatgccatataaatgattaaaaatttcaagaggaaagtagactttaaacaatatttgtttctagaaataggagtactataacattaatgatttgagaagctagaaccaagacc

SEQ ID NO: 60597 - DNA, 9557 bp, Oryza sativa
tgatccactttcacctatggttttaatcctcgcaatggaggccttgcgtaagatattacccgcaactgaaacagtgggcctcctgtcccaactcaattgcaactactgcaggtttaggtcttcgctttatgcggatgataacatgtgatcatgaagtatatacatacaaccaagcatgagaaatataaaacattgtcaaacaatgcatcggatgaacgggggatccataaaatattaaagtctaatgagttttgaaatttagttcggcctctagagacaacactgaattcaaacagacctagcacctccatgccatctccgatttgggtgatcttggacttgatggaaagcttatctctctacctttcaaacgcattcggtctcgtatccaaattcattccgagttaacatgaatcgtcaaaacaaggcagtgctgttactgaaacctaacttgggtcttgggccttctaatcactggtggagaaagcctttttactcccggttggtaacccccctatagtcccggttttccaaccgggagtacgaatccgggactaaagatcgctatctttagtcccggttcaaatacccgggactaaagatcggttggtgttacgaaccgggaaaaaaaagaggaatctttagtcccggttgataacaccaaccgggactaaagagagagtagcgtcagttcagatggtgccctttttttccagatttaatctctatattttctcccgaatctagtgccatgtatatccctaaatcaatccccaaatccccaattcaaagtaacatcccaaatcttaagttattataaacataaatcaaatacatcacaaatccttaaaaaagtgcactcaaatcaaatacatcacaaatcctaaaaaatacacacaaatcaaatacatcacagattatgtcacgcccagaagtttcccccttttcttgttttaaaaattggttaaataaattgcccgaagaaattatcttaattaacctagagctaaatccctagttaataaatgcaattaataatcggaaatagcgtggtggaatttttcttgagttccccatgctccaatgcattaacaagatttttagtggaattttcacagccctggaaataattttaaccaattaaaaatcaccaaagtgcaattttttaatcccaggaaaatccttttcctcgttttcttttcttttccttcctttttctctagatgggccgtcggcccatctctctccccgcgctcggcgccacttcctgggccggcccgctcctcctttcccctccacgaagtcctccctccctccctttctctttcgggcgccgacaggtggggcccacctgtcggtcgtcccctacctccggtcgttggagccggagctccaaccgcccgcgccgccgccttctccgctccacgtcacgcctccactccgcgcccgcacctcgcgcccacgtcgccgccctttccccgcatctcccgcacgcgcgcgcccgcaagtggtgggggatttgaaatcccccaacaccctctctctctcctccacctctccacgtcgccggccaaataggggccatccccggccgtttccgcccctccctcgcccataaaaaccctcactcgagctctctctctcatttcccccattcaccgtcctctcccacgccctctaccgccgtcgcgccgcgctcgccgagctccgccgccgccgcccatctccggccgcgtgccgtcaccactagggccgccgccgcgccaagccgccgccgccgctagctccgccgccgtgtgggccatctcggccaccgcctcgcgtcaccggaaccccaccgggaccccatctccctcgcgagccggtgagctattcattcccctccgtctccagccagccactttggttgtcgcggtcgccttctccatccctaactcctctcctccccttctctaggtgtcgccgccgctcgtccgcccctcctctcgtcgggtcgtcgtcgccgccttcgtcttccgctccggccaccgtgtcgtcggtgagtcctccctctccctcctttcctcaccttcccgcgagcgccggccacgccgctgctccggccatgcgccgccgcctttcggccgtcgccgccgcttcccgcaccgccggtcaccgccgtcggtggccgtgcctcgccgtcgcctcgccttggtcggccggtcggccttgaggccgagccgagcccggccgacgccaccctcgcctcccctttgagccaccgcctggtggggcccacctgccaggcgccacctccttcccttttgagccgctgacctgtggggcccacgtgccggcgcccccttcctctcccctttgagaagctgacccatgggccccgcctgtcggcagccgccccccccccttggatgacgtcagccctgggtattattgcgcaataattaattaaggactttttctttattagtaaaaacacagtttatcttctaaaattcataagtaattcatccgagctccgttttaagtccattcaagtctcagtaaatcaagaaaaatgcaaataatccattaaaaatggttttgtttcctgtttcagtagtcttatagcatgttttgcttgtgtgctttgtttgtcgcgtagtttcggccgtttcgtcgatccgcggtttctcgaaggcgttgctgacgtctcgtcaatgtgagagcaaggcaagtcatgctttacatttgatcatattgtacccaatttacaaataccctgcatttctattaaatgttgcattcttttacaatgtcatgtgggatgggtcctattacttagccatttattgtttaccatatgccattgataacctgggtatcaaaatgattagatgttggtttaggaaatgcttagccatgcttagctcaactagtacacaaaaagggatcacattattacatagactttgtctattagcatagttttggattggtgccaccgcaatggtgttagttaattaaaatacactgaatggtgggctgtgggtgcatggttttgctggtcgcacccatggcagttaaggaccggttcacgggaaaccctgggagacttaccgtgcttaccgcaagcgggagtgggtaactgcttgatctgaagtatagctcgaccctttcctaggcaccggtagcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttacgtggagggtcttgtcacgatttccccctttgcagtatcatggtgatacttcggggcatggcgacatgtgtggaatcgtgtcttgtgggtacagttgtacacctctggctagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggatagtgattggttaatattgattaattactacagctgttttactgctttcaactactgttttgaaatgcctgctttatgcaaaagaacccctagcttcctttggttatattctgcatcatacatcctcttccggtatgacttgatgagtacagtgggtagtactcagtcttgctctcttttcccccacaccagagttgaagttcttctcagttggagccgtctcagagaggttggtttcgtcgctgcagtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattatcgtttgtgtaccctggctggtcctggacaggggtttaatgcacattcagcttagaaattctggttcgagaatttctgggtgtgacagattatacatctcatatccatgcaatgaatcacaaaattatacatctcaatcaatcacaaattatcagaaaaaaaaaagaaaagaggccggccggcagacgagagggcacgaccgctgccgcgcgtgacacctttggccgcccgccatggccgccgccgggcgcggccccgccagctgccgccgcccgccatggccgccgccgccggccaccggatgggaagtgagggggaggagaggtgaggaggaaggcgaggagggggaggagttagatctgtgaagaggaaggggaagggatttgtgaagtgtaggagaggataagggatagggattatatactacatattaaattttagtcccagttggtaaaactaaccgggactaaagatcaatataatttttagtcccggttagtattatcaaccgggactataaagatgatctttagtcccactaaagatcctcggccccctgacagactactgacacgggatgaaccgggagtaaagatgatctttaatcccggttggtgatcataaaatagctgtggtgtttttaaccgggactaaagatcatttttagttccagtttttattgcaaccgggactattaatagactaggcccatctcggaagtgtctccctccacctccacgaattaacactaaaccctagatctattttctctataagtgtctatgtgcaccctctagaacatttgggttttgtttagttgaattttgccaagtgccattcaccttttctctaatcctcgctcgattagtcggcgactatagattcagagctcctaatagttggtgtgttgatttgtcgggtcgattagatctaccacttcaatcagaactatttcttcgtgcttcatcacctattcgtaatttagattgcatcttatcttgttcctgcagtgttctctcatttgcattgctgagatcatcaaccacgtgtcatggttggtatgacatcgtttgtggtgtagcgattgcacgacgttctagacttgttctggttggtagccacattgcaaatgttgtactcgatcaaagcaagaattatcctctgaccagaagatcaggccacgagagagagcttcatcaaactacctccgtccctaagtaagtgttgttatgggttttcgtatcatgtttcactgttcatcttattttaaaaaataatatgattagtatttttattgttattacataatagaacataaatatattattttatgtatgactaaatattagaagaaatttataaattttttaaataaaacggacggttaaacattaggaaaatattttttttctatttcttttgttcgatccccgctcccaatgaaccccatcccttggcaggcagtcaggtcggccggcaggttaggtgcatcgcatcgtcccaagacctgaatagcggtggcggtggagagatatcgctcacatcaatcaccaccacctggccatgctgccggcaggcagtcctcccacgtggcacttgtatcgacgtgtgggccccaacccaacacccaacggagcctctcggaccatatcatcttcctaccggcttcctctcatgtgctccgctccgttcacaccagcagaaaagtctctctgcccacgtgtcaaagcaccggtggatgccaccgtttgcggcgaggccttatatcagaaggcgagcgatacctacacaccgcaggatccaatccacttgcatttcagctcaggaagcctctgctactttgcttggcctgtacagtaatacagataaagacctgcagttctttggtctctttagtgaggactgaggagtttggttggagattgttgaggagatgggcatcgtcgacgttgtctccgagttctgctccgtgccgaggactcgccgacacctcaagaagaggaaacaattccaggtaatactgaacatgttaatccattaatcgcatctccctcttctgtcgatctctgtatatctgtcttccagtcgaatttgtaccatgatagtactagttgacagttgtgttgttggagtggaaaaaacttatgcctatatcctcttcttgtttcagacagtggagatgaaggtgcggatagactgcgaaggctgtgaaaggaagatcaagaaggcccttgaggacatgaaaggtgcttaatcatatttttgctgctgcttcttctttcacacgctctgaaaagcaaaacaagggctcctttagcttttgttctttgttgtggaaatgattgacgaatctgtgcatgtgcgcaggggtgagctcggtggaggtgacggcgaagcagaacaaggtgacggtgacggggtacgtggacgccgggaaggtgatgcggcgcgtggcgtacaagaccgggaagcgggtggagccatggccatacgtgccgtacgacacggtggcgcacccctacgcaccgggcgcctacgacaagaaggcccccgcggggtacgtgcgcaacgtggtgtccgacccctccgccgcaccgctcgcccgcgcctcctccaccgaggtccgctacaccgctgccttcagcgacgagaaccccaacgcctgctccgtcatgtagctagctgtgtgtccccgggacgacgacgaagcagcctagcagggtgtttttgttgccacttgcagctgtaataatattctgtgtgtccagattcgccatccctcaaaaatctttcgtccagattcgccatccctcaaaaatctttcatagtattatagaagggaggaagtagtaatttttccagctgtagtaatgttctttgctttagatagggtgttgtgttactattggactctcttttgcttgtgcttttggtttcagatgtaaaatactccatcatgttcttgtttggtgagatgaatcttcaaatctgcaaagttgcagatcggttgtttgagcttagcatgattgattggggtgggtgggggagacgtgtgaatatcgtactgtatattcgagttttgggtgggctcacaaggtcggcagcgccgaaaggtttttttttttatccgaggcgctgattgcgacgttctgaactgtagcccgatgctggtgtggcattattttggtggttggatggtcagccgataattctaaactttgaatcaaagtttagtttagttatttttcattacatcaatatgtcatatacacatattagttatatcatctttaattttaaccaaaatctaaactttgcgctgaactaaacacagccaaggtgtactatacgccaagtacgcgctatatattgctattaatattttaaatatttaaattttaaacatatattaaatacataggtttttcaattttattaaattaatataagtaaactttgttttaacgaaagttatatgtaaactttattttgaattcataaggacacaacaattttatttatctatagttttaaaaatcaggattagtatctatattgttgtcgaaatgacaataacttctctcaatgaaatgattggatggtaaaagcaatgtattaatgatgaaatttttttggatcccctattacatagccctaaagttttgtgtgagccttcttgggccgcaacacctcctagcccttttgttgaagacgagccccattgggcgaaccccttctgcttcgcgccatggcttcacccaacagagagacttgatgacgaaccttatggcttccattcttcgacttcgccttacagcttcatcctatggcttcacctccaagcgaccccttgtgattttagtcggcgctttgctaatctggtggtttcggcagatttggtcgaaggccctcgtgatatgcctccagcaagcccctcatgggcaagagcgagtagggagctttgggcgagaccgtgcaaatatgtggtatggcatgaggtgccccctttcggccgatgttcctgccaaaacctatgtacacctgcagaagctaacccttgttatttcatgagttctctcaaacgtttccatgttgtttttcgaccttctatccttttcggacgtgagttaggtcacttcttcttttctttaaactcgggttttgggtcgcgtttttcctgttcatgtggccttttactgttcggcccatcctaacaagagttaccattgtgtccatccctgggtgccacgtggtgggctgctattggccggaaggcaaaccgtcgcatgactagggctatatagtccccccgtgggtcgctttcacttttaccccatctatttttacttcccccggctgcgttcttgctctcgctttcaccttttctttttcggccttgtagtcttcgctagctctgactttcatttttcgccattccatcatggctccgcgcaagcctgctccagccgcagcgaccggaccggacccctgcaagattggcgaagactgcaccggcttcctcggcacttcgctgttcaacaaggcggatctggcgaagctcgtcgcgtcaagtacagtggttgaaaagcaagccttcttcgctggcgatgcagtggttcatcgccccgttgatggctggaccgttgtcttcgccgccttctttgatgcaggtcttcgcttcccatgcgacgtcctgctccccaaggtccttcaacttttccaagtggagcttcctcaactgagtccctcagtcctagttcggatcgcgatcttcgactggatttgccaaaccgcggggttcgtgccataaactgatctgttcggcgctatcttcttcgccaccgttcactcaaagatggtggtcactccggttgggacaaagaaaaccgtctttgggagtgtgaacttcaatgttcgcgctgtatgctccgatttgtggccagtgaatgcctccatgccaaagtgggagcggcattggatggagaggtggttctaccacacgaatccctatggagctaagacagacgcgacgaaggcaatccgatagggccggctagtgatctcccctaaccggaagctgaaggtggcgattgatgggacgatcgagtcccgtttcacccttttgcggagaaccgcccatcggttgagctgctgtgatttcgtggaggagttttgcatgttggcagatcaccgtaaatgaggatgaacgggttctcgacttgcctcgccttgttttgccaggaggcgttaatcgtaagtttttgggccaattccctatatgcccatgtaatttcacctaatcccttctacgcccctgaaatttgtttgatctcttatatacccctgagttttttatttggatcccttacatacccactccgttagttgaccattagtttgaccgttagttattgtagaaattattttattgtccttggtatattgttaaaagctagaaatgttttatgtgtaaattatttgagttgtgaaaaccaataaggaataaattactaaatatttgttatgaatttttaaaaataaaacattatttcattaaaataaaaaagatttatcgtaaaaaaaggttctgcataaaatttggg

SEQ ID NO: 60598 - DNA, 6114 bp, Oryza sativa
aacctaaataacatttagtttttgctcttaattttctagcgaaactaatgtatggatttaatcataatttttaaaaaataaaaaataataacttttattttttaagttgggcattaaatgattatattgcttttattttgtataagttaatttttttcatatgaaaatttattgggtaggtaccacatatgtataggatggataatatagtcattttaaaatatttagcggtcaactaatggtcaactaatggagatgggtatagaggagatcaaaatgaaaactcaggggtatataagggatgatgtcaaattcaggggtattgaagggattgagtaaattttcaggggtatttagggaattttctataagtttttctaatttgctaactctttatttatctcatacccttttgttctttttttttttttttgcctctcttgtttttttgcctttttgcgcagttctcaccctaacccaggccgaaaatgaggcccgaactctgatcggggacctcaccattcatgagtatagctgtcacgccctaaaaatcctaaatatataaattgttgtttaattggaattattagaatttattttaaaagcctacaagttaaactctaataatctaggaaaattttcaacataaaaatgagctagataaaattttattaaatactttgcttgttcctctattttctagatttttctgggaattatttgagcaagggaagtatttttaataattgaaacaacatttcacaaattattttaattaaaaagttcaaaaacccctccctaagccgttgggccgaattcggcccaacattcctctctcttccgcacgccggagccggcccaaggccgcccgagtcggctcaagccgagccgcccgcccctcctctcatgggacaccgacatgtggggcccacatgtcgggcccttctcctacctccggccggccggccttgctagctcgagccgccccttttcccctccaaatccgcacccaatccggccctttttcttccgattgtttgaggagtttttatcctctcatcctcctctatctttacccccaaaaatcggagcaaatcgttgagtatcttgcccgaatcgaactcgtttccgagtttatctccaaaaccgagtttttgatttcccgagtcgattttcttgcgggaggagtccgatctcttcaatccaaggctataaataggaccccctagtccttctttttcgtttgccccctctcccgtcctctcccgtgacccgtagagccgtcgccgcgtgaaaccatccgccgccgccgctggccgaactccggttgcgccgccacgccgcctccgtcgtcgccgtcgcttgccgtcgccgccgttggtttcgccaagaggtggagaagctcggccgccacctctccttcgccgccggccgccgtagcccgtccccaccggccaacccgagccgccgccgtcgcctcctcgtcgccggccgtcgtcggtcgtcgtttggcacgagggtgagtatcgttgggttcgtctcgtcgtcctctacgtgtacatgtcctccaaaatcccggccaatcaccctagctccggcgaggtcgccatccgagccggccgccattgatgacgtcatcatgacatcatcatcttccccttttccagttttttttaatagattaaatcttcggaaaatcataactaaataaccgtagatccgtttcaggtggttcaagttgctaaatttttctaaaatcaagatctacatgttaaaaatatccacatgtactgtttatgcttgtttttgtattgtttatttggtttttattagtctttttcttcgttttgcgtgttagcttgtcgtttccatcgttgcgaaggttcgtgagtgcgccggaagtattcaagaagattaattgaagaccgattattgcaaggcaagtcacacagatcccaaataaccctttgagcatgttgaacccgtttaaagctattattttatttcaactatgcattattttcgaatgtcattgggtggtgaacctttccccgttaattaatggcctaagatgactttattttcctatgggttataatttgagtagcatgaaccttatatattggattggttcagctaaatgctatatgtatgtgtgcttagctatgcttagaaacattagctaactaaaggggataattataaactatattatattattttaattatggttatatttaatggtcgatcacgatggttaatcgtgtgatgttaattaattgataaataaaatctggttaaggtgggttgtgagcatatggttttgatggttgtgctcatgacaattaaggactggttcgcgagctactgttgtgaaacatttatcgtgccaaccacaagccagcgtgggcaacggctttatcttttgtatagcatgattcatcatagtgtgccagactgtgaagcggcaagaagtccgtgggggtcgctggggagtccattgcctctggttttgagggggagattatgatccaggaacggtgcactgttttgagttgtgttgtgcaaagggtactgtcacgatttcccccattgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacccctcacaataattatggatgttataactggtaataatttgcttagctcctggtttggagttagaactgtacagccgggtatggttgttcaggatggttgggcctgtgcagcatgggtgtgttgctcagtgttgattaaaatttctgattaattactccactgttttacttctcttaaatgttttgctaaatgctgcttttgcaaatgagcctatattatgccatcctttggtatccttgtgcacttgcatatttgctgtgtggtttgttgagtatgtcatatgctcattcttgcaataatcatcaaacctcagttgaagataaaggatccagaaggagaagacgtttggcttataccccagttgagctgcctgtgggagtggagctgaagtcatcgctagatcgttattccgctgctgttttcttttcttttgtaagtatgtaacgttattattaagatggatttgtatattaaattgtcagtttgtgtacctcggctgattcctggacgaggattttatgcacaaattagttcggaaattactacagaatttccgggcgtgacaatagccagctcctgacgcgtcaagtcaccggtcgggcaaatcgggtttacaatggctgcccctagcgcgccctggcgacgcgctccaacatgccggggctgaggacgacggcgaggtcctcgaaccactaggtgcggctggtgcaccgcacgctgaggcagctgctcttggtgtcgcacgagaaccggaacaccgagctctccggcgaggaagctcgtcagggtggcgtcccctggggtgatggccacgtgggacaccagcgcgccgatgacctggtcgaacatccctgtagcgtccaccatcgggtgcagctagccgctggcactacctgactatgtccaccacgctctgccacgaccactgcggcatctcatcgagagccttctccgtcatcttaaccaggctcggcggtgtcgacacctccgccatcgccgctattgctgccaccatgtccatgaactcaaccgtgcaccgcccataaaatcccccaagatgcggcgctggaggagaggatagagagagaagagagataggagagttgaaatgtgggtccaagagcatttttgatatttaatgtgatttctctctcctcttcaaccgaaaattattattttaactaatgatgtgttcatcagcaaatatccacgatccattttttaagagtgtcttccgctaaaagtcacttcggacagtgtcctacagctaaaaccataaagtcatgatctcctgtaacaaaatttgtcaaaaaattagcacaaatgaaaaaaaactaacacagaggttaactaactgtaatagcaaaaaggaaagaaaaacacgttacaatttttttttaactagggctggaaagcccccatttccattactaaaaatgaaacgacaagtacaacagggttcagaagtaaaaaaacaaaggaaaaggctaaacacaacccccttactggagcagcaccctgacaagagagactaacagtttctgcagggcaagctttacagagatcaccagatcacagacaacaagatgtaaagggcagcctaaccgagtagtaccatagcaaagcaaagaactcagcaacactaaactcctgaacttctttattccaaacgtcttgcatagattctccacccaaatcgggaactgaagacttcacttgccacttgtcttgccagcttggctcccaacattaagcttctttgtcttgcctccgatttctgcaagttagcccaattttcaataaaatgacatgtaagatatatcagctcaattggatcattgggccattttttatcaaaacacactttgtttctggacttccaaatggcccataatacagctgccaccccccaccatcacaagttgcttagagtgtttgtcaaaattagataaccattatccaaacatatggtttttatctctagcaggtgttatattcaaggcacacaacatcacattccagatcaatttagcaacagagcattcaaaaaataaatgctgtatggactcctccttatcacagaattggcacaatttatcacattttctccaacctctcttaaaaaggttatctttagtaaggattctgttttttaacaccagccataggaaaatcttgattttcggaggtattttaaacttccagattttttttatatgggaatgccacttgctcccttttaagagctttaataaaaggatttgacagtgaagcaaccatgcttttctagattccaccacattttatcttttattccttcttgcaaattcagaagcatccatctctgtttaatccagtctctaagtttatctccatgcaaagtccttctgaatttgataatctcccatcctttctccttcagttttgcaagggtgatatgtctagtatgggtaatgttgtataaagcaaggagctgcaaattcagaggtctgccaccataccaattatcctcccaaaacagattgtttttgccatctccaacctaagttgaacaaaatttcaggaattcttcctgacttccatcaaaccatgctagaaatgaaaattacccgctttataagtcacccatgacaaagttttttgactcaaatatttttccctgagaatggaaattatagaaacgagcgctcgtcaattcgtcattgataaatcatagaatgtcacatatgtatgttggtatgaataatctagagttgagctcctaattggcacagtccgtaaaaagacattcggccttcatggtaactatagtcctcttaatttttatatgtgtacaccgatctcaagtgaggccaaaagatggacagcgcttgaaatgaagaacgaaattaccggtgggcggtggtacaatcaaggaatgatctgcggaaaaataaaaacggccaccactttactgttctcgattaccggcatatgtagtacaccgatcttaagcgaggccaaaaggtggacagcgcttgaaatgaagaacgaaattaccggtggtacaatcaaggaatgatctgcggaaaaataaaaacggccaccacctactgttcaagatttaatttatatgtatatcatgatttgggatagatgcaattggatggtcagaaaacaatcttcactaaaacatggctacccaataagcgtttaacaactgtccatagctgctcttaggcacgaaacaatctacctgcccaaggtttgcccagcaaaaagatttcaatagttgaaatgggtaaacgaccgcctaaagctctctttcagtgaaataaacacaggtgttcgaaaataagtgttgagatcactgaagatgaagtgc

SEQ ID NO: 60599 - DNA, 1046 bp, Oryza sativa
ttcctctggactgggttcggtttcttaccaattgatcgcggtaccgtaaggctttggcgacactgtcctccgcatttgcaggctccatctccactgattgtctcactgcatggaaaaaaaaagcattgtgtcgttctgtaatttgagcaagagctagcaatagataagcacctaatccaaagcaaatctaactgataaatctacctaatctcaactagcacttcctatgctcctgtctgcccaaataaaatgctgatttgcatgtaacttcgccgttcaatcccgttgaaacgcacctgccgttgtgtgacaaatcgtcgggtcccagtggattgaaaaaattcagtaattttcctgattacatcatcagctgtgagacacctgcgtgcagtacattaagaaaattcagtgtttgatcaatttcatccattcattcattcagtacagtagaaaatatcatccattcagtgtttaagaaatttcacatatagcaacctacaaatgaatgtgctctcaggtgatacacacatatgtaaaatcatgtgatgaaaagcaacataaagggaaattcaatttcttcagttccatggcatgggacaaatttctgagtgtgaaaatcaaacaaatcaattagtgttgagagagagaaagagagagagtactgcatccaggagttggggccgcgtcgccgcagcctggagacaaaggcggggtacggagtgagggcagggacggcggtggcgcggttcagggaagaagacgggacatggagttgggaacgcggcggcgcggccgggggtggagaaggctgctcgcgcgccgggggtggagaaggcggcgcgattgggaaagaaggaggtcggatgcgcgcgattgggagaggagatggcggcgcgaccgggagaggaggagccgagttcgcgcgctcgtgtagataggagagggcaatctgttcggttgatggcataggtgggtaattttttcaattatctaggggtagtggatctttatccactcaataatctggaaaaagctcttttagagca

SEQ ID NO: 60600 - DNA, 2784 bp, Oryza sativa
acccttagattatcttaaaccctacttaggatatgattatcacaagtaatatataaattattagtcgagttcactctaccatgatctttccatgggataaaataaatacgatacacttaaaatactctcgggtgaaatgctacaatggtatatccgtgcgcttgcggatgaattctgtaaccataatatagcaggagtgtttctgcgccattgtttttagtaatgacgttaagaaataccaacagtagccttgttaagtttcctataatctatgcacatcctccatccggttacggttcgttgtgggataagttcattttgagcatttgcaaaaaccgtcattcctcccttcttcggcacaacgtggatcgggctaacccactcactgtatggtacgggataaataatcccggcatgcaggagtttcaggacctctttctttacaccttctcttatcgcattattgagccatcgttgaggttctctggagggagtactctcggggtcaatagggatacgatgaatgcaaagcgacaagaacagcacaatgcttttctaacacagtcagaagacgttgagtctcgactttggagagcttgtcactgattatgacaagggcttctttgtaattgtgcatgaaggcataccataggccttgaggtagaggtttaaactcaagcggaggtcgaggtggcggttccaagattggaagatcgagagtctcttcgggttccgcttcttccttgatgaagtcagggacttcatcttccaaaagggcctcgggagactcgtgaggaggaactgttgtaaccttctccgctgactcaatctctaggagagaatcgatcaaggcgaaccttgcccgtgagaatgggactgagaattcattccctcccaaagttatcttgaggctatctagccggggtgtgcttatgaggagttgctcaatgggaagcccgattagaatgtcaaaatcttggatttcaaaggcatggacatccaagactggctccttgtcacgcccggaaattcactagtaatttccgaacttatttgtgcataaaacagtcatccaggaatcagccgaggtacataaactgacaatttaatatacaaatccatcaaaataactaaagcaattaatacttactgaagaggcacttagtcctcacaacgaagaaaactacagcggaaaaataaaatctagcgaaactccggctccactcccactagcaactcaactgggtataagccaaacgtcttctccttttggatccttttcttcaactgaggttgattgattattgcaaggtgagcatatgacatggactccctagcgacccccacggacttctcgccgcttctcagtatggtaccccgcaatgaatcatgctatacagaagataaagccgttgcccacgctggcttgtggttagcatggttaatgtctcacaacagtagctcgcaaaccggtccttaattgtcatgagcacgaccttcaaaaccatgtgctcacaacccaccattaacaagttttaattatcaattaattatcataacacgattaaccatcgtgagctaccattaaatataatcataaataataatgtagtatgattcatcccattaatgagctaatgtttctaagcatggctaagcaattatatatatatagcttttagctgaaccaaaccaatatataaggttcaagctaatcaatttgttacccaaggtatcaaggaatagagtaatcaatgcaaattggccataacaaaggaataggttcacaccacccggtgacattcgaaaataaatgcacagttgaaataaatagagaatttaaatataggatcaacatgctcaaaggaattgtgtttgggatctgtgtgacttgccctgcaataatcggtcttcaattagtcttctgaatctcttccgacacactcacgagccttcgcaacgacggaaacgacaagctaacacgcaaaacggaaaaaaagactaataaaaaccaaataaacagtacatataaagtaaacaaacatgtagatcatgattttaagtgaatttagcagcttgaaccactcgaatccgagttacgatgatttagttatgaattttctaagattaatctgattttaagatttatttttagaagggaaaaaggcttcatgacatcatcgatgatgtcaacaccggcgagaggctcgggacatcacggtcaccggcgatctaggtcacgacggcgagaacggagggcaccaacgcgacgagcacgacgcggggaactcactgaggggcggcacgatgacgaacgacgatgggagacggccggtgacgagatcgaatcggcgacgggctcgacttgacggcgtcagaggcgctacggcaggcttcggcttcgacccaggggtcgacggtgtgcagttcctccttgcgaagctgggagaggcgacagcgcaggtcgacgacggccgaggcggctgctaggggcggctggagcggctgccggcggtggacagagaagacgaacgcggcgacggcgctacaagcgacggcggagagagggagaggtgccagccgaaagaggagagggaggggactctatttatagccatgggagagagatcgatccaacaacgagagaatcggagccgggattttctagggtttggtttggagagaaaaacacgaatcgagctcgattctgcgttgatttcttcgggataaagtccgattcttgggggaaaagataaaggaggataacaggaatatttcccctca

SEQ ID NO: 60601 - DNA, 1206 bp, Oryza sativa
agaggagaccggatttggaggggaaatcgacggcaatggcggcatcgggctctgtctccagccggctggaggttgaagatgccactgcagcgataggaaggaaaagtagacttccggctgggcttctacttcttggcccgattgaaagagggacacaaagcagacttcgacagagagagggagaggggctacaggcagagaggagattgggccaagaaagagagaggacttttcctgttgcggcccgaaaaaggaaaagaggaattttaattacttttccaattaaattaatcactgaaatgatctttgaattgttaaaaatacttccaatactcaaataatttcaagaaaaatcattaaaatacttggacactcaaagtacttaacaagattataatcaaaccatttaatgattaatttaatatgtggataattactgaaatgttgtttgtattattaaaattaggaattgagctccgaaaaatccgagaaaattccagagagtataattaaccatggagaatttactaaaaattaaatccatccatgctttatatttaggaaattttatttcccacatttaacttcacttgtaaattaatgatcatttaatataaattctaataataatttattaaataatttataaatcctgaaacgaaaatcaggatgtgacactccctatcttcaaagcagacaagcatatcttgtacaatcccaaatccttcaataatatttccgttcgggtgcttgaagaatttgtttgtcggggttactgccttattgctcagataagcgaatgcaaatgactcagagatgagattaaccccgacagttggactgtaaagaataccaacggcgttcccctccggatggcaaggaatgattcggggagcggtatttatccgaattacttcggatgaaagctctacctcccttagccattcgtcgctcattatggatgttaactcccgaacagtttcccttaggaacccaagttccataggatcaggaggcggcaaggggacgagtggtttctttttactgaaatagttcagggtgttgccataatcttcgtcaaaaccgtccttgaacaaaattgcggcacgatccgagtttgaatttcttcattctcaatggatggctactcgagaactttctcatcaatcgagtcagcggaagtggaaggctcatattgtgactcga

SEQ ID NO: 60602 - DNA, 3154 bp, Oryza sativa
ttttaagagcacatattcgggtaaggacaagattggtccggactacactaaattagaaaatctggaccaggctgcactaattgattcgtttttgatctgctggaaactgaagatctctactcgaagggtagtaatatgagtaactaggaagaaggcaagacagaatctgtctcgtaacttttcctaaataccgtttatgcatccaacggtagaggtgtaccattgcttcgctctctcttgaagagagaacggaaacaatttccaccgtacagtttcttgtctcatgccacgaatcttaaggcatgagcagacttgctcgaagtctcgcagattatggtagggattttctggatcaaagctagaaaaaggattctccctaaccatgctaattagttcggggcgaatttcatagcgagttgtataaattggctccgatgaaggaggtggctcatagaattcacccctaggagcagacagctcgaagagaggttgatctatagttgagaagagtttgacaggaatacttctctgggtagcaggggtaaaggtagaataaaaagtaaaaaagagatacgaggatgaactgggttcagaaatgatcagcaaccgttccccggcaacggcgtcagaaatgctgttggtaattcttacggtcacaaataaaatctccaagcgcacggatataccgatgtagcacttcccctacaaagtattccaaagggtatcgaatccaagggaacgtgtgtggtcagatcttcctccggttcatccaaggacaccaaataaaggataggccaggatagagaggatttactagtgagaaacagtgtctagggaaagcttaagtttaatcctaacacaatacttcaggcactggcaacccggacaggaaggacttaagtgatctcatactgtgggatacgcaacaattattggataacaattacttaaacaccatgtctaagcaattaatatctactttaatgtttataactcaccaaagcaatcactatattttagttgattatagtgaataataatcccgtaagctatttaggaactaaccaagagataattctcacaagataaatctaaattactcaggaagaatattatattgaaatcagagtaataaacagaataaaagaaatgagagaagattaccgacaactccggaattcttccgacgtcttctactctactctcttcctattctagtatacaatatagtacaagagagcctcttataattcagctcaagcttggatgtgtgtgtgtgaagtgagggagtgaagtctatttatagggcagttatgacggttgcgagaaggggaaatgtccgaactgccgcacaactgtcatcaggagagcatctagagcatccacgccaaaccccaggatcaacggtgatcagagggttttggccgaaccagggggttcggccgaacctgggctgggccctcccggcctagccttcggcctgtggactctcgtgactctcctctgtccattttcagaattttgggatgagtctttgatattctgatggcgttcacaacccatccttgtatgaatacatgtttctcctcactttagtctagatttcctcccaacttcgggttcatcacctgcatacaaatatacaccaacacttgtggaatatgtgagatttaacacctatcactatgttggatgttttattatctagactttatgcagatgttggcggtatagaatcggcatttagcagccaccaacagtagggtagtaggggattggagcacaatctactatgttggtgatatcaggagaaaaatgcaactaaaaagcctaaggtggtgacaaacagtgatttggaaaaaatcaagttctacattattagtggactagagtaagaatgctaaggagttgacgctagaaaacgagtcccaagagctagaaatacctttgagtgaaccttttcggtcataaccagaacctatagagatgacatatgatgaggtcgatagaatagagaagtgtgagattcccacatattataatattgagaggctaaggtagggtgaaggcaaataagaggaatataattttcaagaggtgttacacaagaaaaagagcaagcccagaaaagctaaaccgacagtgacctcaaggacgagtctgagcctgagagaattggcagttgtcccagtgccaaagagagctaaatgttgactgagaggaggaacttggagtcatcagctacgttttctaatccttttgccatttttcaaattatgaatgttgatgaattgaataacatcgatgttgttttacttaaatatcccttgtacattggctgttgatggttggcggagagtcaacataatgtggtgatgtacaatgtgaaaccctcgtaagtggcaatgttgatgtttgtagaccggcattatacgaggtgactctcttatggcacttaaatctattctgccaacggttgacggttgagcgtgaccgaacaaccacgggatttgaggcatgcgagcctggcggttgacacagaggaaaaggtgatgggcattcgcgccagagcggctacaacaggcagaccttgggcagcaggaaggaggacaacaagagagtggcaggctgtgctgagctgataagctgggcaagttcagccaagggacaagaggaagtaaactaagagatggggaaagatgggttggtgctgcgtggcagggggaatgagagtggaaggcagaatgggccagctgggtgagaaggaaaaagaatgggcgcccatgaagcatagtaaactttgttattttccctgagaatgacttgttagaatagtagagtatgagcatttaaatttaaatttaaatttgatatttgacctaagataaatgagagggattcaaggaatgcttctttgagtggatgtcctgatatgttttggaatgaattttgtatttggtttggatggaattggtggagagattatctcttcagacttgaaagttggttgaggttgaaaccaaacactactagaaaaagcattttcccaagcggtcaaaattgatttttgcaggcggaggtttggaccgcctgtagccaaacgactgcgaaaatccattcaaaaaaacaaaaaaaaaaaatcacgggcggccgc

SEQ ID NO: 60603 - DNA, 3540 bp, Oryza sativa
tgcgccgcaccgccgccggacaccgcgccgccccaccgccggacgttgcgccgccccgcgcgcgtagccgccgtgctggagaggtgaggggaggggaggagaggtgaggacaggccagccgtgggtgaggggaggatttgagacttagaaaaaaatcactcctatccaagtctatttatattcgagtctattttcgcaggcggaccacttaacgccgcttaagtggtccacctgcgaaaatagattttcgcaggcagacggtagatttcacctcgatttatatttttataggcggtcatttggctctaagggttatgtccgcctgcgaaaatgagacccccatgttgggaaaaatgctttttctagtagtgaaatatctaacatttggatccaggggatttctagagatcaaatgaaaaggatcaattatatgagcagcataggagggaattttcttttggtatcaatttttggtaccaagaaaaggaaacatattgatagaattttggcatgacttacaactctgcactcacaaaatgaaagttgcacagatagattttcatcaaactagtttttaatgctgagagaaaaaggggtgttacaacgaaggtgagaagttacattagagttgtataatatgtacttataatctgacgtccaagaatttgtaatggagttgactgtcgatgttttaaatttttaaaatacaattttgcattctattttaggaaaaagtatattttacatcttcagctattattgaagtccaaaaaatcacccatgtgttagcgatagcgctattatcgcatgtgataatatatgcatgtcgtgtattagagataagagagactttggataagaaacttcttgtactacaatgcatgtatcttctatctctctgtaagccatgttggaggctatttcgaaccaatacaaatacatatatgcgacctctgtatgaggtgagaacgcttccatattttctacagagaatatatggtatcagagcctcctcaccaaaactagatcgcatctagccatcgtaagtaactccagcgccgccgtcaatccattgtccaggcattctgcccctgagaagttgacccggggcaatttcctttccatggaaggcgcagatccttccaaacctccgtggcgcgcgtatggaaggttacatcaccggcacgactcgcgctctagctgccaagatcgaggtcacagagaaaaatggcaacaagacgacagtcaaggcgctgaatccggcgtatgacgcttgggtggctgcagaccaacatgtcatcggtttcatcctcgcatccctctccaaggaaatcctgatgcaggtcgctaccgtggagaaggcggcccatgtttggagatcaatctcatagatgctctcctcccagtcacgtgcgcgagctcgcaacacctgtctcgcactttccacaaccatgacagaatacattaacaagatgtccactgccggctaaccctgtgacgatgaagacatcatgtcctacatcctcgccggcctcgacgacgactatgaacccgtggtttcatcactggtaggcaagaccaagccagttcacatctttgtagtttactctcaacttttatgttttgagtacagggcaaaattgcgtcaatcggcagcaaaccaggtctactcctccgccaacagcactaaatgtggtggtgggagaggtggctacaacaacaacgacaacaacaactccaactgcggtggatgcgatggcaactccggtggtggctgtggagatcgtggccatggccgcggcaacggaggcgatcgctacaactccaaacctcatatggtgtgccaattgtgtggcaacactggccatttggctggcgattgctggtatagatttgatgatacttttgttctagatttagaggtaacaatggcagcctcatacaacgttgatcccaattggtatgtggacactagagccacggcatcaccggcgagttggagatgctaacaactcgggaaagtacaactctaaagatcaaacatatacagcaagtggtgcgagtatggagattaaacatatatagaattcagacacacacgcgtaatctttatctttgaaatattctacatgttacttaagccaaaaggaatctcatatatgtacattgataatcatgcttttattgaagtatactctcgtttctttgccattaaggatcaggcaatgaaaagtcttcttcttaggaggcaacgccgcaatggattgtatcatctaccgaaaatattgcttccttcatccaagcaagttctcggagttgttaagcctagtattttgcagtggcatagttgtttgggtcatccctctttatccaatgttcaaaaatttattagcaataactagtcgccaacccgtgcatttcacgggctatgattgacgtgacataaatattaaattttaaccatatatatataatatcttataaattgtaaatacttggtaaaaagttactttgcatcgatggctacatgctgatattaaattgaaagtataaaataggaccatatttcttaattaggaaattagaaactattaaattctggaaaggaactaaagagttggtagtaagtgtacggtactactacggagaagttgtcagcttacactggtaatactttgggggtaaatgatgcaactcagtataggagtatatttggagctttacagtacttaacattgactagaccagatatctcttttgcagtgaataaggtttgtcagtttctacatagtccaacagtacaacaccggatggcagtcgaggatattgagatatattaagtcatcagttaatctattttgagaattgataaatcttattttactttgttagtgctttttcagatgcagattgggcagttctgtagatgatatgcgatcagttggaggttttgctgtgtttcttgggtcaaatctgatatgatggagtgctagaaaacaagctattgtttccaagtcaagtacagaagttgaatataaagcagttgctaataccacaacagaggtaatatggatacagactcttcttaaagagatagggatttctatgcctcaaactataagtttgtggtgtgtgataatttgggagctacatatttgtcagtggatcccctttttcatgctagaacttatcatatagaagtagattattattttgtgagagaaagattttctaggaagcaattggaaattaagtttatatcttcaggagatcggatagcagatggttttactaagtcacttgctgttcaaccatttaagaattttgtatacaatcttaacttagataagttattattaaacgagaaagtcagcgatggcgctattatcacatgtgataacatatgcatgtgataatatatgcatgtggtgtattagtgataatatatgcatgtattctatctctttgtaagccaagttggaggctatttcagtaacataccgagcatttcacctaggaaaatttttgaggaaaatgaaa

SEQ ID NO: 60604 - DNA, 1442 bp, Oryza sativa
attcctgcaccccagtcaggattgatcatagactcacagtacgatcacacttagttatcgaagtgtatatactcatacagcagataatttgtgaacccattgacagatgacaaccccagtcccaatagcattatgaagtttcacgtacagtaaattattacatcatgctgccaatgaatcagattgctgtgcaagtttgtaggtgagggtgacacctgtcaaaaaagggatggctgatgtactaacaagtaatgacagttggacaaaaggaaaacaatttttacaacaaattctggaaggtctgattcaatgaataaacttgaccaattcttagctgggaggctcctctcttttgaagttatgcaaaatgtaccgacagtccttaaacatgtcatagatgggcacagatgcacagttggacccgtgatgatacattaaattaagggcttaaatatgcaatttgaaagttcaagaaccataatgatagaagaattgtactctactgactatgttaaattacatactgctacctaaaaacgcttagcttgtaagtttttcattaccaacaaatcaataattatcccctcaacagaaaatcaggacatagaacaacacatcatggtaccccatgaactatttccatgaagctaaacacaatactaccaaaactcagaccttgagctatttcaggagggatggtttgcctagctgggggaaaccaacaacgcttgactacaagctcaaggccaagtttgcctcggattacacaatcaacctaactcgtttcaatgatttcaacaactttcaaggtattttgagatgagaccaaaaggctggaaaaggctcagaataaacttttttgtcgtgtgcaagaacacatgcaatcaagttaccatgaagatttgtgctcactttagttcaggctggtctctggaggccaaatagggctccaaatatgccctttttttgtatctctaactcaaattggacttaaatactcatttcaaattgaacatgtatcatacataaagacaaatactcatttcagacaataagtagtgttatatactcaatcaattcaaattgaaacacattaagcaatgaggttacttgttcaaaacaaaccaaatgtagcttggcagatgccattttgtatggaacagaatttctctgaccactaaggcaaattcatagtatggcatgctctttgcaagcctctagtaaaggatcacttgctccaaacaggcaaacactttattgtatggagcaatttcgtttctgcccctactttgatgtgggctaatactgattttacccctactttttatggttttcgtttttgcccccaattttttgaaccggacgatcgtcttgcccctattttggatgctgaaattaacggcgttaagtaattatcaaaaggacatctataccctcttcta

SEQ ID NO: 60605 - DNA, 13770 bp, Oryza sativa
atttaaaataaaatgactcacattgactaatataacaattatgacagattcacacctaattgttgtggcaatgtgcatcatttaattttaaatatattcacaataataaagttccaaagcaaacatgtataaaatgggggcaaaaacacaattaatgaacataaataggagagggtataaatgttcttctgccaattacttaacaccgttaacttcaccatccaaagtaggggcaaaacgatcgttcggttcaaaaatgtgggggcaaaaacaaaaaccctaaaatgtaagggtaaaatcaatattagacatcaaagtaggggcagaaacaaaattgccccattgtatctattcatccatatgctccaagccctaacaacaatagcaccaatttataattatttttctcaaaattgtcaactgattctggaaccaagagatctcttgattgttcatcctcttgggtctccacattacacatttttcaatgctcaaacatgctaagaccatagcaaaaatccctaacagctcccaggctcaggtggaaacctcaagcatgtattagtcaatgcaacaaggtaatgactaataggtgacatggcatgggtagcaggactacactacagtgatgtcatgaagtctgttacataaaacggaacaacgaacacaaggaccctgaggtggtcagttcaatgagtgcatgtgaactgtaaggtgacaagaagcacaagtaaagccactcagtgagtggcagagatggcctcatgggagtgatccacagatggcctcattagagtgatctggcggataatagcataatgcaaacaatgcaaccatggtaactaaattaccctccattggaatgttccccacactgatatgacttatgagtgcatggacaagataacaggcccaacagaagcttcacaaaggggacaaactcaggtagcagtatctggtgagctctgctgtggcctcaaggaagaacagtaaaggcaactttggtgacaccagcaagacggtgttagtgagaatgatagcaatggttacaaagcaggcacccaattttcttaaggagtgatggaatatgttccatatttttgaaatggacccaatgtattgtgttagtttttttcccttctattagctgtactttggttaaacagatagaagtggttttcttcacctcatccagaaatcttgatgctaactgatgggagcttattttctgtaatctactaccttagaatcaattctctgtgtcgaaagatagttcccttcaaatatccttcaccttctgtaaagcatcaacaaacctatttcagatgacacctaaattagcgatacttgattttctgtgttttccccattcttgtaattctatttatctgttccaaacagccctatcagcttacgagctaaagaaactatattgggctcacaatgtgaatagtcctacctgtgcatagggacctcgctaactcatattgttcaaaatattttcattcacttttttatctaaaaaggttggatagatgaaaaagaatgaaaaaggttttacaagcaggtattgcttggtttgctaggcttagcactggtcatccagtcgttgtgcaatcagccttggtgcattctcagcagtgctcttggcattaaatcctgggtagtctatggacacgtatggattcagtgggatgtattctacatttagctattttcaaagcaatgaaagtagagaacactatcaaaaggcggtgaaacttatgttctgtagatttatgcattgtccagaaacattgttggtccgccaaactcatgacaattgactgtcctttaacttctatggttacttgaatcctcccaacctcagaaacagcttctacagcagcctcccaaccaaaatacaaattataatctatattctcgatagtaatcattaagataaaaaggcaaattacagctagtgaactattttatcgtaaccagatcaccacgaaaagtactttttatcaggtctaatgcacatcgaaaacgctagattggaggagtgcacggaagcaggagcacatcacctctgactttgttgcagaaggggcaggcctggtactggtacagcaccacgttctgcggcagcagatccatgggcggcctttccttggcctccgccgccgccatcgtcgcgaaggtcagggagaaggagaccgccccagcgattccagctggcatggcccgcgaggatgatgatgatgatgcctgggatgggggcgacggctggacgcccaatctcccgccgcccgccgcggccgccgccgtggaggcggcgtccccatggagagcgcgcgaggagaggagcagcgagcgggaggccagagcttgcgccgctcggattgacctcatcttggcaaacgaatagagcggggctgttagggttttggactggtttgcctcgccggcgccggcggaagaagagacggatttaggaattacaagggagatcctggatggtgctggatggaacgcctaaaacccttgatactttacgtattagtacttcaactactattaaattgtgttattatcgcggctaagggcccaatgacggatcggttttctaaatagacttttgttttcggaggatacctttgcgctcgttcttcttggagaagaagaaaaaaatacgcggaacagttgggttcgcaggttaacgacggatgacgggattgttgtccacggctcaacatctacttccctccgtactataaaaaaattaaacctaaatctaataacctattcaaaatcatagtaatataggtatgtttagtttttttttatgtaaagtttttaaagtatacggacacacatttaaagtattaaacatagactaataacacaaacaaattacagattccgcctgtaaactgtgagacgaatttattaagcccgtcattagcaaatatttactgtagcatcacattgtcaaatcatcacgtaattaggctcaaaaaattcgtctcgcaatttacatataaactatacataggggtgaaaacggagcggatattatccgatccgatccgatccgaatccgtccgatgtgaggatatggtaaaaatttttagatatccggccagatgcggatgcagatgcggatatggtatcaacgatatccgacggatgcggattatccgatattttaatcggattatccgatgtaatgtttggcggataatccgtacctttcaggccacacaacaactctatttagcccattttacatcgggcaacccatctagcctatatagtgtaacctaatccaatcctcccctaaatctctctctctctctgcgactcttctctcggtcccttctcctgctcccacatgcgccgccgcatggcaccataggtgcgccgtgccatcgctacagcctgctggcgccaccgccgccgctcctccttttagtccgccgacagtgtgttgtgtgctgtttgctgtaagcagtgtgctgtatggaactagtgtgttgtgtgctgtatgcagtgtgctactgtattgtgtggctgtgtgctgtatgcctatattgctgtatgcctcattgcctcatgcctgtcatactgatgagtgaactactgaactgaacactatatttttaaattttaagcaacgcagtgaactgctgaactgaacacttatattatgtttttgatggatgtgttatattaagcaaaattatattattgatgtgttttggttggtttttcctagagagctgagatcatgttcatatgttgtttggccatcgtattgcggcaattgtattgccgccctcttgttgtatggattgaatacaaacttgacatccgacaactttttgtctgtttccgaacagagtccgcaccgactccgcaccgaatccgacgtccgaaataatccgctccgcatccgcatccgcacgtcatctgcactcgctccgcatccgcttaaagaaaatggtttaggatatggtatagctattatccgtccgaatccgctccgttttcacccctaaatgtacaattggttttttcctcacatttaatgcaccatgcatgtgtccaaacatttgatgtgacgtttttggccaaattttttttatctaaacaaggcctatatcatatttttttattatgtttgttttttatgagacgaaagaaatacacctttaccaaaagcaaaagcataaggttctcggttttggacatgtgaatatgaaagaaacatgatgatattaggatcctgttgggtagggcttcaactattaaatttaatttcaagagttaggtctggactagagttatgaagcgcggtttaaacccagctttacctcgctagtttattttgtgatgcacttcactccgcttcgctctcttgttaggtagagctgaaactatttggatggactctagctctaagttagagttgaaactctgcctaacaagtcctaggtattgggtagataagcacatcagcacgtactaactttcaaacacacattgcttaaaaaaatccacgctttcttgtttaggagctacttagttttagttgataagggtgtgcatttggtttcctcggtttggtttgatccgtttttctttatttggtttttctaaaatgccaaccaaagaagagcgtgaaaacttaaaaatcaaaccgaaaaatttggggcctcatcgtttggcttttttctaaataagccaaaacggcttattagagaataaaaatgaatttgtaggtaaagcttttatacatgtgtttttgtgacttaaaagctaatgctgaaaaagaaactacgttgaaaatatctcaaaatcaatatcaaaattaagtttgaaaattcaaattttggctttttctttagctgaataggccatccgatgggagccttttggtgtactcgtcatcattttttacccaagaaactgccttctcccatcgttgcgggcttgagacgatgatcttcactcgtgcgatcgcgtccacccacatgctcatagatctgcccttgcatcgaggttgagctctcatgctggagatcagcactctagcaaacatcgagctccaatgtcactaccgatctaatctggcagatatcaagatcctacgccatcgtagaggatctacttgcatgcgactcatgactctggcaggaggcagcaaatttccttggttgtgcagtccttctctagcactgtgcgtgaggcaagcctctcctgcaagtgaagatgaagaggcgcaaggcatttcccctcgtccttgctttcagtgcggtttccaatggctcgcttgaaagagtcacttaggcttacaaagggaagctagaaactaaaccaggtcggattgtctgatacctggtcgaacagttcgggttgtttttctttctttaccaaaacacactgagggagacccccacggtatatattaattttttgaagtttatatacaaagatggtagaaagggataaaaaggaaaagaaaacataattacagaatatcatggaagtatatgaatctccctatgcctaagtaaatgaaggctcaaatccgagataagatttctcttccaagaagcaacggaatgctgaataccttgaaatattaggccgtttctttccttccaaatattccaagtgtcgaaacaatatttcggtaatattaaaatgggatggctatcaagcttgaaaaatggacggtttaagagacatgaggtttatacaggttcaggccttctagatgagaagtaatgcctactcctgtctggggattgatccgccgagtatattgttgatcgtatgatcagggagaaaagttatgcccttagagtcacccggatccctccttatatagagggaggagccggaattacaagatacaacccatgttcttaacggactaggcttgtacatataaattacaatcgtaaccgactaggactatcggttgtttccttgatacataagttgacataacaaccaagtcctttactaaatatattctatttctatatggtacccctatacccagtcggatatacatgccgtgtgggtatggggtatccataatctccacagtagcccctgagaccttcgcagacgacgaaataatcttctcccgagtcatttaacgaaaaatcccgagtgcttcaattatctccgccttggcctcctgagtgcttgaattaaaggctgtgaagggcttaaaaataaaaaaaaataggtgcatcgactggatgcacttaataggtgtagcccccgactatgtgattagttgaaaaaaactaaacatatagtcaaggttgaaataaataaccagccgagtggttttataatattaccgaagtaattaaatattaaagcatttgcgactccgtccgaagagtttgccgactgctttaattaaattattaagcttactatgaaacatagaaaataaagatccgagtgataaaagcactctaaagatctatcgtctatgaaatcattgtcatgattaatatttgtgatgaacaattggctttgcaaaatgatttaatcaaagaattggtttgaaaaaatgtgtgaatgttggtgtaagtgcgtgtaactaatgtgggtcaggttgtgatatctgtgcccagaaacggttgttttttctgattgtgtgcaggtgacttgaggtcagccttggtcaatggtgaggaccgagactatgttcagggaggaacagaggtctagtgcggtcaggataccatgtgagaaggtgactagagtcaggattcttggaggtcaacttcggtcaacggtggggatcgggactaaactcggggaggagttgaggtccagacggtcaagatgccaggtgacgaagttggatacgagatggcgcatggtggatggacaccatgtgggagagatcttcacaacgggcttcacgaggtgtgcgtgcaagcgtaagtgttcgcgaaggaaattgagtgataatatttggaggtatatggtgctacagtacacgaggtactgtagcatgcaggttatatgtatgcatgtacggtgctgtacatgtgcagtttgctgattggttggcttggaggtttgcatgtatgcgttggctgtttggaaggcagcaggcagcatgcagcgtctcggctcagccaggaagggagcgagaccaagcaggaaacggcaggcgtgcgcgcgagttggagtctgactcggttggacctggttcggcaggtgcggctgagagtttggatattataattgactagcaaaagtgcccgtgcgttgcaccgggtgatcagggagtgtgtacagtgacaaaaagtgttgtttggtttagacaactaatctgctaaaaaaattatttaccacgaacgtctcaagcacccgtgtcaaatcaaagatttaaatcaagattgactggttccaccacaagaaacttatccggttaaactatacccactttgcaattgtgggaatatacatgtgtattgttacctgagaaaaatatgtggacttcaacaaatcgtaaaaatcaatcttattaattttgtgagagtgagtattggcttttatttacaaattgtatttgaggtcaaatattaataagtagacattaaaaaaatgaaagaagattagacggtgaggggaaaaaataaaaaaataaaaaaaaagagcgaacaaggacaggtcaagaaaattttattatttaaacatttttaataaatagatgctcgtgttacgtgtgttgcaacgggtaaactaaaattataataaatataaaaatattagatcgttaggatttagtttttatgatatgagccctttaaaaaaatatattccttacataaaaaaaagttgtaaaagaaaggcccattagacttaaaaccaaacaaaaattaaaaccaaccctataaatctctatatgtgccggttatatggtatacttgtgctgtttttttattcaaatacagagtgctcatttttttttaaaaaaaaggcccgtcagatctaatccttatccccgagagagcaagcggagagcgagcggagcaagcggcgcctcgatccttccgtctcctcatcttctcgttttcccgacttcccttatcctctctctcctcccttcattttcctctttctcggagttctctctactgccgtcgcaaccagcgacgccctcccctctcccctcaccagtgcgctgcttcccctccccctcgcacggcgccctccacccggctgacggcgccctcctcctctcggtcttctctctcgctctcctctctctcggagccaagcggcaggcggcggcgcaagaggggaggcagcgggcgacgggtggcggcggcaggtggagacggtgaggcccagcagcagcgggaggcggtatcggaggtgatggccgcgtccgcccctctgctgcagcggcgggaggagcggtggccgcccagaggcgccctcccaccgctagatccggcgggaggaagggctccggagctgcgccgcctcgccatcctccccgccgccacctaatgcgtcggtcgatccagcggtggcggctccctccgccccctctcgccttcctccggcggcggtggcagcgtcggcggcagccgcgggcggatccggcggcggcgggcggatccaacggcggaggctccctcctccgccgcctctcttctccctccggcggcggtggcggcggctgcgacggccgcggattgatagcgtggcgacggctgagggcagcagtggcgacggccgaggtcggatccggcggattgtgatgcatattgtagttcttcttggacatttattttgtgattttgtgatgattgtggttgagtgatttggttgtgccgattttgggaattgtttctcttgtatccgattctgagagggattgggatttgggggctgcgggcgaaggcggacagaaaaaatcaacgaaaaaaaaccgggccaaaaaaccgtgaaaaaaacggacggcccaaaaaaccggacaaaaaaccgacgaaaaaaaaaccggggtagagaaccacgaaaaaaccggacggcaaaaaaaaccgcgtgtgcgttcaggaaaccaccgacggacgaaaaagcctcacggaagccttacgaatttttttattaggtatagatttagaaattgagcatagagtcctagtgtgactaggagttattctcctactttgagtaggaggttttcggtataaatagagagggagcgtgagacttccctgtatcgcttttcagagtgtggagttgatagtttagttagggtttcgagtttagtcgagatttttgtaaggagtgctgttgttgcactatgtaaacatagagagaagcaataaagttatcatgtactttgagagttcttcgatttgtgttttcttgggttcaggcggtagggaggcgatctaaccggcagcgtgcgagcggtccgactggcggcgacaggactacgtcgagatttccatcaatttgagggtaacttttatttccgctaaaagtttttgggtttttggttttccctaccattcacccccctctggtaggcttggttacttgtgttcgatcctacaagtggtatcagagccttgttttcttcccccctctgtttgatttttatcgatctagagtttttgccatggctactcctgttaggttttcaactatgcctcctgttttcgatggaacggattttactcattggtgtagtaggatgcaatcttacattatggctaagaattatgatatttggagaaaagtttctcatccttttgtgattcctgaagttattaatactgatgctgcaaaaactgagtttgaacaaaattgcaaagctcgcaatattcttttgagtgggatttctcgttcggattatgatcgtgttgctcatcttcaaactgctcatgagatttggattgctttgagtaattttcatcaaggaacaaataatattaaagaacttcatcgcgatcttttcaaaaatgagtatattaaatttgagatgaaacctggagaagctttggatgactatctttctcggtttaataaaattttgagtgatcttagatctgttgattctttttatgatgctaattatccataatctgagatttcttgtcactttttgaatggtcttgacatgtctatttgggagatgaaagttacatctattcaggagtctgttaacatgtctactttgactttagattcactttacacaaaattgaaaactcatgagatgaatattcttgctcgtaaagtcgattctaagtctagtgctttggtttcatcttcgacttctttggatgttggtgcttcttcatcggagtcttctgttcttgctttatttaatgccatgtccgatgatcaactcgaacaattcgaggaggaggacttggttttgttatcaaacaaattttctcgagctatgaaaaatgttagaaacaggaaaagaggagaacctaatcgttgttttgagtatggagcacttgatcatcttcactcgcattgtcctaagcttgagagaggaaagaaggaagatgatggtagagtcaaagatgatgacgtgaacaagaagaagaacatgaaagagaaggagaagaagaagcattgtatgcagtggttaatccaagaactcataaaagtttttgatgaatcggaagatgaagatgagagcaaaggtaagcaagttgttgatctagcttttattgctcgtaatgcaagttctgatgttgatgaatctgatgatgataatgaagaaaagcttagttatgatcaattagaatatgctgcttacaaatttgctaagaaaattcaaacatgttctattgcgcttgatgagaaggattatactattgagattcttaatgctaaaattgctagattaaaatctttgattcctaatgatgataattgtcaatcttgtgaagttttattttctgaaattaatgctttgcgagatgtcaattctattaattgcaagaaattggaatttgagattgaaaaatctaaaaagttgagtcttcttttgctcttggatttgctttacatgctagtgttgttgatgagttgattttgacaaagaatgttttgaaaaaaaatacaaagttgctttttgtgcaagttctttggtcaatgctttatgtgcaaataaggcaaaacaaaacaatggtgctttgatttctcaagattgttcaaagtgtgttttgaatgagttgaagttgaaagatgctttagagcgtgttaaacacatggaagaaattgttaaacaagatgaggtgttttcttgctcaacttgtagaaaacaaaaaggtcttttggatgcttgcaaaaattgtgttgttcttacacaagaggtttcttatttgaaaagttctttgcaaagattttcttatggtaaaaagaacctcaatatgattcttgatcaatctaaagtaagcacacacaatcgtggtttaagttttgattcttatgcttatcattctagacatcctcctgttgttttaggtgttggtgctagaagtggtaaaattttgattgaatctgagcctaagaatattgtgtttaaatctgctggcatcatgtctactttgattgcatcttcttcaaaatctactgttgagcatgcgaaaccttctgttgatgcaaaaccattgatttcaaaacgatctacttcacaaacttgtcgtgagaagtatacttgttctttttgtggaaaagatggacatttggttggtttttgttttcgacttgcccgcaaacagaaaaaggaaagagaaattgcttttgcaaaacaacggtggcaaaaatcgggtttttgttcgaggagcacagttagaccgcaggtgaaccggcggtcagaccggctgccaggcccggtcagaccgtagggacagcgacggtctgaccggcctcggggcagtttttcgcatacttcaaatcggacttttgtgaaaccaaaaggtaagttttcagctaagtctgattctgattttgtttgtgcatatgtacctactggttctattggtcgtgtgactcagtgttggattccaaaatttcttatttctaaccccaacacggaggcctcgacatcttcttgttcgtaggtattttggtggcatactccccatgtgcattcaacgttgagatgacgattgcttttcatggtaacatcaatttacttttggattgacatatttttggttctacgctctcgtttattagcttttcatatgctagtgtttgaggtagtagtttttgttaatacaagtggatacatgtcaattcatgagaaccttggtgatatcattggcaattggatgtctttttcaaaatctttaatttcttcttgatctttcttcggggagaattggaggttaatttgagggggagtttgtgctttttcatgcattcatgtttatttttatgcatttgttctaattctgaaaataaataaaaatgagaaaaagaagagctttgttttatacctctagtatattcttgtgcatgctagcaaaataattgaggtatatttgttgctatgttagcttatatgcatttttagtctttatatgaagcttagatattgcttttaagtgagatgatgcatgacactaattcttttacttgaattaagaaaaatatgcaatattgatgctagcatatggtttgatttataaatgctttatatatgtgctttattgaattgttattcctcacatacctttgtcattgctcattgcgtaagagaataaaaaatatctgtgagagagaaaaaaataaataccgaatccttggaaacagtcttgacgacaaggacgtattcgatgtgagcaaaataatgggtgccgaatctctggaaacagtcttgacgacagggacgtacccggaataaaagagaaaaatatgagcaaaaaggctcaagaaaaagtaaaaaattctcttgattgttttgtgctaatgctaatttgagaaagaatgataaatgcaataggtatatatgtatagtgtttatttttcaacctatgtgcttgtgaatatattgcattataaatcatttgaaatcatgaatccttattgttgatttgagcttaattgtaatatctttgatttatgtttatactatagtgcatgcttgataaatagctgatgaatttctcccttatattgctacacatgatcatgaattgcttttggtacattttaaagctctcaaaaaaaaaattagaaaatagaaaataataaattggttattacaagtgataatcatgatatcattgcatatgtgctttattggttattatttctcttttgcattcttgaagaaatatacaaaatgcatgcttcttgaaagggggagaattgaattgtgtttcaattttaaaaatagtcgattttgtgtttttgtcgcaaattgatgggagaagttcttccttttaaaaagggggagattttttctttttcacctttgtgatttttgtttttatttttcaaaaacataaaattgcattttggtgatgttgccaatgtgttcatcaagggggagattgtgaaatcattgtcatgattaatatttgtgatgtacaattggctttgcaaaatgatttaatcaaagaactggtttgaaaagatgtgtgaatgttggtgtgagtgcatgtgactaatgtgggtcaggttgtgatatctgtgcccagaaacggttgtttttctgattgtttgtgttgagattatagacatataatg

SEQ ID NO: 60606 - DNA, 7261 bp, Oryza sativa
ttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtgtgtttctcctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcagttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactatccctcgggtggagcgtataagtcatactcctaggtctttagtaagcttcctagaagattcacccaaaatcttcatagactgcgaccaacagtcaagctcacaaaggtgagttctttcaagaatgctttgcaggacaacatcttcgctaattaaagccaacagaactcattaaggcatagccaacctgccttgcagctcacgagagtacatgcatcttcacttggagagggtatatatattgatactctcctctagtttactaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactccggagtttcttaatttcctgacagacttcaatcgtcttttcacatgtctagacgatttcatattatccttagaactatttactttgacaattaccgtttgattgtcacagttcataaggatagctggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaaaccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattaacttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcttcattgactgcaaagcctgcagatatcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcgctacagatagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctgatggtgtgattgaactgggaattatttcagagggttggttcgaaccactatgtgtatccttcattgggaaaaagctctcaaagaaggtagcatcacgagactccataattgtaccaacatgcatgtctggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaatttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtagaagttctagtggtgccaagtttctctccttggcagccttgtgaggcttgcgaggttgcttcgattgcacacaactatggcacttagaacttttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattccggtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatggaggtagttttgcaataatgcacccggccacaaatttgtcgggtaagacacacttaaggagttcgagttccttagccatggtttgtatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccgactgcttggtcgaaacttttcgcagatgtctacgaaggcacgaaacacgcgagcgaagaggaagacgagccgttgtgaacgaacagggagcagtcgcgcgaagcgcttcccaaaaaccttattgccgccttctcccggtgcaggacgtcgaaggcagaggttccggagacctgctctcccgatcgccggtgcacgccggcgagcgggatggagtagtctacgagcgacggcgcagtacagagtaggaggcaaaccctagattgatttcgcgtatgttgcacgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtgtgtttctcctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacagtttgcaggtgacttgaggtcagccttggtcaatggtgaggaccgagactatgttcagggaggaatagaggtctagtgcggtcgggataccatgtgagaaggtgactagagtcaggattcttggaggtcaacttcggtcaacggtgaggatcgggactaaactcggggaggagttgaggtccagacggtcaaggatgccgggtgacgaagttggatacgagatggcgcatggtggatggacaccgtgtgggagagatcttcgcaaatcgcaacgggcttcacgaggtgtgcgtgcaagcgtcggtgttcgcgaaggaaattgagtgataatatttggaggtatatggtgctacagtacacgaggtactgtagcatgcaggttatatgtatgcatgtatggtgctgtacatgtgcagtttgctgattggttggctttgaggtttgcatgtatgcgttggctgtttggaaggcagcaggcagcatgcagcggctcggctcagccaggaagggagcgagaccaagcaggaaacggcaggcgtgcgcgcgagttggagtctgactcggttggacctggttcggcaggtgcggctgagagtttggatattgtaattgatttagaaattgagcatagagtcctagtgggactagaagttattctcctactttgagtaggaggtttttggtataaatagagagggagcgtgagactttcctgtatcgcttttcagagcgtggagttgatagtttagttagggtttcgagtttagtcaagatttttgtaaggagtgctgttgttgcactatgtaaacatagagagaagcaataaagttgtcatgtactttgagagttcttcgatttgtgtttttttgtttcaggcggcagggaggcgatctaaccggcagcgtgcaagcggtccgactggcggcgacaggactacgtcgagatttccatcgatttgagggtaacttttatttccgctaaaagtttttgggtttttggttttccctaccattcaccccctctggtaggcttggttacttgtgttcgatcctacatcgtcaatttcagagctaaatatagcatttgtgataaaaaatccgagtaaaaaaaactcataaggatttatcaactgcggaataaatactgactgacaagtttaaccaacctaagtaataacttgagcctgtatcagataaattaaacatacaaatgtttttagaaggaacaatagtcttaaaaaaccaatcgtccttatcaaaccctagcagccttgtgaccatatagaaaaagccagcaaaacaacatgacgtttttaactgtcaggcacctttttatacgtatcgtagtagttacaaagaatttactaactgcagaaaaagaatttaaatggtattgggctttacattttgtaggcaattt

SEQ ID NO: 60607 - DNA, 2230 bp, Oryza sativa
tcaatgggctccttccgatgtcactgaggaaactctcaaggagatggtggagcacggagtattaccatccaaggagatcatcgaatagcgtccagcatttggtgaggcctttccaatccccgatactcatgaaatcgtagtcttcacccatttcttctatggtggctttgctcttccaacctctaaattctttaggggtattcttgaattttatggaattaatatctaccatctcaaccccaactccattattcatatcgcaaactttgttcatctttgtgaagccttgctgggcgttcgggctcattgcgccttatttcgccgaatctttttcttgaaaccccagccaaataaaagcaagccttgcattgttggggtatctagctttcaacttcgtggcaccctatgccaaaaatacttcacccttcctttcaaaacctccaacaagggctggcatgctagctagttctatatccaaaacccagatccttccctgcccaaatactcatgcatccctcctaagtatcaagatatctggaactcactccctatgggcgatgaagcttctcaagctcttgaactgctgaaccggctgttgaagttgaaagaacagggtcttcaaggagagcagatcacttggcatttcataaagtgtcgactggctccaattaaagaaagatctctcgcacggccttcgagtatgatggggagaatgaccccaacctagaagaccctgactccctcgaattcaagatcatgaaggagaggatgtataaagtcttttcatccagtattgcggtcagcttttcacatctactgtcagtcgtgccatacaacgccttcaatcctcctccagcggtaaatatctaaatgtttaaatttccatcatgcttgctgcctttggaaataatctttaaatcattatctccaggaaaatgccttgatgaaatctgagccaccaactactgttgacgaccaaatttggtagatcatgcatcaaattcaaagctaagatcgaagcggattttgtggaaggtcgtttctcagaaacatagtatgcatcggctacgggaggcatcgactggcgcctgcatcggctgacgttggatcagacaaataatagccgatgcagccgatcttggtaaggtggttctagaatcatctttgggattgattgatgtgatgcagaagtattgccacgattgggataagcccacagacgggcaattgtatatattaattaagatattttgaatagtttccttagagatatttatcggcaagagtctgcctaaacgacttgttcgtatcttacgtttgtaacatatttggagtcatgtccggcaaggacacattatgtattttgggtataaatatgacccaagaccatgtaaacaataacgatggttctataacactttcggcacatcaccacctttttctattttcattgtttcgacgagttcttgctttcaagttgggctgcatcgggttcgatctccgacaagaggtaaaacttgtcatggcggcttgcgttctcgggattaatgcttacatctctatgaaactctaatcttgtttatgtaaatcatcgagttatcatatgtgcaatataatctttatcaatattgctatctaaccctaaatcgaccaacatctatcattaggaaacaaccgatagggttaaatgtcaacgttgatctagattatatagtatatttaccatctcatagaggtcttcatcaattttcttagatcttatgtttctctttatgcttaatgctgcatcggttgagttcgatctattaagtaatatcctgaactataatatctagcttgttttatgatcatcgataaagatagtatcggggtttcagccgatcttacctgatttagtcatctggttctctatatgtttacttgatttactaaatttgccctttatattaagatcttcttgcattaaaatatattaggttcactgtttgatatattttgtctgttttaatatcttaatatagagtggtatcggagtaatagccgatacatattagatttacttcatcggctatgctataaatatatataatctttatcttaaagtatttttaaacataagtgatttatactgtctcggctcactgtccgatctatctcggtcacttggtttaaggatatttttagaaatagattatatatcattgggacgtgactacacagctagtggtag

SEQ ID NO: 60608 - DNA, 1435 bp, Oryza sativa
ggatcaacttacactagagcaaaaggtagagtatgagcagatgatgaacaacttgcagaatcggtttttacattcatttgtgcaaactcgttcaggtacggttatccaaaggtataaattgaaagtgccatccaatgatgacttagaatcaagcacttccaaagatggcaagcccaaagatgacaaacccaaggatgagaaaccagaagaagaagaacctcaagagttcaggaacctgcaggaccagattgactatgttgttcatcatgcactgatcaaccaatcgggagtgcttgtcaatactctaactaacatgatcaattctgtggttgatggtacatttgctgaacatcaaagctaagggtctaactttttttcctgatggcgtgtttccaccgtatacgaatttagtgaccggcaaacaacagcccgtttctggtgtaattccagagcagccgatggcatcaacttcggctttgggagacagcgcatgtcaacatcagcacagggacaaccagggtttaatcctcatgtactgattagacctcagtctcagcatatggggcaaaacatacctcaagttactctagaacagatcgtgctatgtttaaggggaagccataggttgttgagccgattcagcaaataccggtggggcagcagacacctattgttcagcaacatcaacctgttggtgctcagtttgtctctaatcaacaagttcataatgtgcatcaatctcctcaacattatactggtggcaatatgaactttcagtaccaacctcattcacctcaaatgcataatcggccagggggatcacctcagcctcagatcttgcctcaatataatcagtttgatcaaatttaggtatctcaacagaagccttgggctgatatgattgcaaatgtgatgagggaagaatttggtcttaagcccaaagatattggtaacttatattgacacccatacccagaatattttgagagggttccactaccaaaccgatacaaggttccagacttttcaaaattctcggggcaagataatgtatcaacttatgagcatctcagccaatttttggctcaatgtggtgaggcatcggctactgacgccctgagggttagattgtttcctttatctttatctggatcggcattcacgtggttctcctcattgccttataattctatttcaaagttgggccgatctggaaaagcagtttcataaatacttctatagtgggattcatgagatgaaactttctgatttgacaacaattagacagagacatgatgaatctgttcaagattatattcagaggttcagagatatgaggaataggtgttatagcttggctttgacagattctaagttagccgatcttgctttccagcaattgttaactccgtttaaggaaagatttttggctcaa

SEQ ID NO: 60609 - DNA, 1394 bp, Oryza sativa
ttcctgcagcccgattatcaataaatatcaaaggaagtatgagagataggaagaaaagtattatgaagatgatggtggttttgatcctcattgggactgtgaattttttagattttgttggaatgaagggatgagattgccgtcaagagaagattgccgaggatgcagtgattctaataaaggtttcacggggagctcgagccgatcagaggaagctgcctgttcatcagagattgggtccgattcattaggattgttttcaggatgaaaatgagggcaggaattcacaatgttgtccttctggtattttcgccaagaatcaaaagagaagggtctagaggatgaggaacaaggagcgttttcaggaagtacagcaagagatcaatcatcggttgaaaaaggttggggcaaagcaagagtggcgtgttaagagtaaggtactaacggccgatgaagttgaagctgacaaggcaaagagactagctaaagggaaggctgttgcatcttcatcaataaacatggtttttgtgctacctgcagaatatgaagctaatcaggtcgatgtagatgttatggaagaaacttttactaagttggcgttgtcacctgaacaagctatttttgagaaaccagaggggacagagaatcggcatctcgagccattgtatgttaaggggtttgttaaaggtaggctgatgtccaaaatgatggttgatggtggggctgctgtaaatttaatgccttatgctcatcaaaactaatatggttcttaaagatttcggtggcaatccttcagaaaacaaaggagtgttgaatgtggtgttgacaatcggcagcaaaattgttcctaccacgttttttgtcatcgatgggaagggttcttatagtgtgttgcttggaaggaattggattcatgcgaattgttgtattccttcaaccatgcaccagagtttgattcaatggcaaggtaacaagatagaggttgtaccagccgactggtcagttaacgttgctagtgccgatttaactgtttgggagatggatggaattgattgccagtccggaaaaatttgggaaggaggttatctaaaagtgtccaattgtgatatacatccaattgaagacggagagcctcaattgttgctttgagggagggcgtcgtggagggttcaaatttctacaccaaggatactgtagatgatctcgatggcaaattaggacagggttttatgtcggccgatgatttagaagaagttgatataggtccaggagatagatcaaggccgactttcatcagcaagaatttatcatctgaatttagaaccaagttaataaagcttttgaaagaatacagagattgctttgcttgggaatattttgagatgccaggactt

SEQ ID NO: 60610 - DNA, 3660 bp, Oryza sativa
ttctttgttggtgagatcaatcagttagcgggggaatatgagtgcaagaatgatacattgataatctacaatgagaagttccgagaattgatgaatagttttcgggtggtgactttgaagcatgtctctcgggagcagaacattgaggctaatgatttggttcaaggggcataaggatacaaatagatgatgaaggatattgaggtcgaagttgctacgattatagccgatgattggacgtatgatgtgtttcagtatttaaaagatccttctcaatcggcttcaagaaaattacgatataaagctttgaaatatgccttgttggatgatgaattgtattatcggacgattgatggtgtgttgcttaaatgtttgagtgccgatcagggaaaggttgtaatgggagaagtacatgaaggcatctgtggtactcatcaatcggctcacaagatgaagtggttgcttcggcgagttggatatttttggccgacgatgttgaagatttcttccgacattataaaggttgtcaagattgccagaaattctgagcaatacaaagagcactagcgtcggctaagaatcctataatcaatccatggccgttcagaggttagggaattgatatgatcggccagatcaatccacctttaagcaaatgacataagtttatattggtgggaaccgattatttcacaaaatgggtggaggcagtcccattgaagaaggttgactctgggatgcgattcaatttgttaaagagcatattatataccgatttggtgttcctcagactatcacaaccgattagggatctatctttgtttccattgagtttgtccaatttgcagaaagcatggggattaagttgttaaattcttcaccatattatgcacaggctaatggataggctgaagcatctaacaaaagtttaattaaattgatcaaaaggaagatttctgatttccctccgcaatggcatacgaagttagctgaggcattgtggtcctatcggatggcttgtcatggatcaatccaagtcccaccttacaaacttgtttacgggcatgaagcagttttaccatgggaaagtgtcatcggctcgagaagaatagatttacaagatgaattaacagccgatgattattataatcttatggtagatgaaacagaagacttggttcaatccagattacgtgctttggaaaaagtgacaagggataaggaaagaatcgctcatcattataataagggagagttggtttggaaattgattttgccaataggaactcgtgataataaattcggcaattggtcgccgaattgggaaggaccttttcgaatctataaatttgtttctaagggagcttatatgttgcaagggctcaatggagaagtttttggaagagctctagatggaaagtacttgaaaaaatattatccaagtgtttggatcaattcatgatcggttcggttataccgatgcatgttagccgatgtgttgacatcgccttcagatggccgatataagttatatcgcccttcgaatttttattgttaccataatcggttgtgttatgcggatgtatgatggccgatataagttatatcgcccttagaatttttattgttatcataatcggttatgttgtaccgatgcatgttagccgatgtgttgacatcgcctttagatggccgatataagttatatcacccttagatttttatttttatcataatcggttgtgttatgccgatttatgatggccgatataagtcatatcgtctttagtcaagttataattttatcaatgtttactcagcattgcaaaattaagggggcatacatatatatgaaaatatgcgaattccaaaacaaaatatgtattcagttcaagttcagattacaatcactatgcacagataacttttaaccagatacaagcttgttaatagccgatatagctcgttgcccaatttgttctatgtcctctatggcctgagcgtcggttgcatcggtgtcatggttatggataccacatacctaatagaagttgactaaactcggcaggacccaccacataccacgtcttatacgagaacaaacctcgtggggagagaggacacacccaccacagacgcacaatacacaagccaatatataccaagacaagccgccggatatcaacatcacagattagtctagacataccccatccggctcttacggaggtcggcaagagggatctagcaccatttctgatctcgccgagtacggattcgaggaggaagactaccctgtcgtcgactacgagttggttatctagccaccaagtcgatgagagctagataggttatcaaaaatattgtatttgtgtgattcatatgaataaagagcaataccggcttcgaccaacaggatgttgggctattacctatcagataaggggctcgaacctatataaaaatccttgtctctatctcttttacctcaatctcgcatataccctggtaccgacgatccccataccatccaaataccgtagtcgtgatctcaaacgtcgacagtagcgtgccaggtagggggattttggtgtttcaagatttcgacgagatgggtttaagagacggactctccaacaacaagctactcgatgacttcgaaccagggagatacaacctggccagagtacgtcccccaatgagatcggaatcatcatcgtcaacaaatttgatctatcgagatcaatcaaggtgtcgcaagccttggactcacatgccgacgccgacaagaagctgcggcgcgcactggtgggcggcggagctagcaaggtcattgtggcgctcgtccttgcccttttcaggtcgccgggcagcgtgttctatccacagcaaggcactcttctacgcctattacgtgatcctgctcgccgttgccgtgttcggcgtggcggaggtggctgtcggctgctgggtctctgcttccccgagcgaccggcggcgaggcgtcgggaaggtggtcgtttgggcctctgtcatggcaatcgttgtcgtcgccggacttggatgtttcgccgtgcttaagtaatcaatcgtgcagcaagtaatcaatcgtgtagctgagttgggtgcctgcttgttcttgtcagtttaagctgcagtcgtttgcttaggaccaaacaccttcgggcgtcgccgccgccgtgctcgtgtgctcggtgccgccgctgtgctcgtgtgctcgtgcgccgggtggccgctgcgcttcgtcgtcattggcgatgggtccctagcggtgcgccgccgcttccccggcgtgcgttgctactcacccgcggagggaggaagaagaagaagggagaaagaaaagaaagagaggaggagagatggagagctgacatatgggcctaagggtatttttgacatttcacgcgatttctctctcctcctcaaccggaaatcattattttaatcggcacggtgtctattggcaaattaccacgtttatggagtgttttcccccaaaagtgagtttggacagtgtcccacggctaaaaccacacaataatagtgtcctgtagcaaaatttgcctttgctatttggagcgcatgcgccagaaacggaactggcacgcagcaactggcgcttcccatgggtttttt

SEQ ID NO: 60611 - DNA, 11538 bp, Oryza sativa
cccaaataatgatatcccgtaatctagacaccacgtctaactaccagatactactctaatatcatcatcatgacatagagtaattgcataagcaaacattatacccgcaccaaagcatctctcagataagctagctgtatattcagtataacatgaacataatgtaaagtaggcattcatatactcagaaagtactcctatttaagaaaattattccccaaacgtttgacaaattttgttttcatccttcccaaggggcttcaggaggtctcattgttctttggaacaaccatcttttctctgcaaacctggtttctagtcatccttatgagattactatgcacttttgctccacgttgacaacagatgaaaattggcttctcacaaatatatatatggaccctgctcaggagatttaagaacagaatttgttgactggctatatagtattacttttcaaccagatgaaaaatggattttcatgggagattttaattttatcagatcaacccaaaacaggaacttgccaggtggggatatgaatgatattatggtttttaatgaattgatcagtaacattgaccttcaggaattgcctcttaagggcagaacatatacttggagtaatatgcaatcacaaccacttctgcaacaactagactggttcttcacttccccctcttggacagttctctacccaaatacaatggtcactgctctgagtaaatgcatttctgaccatacaccatacccctctgagaccacagttccaaagacagacattttcagatttgaaaatttctgggtagagctcccaggattcatcgaagtagtgaaacttttctgggatatccctgtcagagcagacagtcaagggaaaatcataaatggaaagtttaaaaatctcagaagaggactcaagatttggagcaagaggctctcaaatttgaatacactgattggtaattcacatgaagcaattgactttttagataacattgaggagcagagacctctctttatccatgaatggaacttcagaaacattgtcaaaaatcacattttgaaacttcttcattacagaaatattttctggaagaaaaggtgcacaatgaggtgggtcaagtttggtgatgaaaacacaaaattcttccatgcttcagcaacccaaagatatagacagaacaaaatctcccatttaactctaaatgatggcaccattattacttcacatcaggaaaaggcccatgcctttctaaacttttacaaaggaagaatgggaacctctgaaggaattcaaatggcgatcaatctgactgagctgattactcctcttgctggcctagaaaacctatcaaacatgccatccaggcaagagcttgaatctattatgaaggcaatgcccattgataaagccccaggtccagatggtttcaatggtatgttcatgaagaagtgctggaatatcattgctgaagatttttacaaattggcaagagagttctttggtttacagtcctcgatccaaaatttaaacaactccttcatctgtctaatcccaaagaaatcttctccagaaactgcaaatgactacaggccaatctctgttcaaaatatgagtatcaaattcttatctaaaatcttggcagaaagactgcaggctgttattcttgatcttcttcatgaaaatcagtatggcttcattaaacagagaacaattcaagattgcctggcatggacttttgaatttctccaccagtgtcatcaaagtaaaaagcaaattgtgattctcaagatagattttgaaaaagcttttgactcagtggagcattcttccattttagcagtgttgaaagcaaagggtttcaatgaaacttggctcaaatggatatcagacctgttaacaacctcatcctctgctgtacttctcaatggaattccaggaaagaatttcaagtgccaaaagggtgtaaaacaaggagatccaatttcacctctcctctttgtcttaactgctgatcttctgcaatcaatgataaacaaggctcatgatacgggtattctttccaaacctattccccgaccggacaccaaattcccaattatccaatatgcagatgataccctgataatcatgaaggcttgtcaaaaagaaatttttagtcttaaaggcattcttcagtcttttgcttcttccacaggcctaagaataaactttcataagtcttgtatgattcctatcaatgttcctgaggaaaagactgaaatccttgctgggactgtggagattatgggtaccccatacccacacggcatggttatccgactagttataggggataacttatatatatgtaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgacacaatatgatcgtcagatctatactatacccggcggattcaaatccccaaacaggagtagggtattacctctcattgagagggcctgaacctgtctaaatccttgtctccacatccatccacttttaggtctcgtgcgctacccccttttattattgccgaattcatgtttcgacagggacctttggatgtaacattggatctttgccattcacctacctgggtctgcctgttggaactacaaggcccaaaatcatagactttgtccctttaattgacagagtagaaagaaggttgcctgctattaccatgtttctaaaccaaggtcaaagactcactatggtaaactcagtcttatcctccctccccacctattacatgtgtaccctcaaaatcccaaagaaggtgatagagcacattgatagagcaagaagacactgtctatggagaaaatcaaatgaagttgatgctaggtctctttctctagaagcatgggataaagtttgcaagcccaagcacaggggtggccttgggataattaatttggaatttcaaaactgtgctcttcttatgaaacacttggataaattctacaacaaaaggggactcccatgggttagactgctatggaatgcatattacaaaaacaaccctcacccacgacatgccatgcaagaaaaaggatccttttggtggagggatgtttttcgtcttattccaatcttcagagggcttagtgcaattcaaattaacacaggagattcaaccctcgtgtggaaggatccttggacagacatcatacctcagtttgccttcccgacgattttctcttttgctgccaatgaagacgtatccattcagaagttcatgcaaaatgatctagaccagaatttcttccttcctctctctgctcaagctctacaatagcttagtgaaatctcaaaccttctgaataatattcacctctctaatcaaagtgatagctggacatacatttggggaccatctttcaagcccaagaaggtttatgatatgttctttgctcatctatcaccttaccctgcaatcacatcaatatggaaaagtaaatgcacgatgaaagtaaaagctttcctttggctgctatttatggatagacttaacacaagagatatgcttcaaagaagacaatttcacattcagaatggaccatcatgtaggatgtgcaactctggagttctggaggatatgcctcacctgttctttttctattcttttgttcaatcttgctggaatttactaggcatcaattgggatgagaacctagagttctgtgatatgattcaatcggcatatatcaacttccatcaacctgttttttagaagttgtgggcactgcttgctggcagatctggacaaaaaggaattctttaattttcaacaacatccagctttcaatccacttgtggaggattggtttcaaagaggatttcactcttcttatgcatagagtgaaggaggaagacaaacaaaaataccaatcatggatagactcaattttctagatcccttgtaaagttttttttctttttttctctcttttgtaaatatctttatatatatatatatatatataatctattatcacagtaggagcctctcctactgtttctcgtcaaaaaaaataccataaatgtatatagaagagtattctaataaaagtacaaaacttacaaaatagaagagaaaagttactgatgctaatgagttgcagagggttgtgctgtggcgtggtgtggcgtggtgtggactgatgctactgtgctgcttcttgcttgctgcacctttttttctcccgatctgagattgggtttgcgtcacccaccgtctcgtcgacatatgtacgtctccgacatcggcatcgactctcttcaacttcatcattctgcctcacgcatcttcggtttgatcacccattcaagcgcccggctacaatgacttctaccgccaatcgtcttcaactatgcgtctacaccatcaagcttcgggttgccgctgcgtcgccccctcgggccacagtgccgctgcctgtggtccacacctcctcaagtttttgcaatgctgagaggcaccctcctcagcatggctacatcaccggtggacttctcgccactgcatcgacatggagctacagctgtgttgtcctcggaccgtagctttgctgctttcgtcgtctttatcgccgtttgcacatcgacaacctcgtcatccgcactagtcatcgtcagccacttgggttcttcttcatctacttcaagcattgccgctctaggccggtgctccagctacctctacatggctgttaccgacgacgccgtccaggccgttggtcccgctactgcgcctttttcttcgtcgaacatgtctcattgccagcgtcgtcatatcttcctcgactacacttcgctcttctccggcaactgcgtgctgcttcggcaattctctatctatgcaattctttcgccgcgactgtcttggaggccttctctactagtctcctccgacattggcgtatgattcatggcggtctccaaccttgcccgcacggtattggcaacaccgttgcgtgcgttcgttccaagttgtccccgggtttggcaaacccgacatgacgtctcatccttcacggttcgactacatcggctcttcaacgttatcttcctcaacgactgtcgcgattgtgtcaccgtctttgtctctagcgcgtcctcgcacaccttggtccacgacgccctcccatgcgtccacaaccactctacggcgccccatgctcgccttgtggcctggctacctcgacatcagcttcccgacttcggctacatcgaccacggctactctacacacggcttcatcaaccacggctccctcgcaccctttgctttagcaacatcgactacggcacgaaaggctatcatcgtgttgagtactcttgttggttttttctctagtccaagtgtccgcgctgctcacgtttggactgcgggggatgttagagtatatggtagttagagttttattaggataggattgatttgtgtggagtctttccatatctgtaatccttccttatctacttcccatgtactcctatatatatcggtcctctgagactcaatacaacgtgtccaatattcacattatctcctctccctatactatccaacatgatcgctgatctctgccttctccagtggttactgccttactggttggcgattcggaactcagcgtccacgaccaccagaccacgactcgatgtctagtgtgctcagtcgcaggctcggtaggacggacacactgtcgatgacaatcgacgaggagatagagacaagatcagcagtcgatgatcgctgtcgaggcatgggcggccgggcagtgggcgtcggggcgacggcgcctcggtggttcagcgctccactcgttcgccattcatggtctgccaatctcgtggcctcgcgggtggagtcaaggggtcaggccatcaagctgtcgggtgaggcgatcgttgtgcagcggcggtgcggcgtagggctcctcgatcggctcctcgcggcggtgcgcgtagcggcatgttggcaaggcgtggcgctagggctgactagactggctgcgaatggcgtgattgcgggcggttgaagcgaaaaatgaggagttgatcgcgacgtgaggagaggtgcacatgtccgcgcgacgcttcggtttccactttccatgccgcgatcaccatttgtttttttctgatatatggtagggtcggttgccattttttcggtggttcaatgaccacgtggaccaccctataaatccgcctaattgacacccaccgccggcacgctctggcttgcagctggcctatcgacgacgtcattatctgctgactgaggttaggatctttgctcgaatactggtattacgaaactaatatttagggattgaattgtatgcattgaaataggctcaaaggagcatataaagtgtacaagcagacaaaaaaaaaattaaaatacccttgctaacaatcagcgtgaggaagctgttcatgatgagctccttccactagtacacaaacgatttttccgtgacaaaatgcatttttccataccgaggtcccgcccgtctacccaggtgtctacaaaaatccatattttcacgtgcgggcggcctaatcgcacgagataatccatcttcccgtgtgttgacggtcattaccatattcatgttagaacaataatattccactagtattaggtttgctaaccttttgcatagaataaccataaagtggaggagaaccgacatcaaatcagatgataaataaatcggatggtgtcgagaatcagacttatgcatgaatgggccaagaactcagaaatgacatgacgaattaggccaaaattcacaagtctgcggagaagagcatgagatgaggccaccagccgaaatttgggctggttgggccggccctaggttcggccaaaccatcctcagcgttgtttgatccaggtctttgcctggacggtgtagatcagcccccaatgacggttggagggtatttccaaccattccaaccatcacaaccatcattgggaggcaataaaaggagctctcatcctcacttcattcacacacttcaagcaaaactctctcatattctctcaagtttagtttagtgttcttaagctagtggagtatgaatagaatagaaatcggagtccggaagcattcagaagagttcaggtatagctctagtagctcttatttcctcttttgcaagcttcgtactttatttagaatactcttctttatacatttctgttattgaaatactttccgagtatatgaatgccaactttactttatgttcatgttatactgattatactgctatcttatctgggagatgcataggtacatatataatgtttgcttatgcaattactctatgtcatgacgatgatattagagtagtatttggtagtttaggtgtggtgtctagattatgggatatcattatttaaggttatatgctgcggatgagaggtgggccgctgatggtgtcagctcagtacgtgtatatagtcctaagttaatttcctggggagtgtactcctccgtatttatccccgattgtatggttatgacaggatgttgtaaggaactcggcagtcaggggtgacttctcgaagtaccaggagggcatcagatagagggtattagctagttaatcatataactagaatgtatgtatactatgtataccagaagtatagcaatagattctctttctttttttctttccacttagcttagatattttagtatgagaatgagtagctccatgcttgtgtgtcactctaccctttgatttatcttaaccctgcttagactatgattattacaagtaacatataaattgttagtacggttctctctactatgatctttccacggtattaaataaatacaatacccttggaatactctcgggtgaaatgctacaatggtatatccgtgcgcttgcggatgaactctataaccataatataccgggagtatttctgcgccattgttgggaattatatttctagtaatgtcattaagaaataccaacatcgtacggtcgggttgagtggaccgcacaggataatcgattatcacgtgcagtcaaattatactgcccacacgcaaaaaaaaaaagaaaaacccaaaaaaataaaataaaaaaatcccaaaccctaaccctaaccctagaatcgcccaccgacgtctctcgtggtcgccatcgtcctcatcgtcgcgctgctgccgctcccagccaccaccgctgctcccgagcccgctgctcctaaccccgtctccgccgtgaccggttgtcgttgccgctctcgggtgccttctcctcctcgtcatcgacgcggcgcggatctggctggtcgcccgccgcaccgcctctcggtcgctagccgccgcgctgcctacgacaacagctgctgcgctgcctcccgcccatcgcctcctcggcggcagcggcggcaagccgggcgcctcccgcgccccgtgcgctcggtggggaggcgaggagaggaaagggagagagagaggactgattgagggagaataaaatggaaaaggaagagaaagggtgaaaggtttgaagtgaatgagagggaaaagatgcagaggtattttcacgtgcggtccacttaagacacccgcacgcgaaaatcaatttttgcgtgcgggcctcttaagggtccgcatgtgaaaataggcttatttttacatgcggaccgtttaggggcccgcctacgaaagtcgatttttgcgtgcgggtctcttaagggtccgcacacgaaaatgggagaccgattttcacagacgcacgcgaaaacggtctgtctggaaaaataggagctcctcgactaggaaagtcttttgtgtactagtgttccaatccctatggttgcggagctgatttgcaggtggacgctcatgccggagttgagggctatgatcttcatcacttaatcacgttgccatggatggtgtcatacaaccggctcacgctgaggttctcctggagagatttgctccagtccaacaaaaagtacctcgagataccgatacctcacggtaccaaatcattttcgattgttggatctaacaaagctcatcctgtccagctagatctaacgattgaaaatgttttggtactgtgaggtaccagtacctccatgtatttttttttttgaccagagcaaacctctctcctagaacaccacagcgaggaagaggaagtggggtggggcctcccagcgagagagctattaaagggcgttcgcggcatgggcgatctatcgtgactgcttgtcgtgccccttgtaaatcaatacatggattcaactgtttgtaccttaaggatgatagaaatgctcctcccataaagctccgtaccaatggatatgaacaaatcaactaccaatgttctttcacctactaattttgtttttcttccttgagaacgacatgttctttcgtacgtcattgtttgtatgcacacacatcgcttgctttcatctaagcttggtgctaacgaaagttatttgtaggtgcaccttccaatggggatctctcaacacactccgatagtagcaaccactcgtacaaacaaagcaactaaaccacctgacccctgaccaaaagagatcgacacccacagcgatcgatcgatcgatattattacatatccctcaactactcactggccgtagccctttgttgcagctcggtgcatgtgtttgcacaatgagctacctcctctcctacatctccaagatgctgtgcatcaagattccgtcggaggcgaggcaagccagcgaggacggcggcagcggtggcctgacggagtgctccgtctgtctctccaggatccgtgtcggcgaggcgacgaggcgtctgccctgccggcatgcgttccaccgggactgcgtcgaccggtggctcctctcatgcaggcggacgtgcccgctttgccgggtttacgtcgtcgtcgacggtaacaagccaggggtggcagcgaagcacaccggcgagccgccgctcgctgaagacatggtgatctggttctctgccatgctcgtccctggattctgacatgtatatctctgatgtctaagcgcaatgctttttatttgtttgtttcctgcctggaaaccggtttgttttttttttcttatattatgcaaattaacatgacgatttcacgcttgtagcgtttgtatgtacgcttacgctcacatcgtcagcattttttttcttttgcaagttttctattgggcgttgattacctattcaagagaactgaaaaaaaaataagtaggtatatataataaaaacggtttctttagatttcctttaacagtttttttcttttaatctgtcgaattttattttataccgtgcgatatacacacagatgatactagtctggtttatcagttcagcatttctttctggtttgcttggttgaaccatcatcactgttgagttgtctgtccatgtggagataaaacaaggggaaagtgagacaagggaaggaagctcgaagatgctagagaaggtcgtacaaatctgaacaggaggtgtttcttgccacgtcgtgagtcctcacccaacacgctgccatccactcaccgtcactaccagactttagcagctacctgtaggcatgaaacccacagaggaaaataggttttaccgtcagaaatttttaacctgtgaatggactgatatgaatcgccgacagaaaaatgaccacagagaaattccattttcctgtaggtttcatattataaatcgtttgatttttttattattataagacatttgactttttttatcaaactcctttaaatttgatcaagtttatagaaaaatatactaacatttttaatactaaacaaacatattatcaaaatatattcaatacaaaatttaatgaaactaatttggtaatgtaaatgttgttatttttttctaaaaatttgatcaaacctaaagaactttgactaagaaataagtccaataactaataatataaaacaaatagagtagttgtcaacgttctttgcatctatatttgttctttagttcaggtgttgttccctctgttcccaaccacaaccgctagtctagtgagatgttagagcatctccaacagcatctctaaattcgattctccaaatacccatacagctaactctccatctgatttgggtaatcaatctaggtgttgactccaacaggctctctatttacatctccaaaatgacaaaaggacccacatgtcagcctctattgctttcttcttcctcttctttctcttcctctttctcttctcccttctcatcgacccatccccgtgcgaggtggacggcgacagcggcagcggatcctcc

SEQ ID NO: 60612 - DNA, 3889 bp, Oryza sativa
atccccgcgcgcgcgaggcggacggcggaggcggcggcggcggcggctcctctcgtgcgcgagacggacggcgacggcggcggcggatccccacgcgcgcgaggcggacggctgaggcggcggcggcggctcctctcgcgcgtgaggcggacggcgacagcggcggaggcttctcgcgcgcgcgaggcggatggcgatggcggcggcggatccccgcgcgcgcgaggcggatggcgattcccatgcgcgaggcggacggcggaggcggtagcggcggaggagacgaagatggtggcgttgagtggcgacctcggcagcgtcgacgacggcgtcggtaacggacgacgacgaggcgtcctcggcagcagagggcaaccggtggcggtttcgacagcagacaacggggcgccggcaacggacgacgacgcggcggcctttgcagcgaacggaggtgggcctgataggggacgacaacggtggagggggcggcgctggcggagaggtgccggcgcgttgggcagtggagaagcggaggaggaatcgcggcagagagagagtgcgggatgggatgggagggggaaaaggcgtgggacccacgtttggctaggctattttggccggccaaagttggccggcgcgagtagtattttggccagccagccggctggccaggctgttggagcacgattttgatctaaaattgctaaaattttgcttggagagtgaagtaagggggctgttggagatgctcttattgtcttttcctttccaattgactctcatcagttctattctcccttttatttactagatgccctttgatgggtataattcggttgtgtgtgtgtcaagtttatctacttattctgttctatctattttgagcaactttagtttaccttgtggaaatttctatgcagtataaagaattaaagaaaggacacataaaatgtgagcttgagagagtatgaagttacctcccagaaaaatatacagtgcaaaatttccatatgttaagttcgtggtatagaaaatatggaagcattctcacctcatataaagggcgccgcatatatgtatttatatcagttggaaattgtgaaagacacctggactttacattatatttgctaatcgaactgaacatatcaaatcaatttgcaagcataatataaattctgaagcctcgagtaaagaacataagagacattgctgggactttaccatgtcagtcaactttagcctgagatatgtccgtcaaaccatacgaaggcggtgaccagatgtgttgcacatttaggagacttgacaaaaatggctaaaactctatgacattccaaatgttctaaacccatactcatgtgaagctagttctcaagatgcgcactagctccacactttcatcttaagcaataatacacaaagcaaataaacctaagacaaataaaattcagattacatcaactttaaatacacataggccgacaggccaaataatctgagattcgcggaagcttagctacccagaccacaagcaaaccgactagggataaactcctaattgaatcaagtcctagaagaaacagtcgaagccggcaccattcaaatttatctaagcatttaacctgcaaagatggatattccagtataacaagagttagtacattattaaaaataatgtattggcaggccaatatcaatcctaacatgctacatgtaaggcatatattcaaaggagggaaatatgtagttcaattttagcataaagcaagttttgattcacaattcttttgtaaaaagttgatgattcaattaacaaaacaaatttgtaaatttatcatatatataacatcatatcatcttaagcatacccttgttgccttccttggcaacaagtcatataatcatcatcacactcatacaactcaacacaaatcatccatttcaaattgcggtttcataaacataatttaaaacaatgagtctatactcatgtgaccgtgagcacgactaatcgattagtttttgaactctgcacagtttgtacagctttacccacatgatgtgaatcactctggtttgtccggtacctgtcagtactaccacactctacatattgaatgtggtctagaggttacaacgtagcctttaaattacctaatgcctagccttgcatcatcgatggcaagtgtggctccatcctaggcatatgacctagaatcattaggtggcaggcccacgccttcaaccaaactccgtggcaacgaacatatccgttcccccacgaggcactatactgttgaattggatagactgagacgcccatgccgtgaggaaggacaaatccgtccactcacgtaacacacacgtagggaatcatcctacaatcaaacagacacacatgagtagttcctatgaatcatcgctaagactaattcattctatttcggccttcatatgcaagactagacattaaataacttaattagccaagggcataccataattagcacatgtagatatacggttaactttaagttggtgacacaagttcagtcgttgggcaaacactcccccctatcagtgtgcaactaccaccatatgcacaccacttgccgcccaagtctaaaacctcattttcacacctttagttcacaaataagtaaatatttccaaatctgtccagcagtgaaattatgcccaaaatttcacttaaaaagttttcataatgtgatttggcatattctaagcatggctaagcatatagtagcatattaagcatttatagtcccaaatgagcacaagtgatgtactctaaccattcctaagtatacaaatggagaggtgtacaataattcaaaggagtttatgcaacaagttatggataactaccatttcccaagttttcaaatattggtttaagaaaatataaatgcaattttgcaaacaacacttttcatctcccaaaacatgggtttcaatgtgatcaaagagaaggggaggaagaacttgccttaatcttgagaaactagatagcatttaattcactccttcaccgaaaaaaacaataatctatacaaataacaccgtatgcaaataaataccgaaatctgctaaaaatacaaaatgctctaaaatgcgtgagtttgctaccatgaataggtgctgtgtggataggatttgtggtgaaagaatttctagtttatctattcacatttgtgagttattaattttcaaaatgtaatattaacaattgggtaattaaactctattagtacttaggtgcatcttaggtccatgatttgtgatgcgttcagttgctgcagtgaagtataggttctcaggagtacaacaaaattggtttcacaatatttaggattaacatgatttttcctttgaattttataagtaggatatcacattataggtttcggtagctatactgattcttagacatgtctgggtactgtaagggccatattttattgtataacaattaagctcatgatttttccaatctaacaaatctagaaccacctcatttggagttggaataaattttatatgattttttagaagtttttatactattcttttgcattaatcctttattcaaattttaatgatgttttggttatggtttcatctagagattagtctacagatctaaagtgcatacttttgtgaaactaactaattttagttttgcccattttgagttaaaatgaattacttatggattttgtagtttctaatttgcattatactagttattttactaaataaacatttggtgatgtttttattacaggatgttgcaagttttagttcatgataattaagaatatggttttgtgagcacactggaactttattcactcaaaataag

SEQ ID NO: 60613 - DNA, 6731 bp, Oryza sativa
atatgtattttacaaatttacactgttttcagttaaacagaaaagtctttaaagtgttttctttatatttcccagattttatgtacatggggtccacaggtcataggcttggggaggagaatagcagcagcagaagcagagctcaccggccggcgggcttgacggcaatgccgatggcgaacgacgactcttcggctgacatatacaaaagagaaaatgtggaagacattcttgcgaactcgtcggtggtggtgtcttggccggaggtggccagaatcgaagccgacggcagcgcgagcagcagcggctttgaggctgcatgtggaagacaagtcacgggcttggttcggttgatttgatgcgtgcatgagctttctttggtcactagggagactcaccgcaggattgtgttaggactcagtttctcaagaacaatggaggatggattgatggaattagggattcggaaacacggaatgtttagagtctctcgatcctacaggaccgaaccgccgccgccaacgccgccgccgagttttccgttcatgcctcctcctctgttcttcttagtatttaacaacacgcaactccagctggcacagcacagcttacgcacgctactcacgcttacaaggcctcacttggcccacatcggtccagcaattctagtattggccttcttgttgcgcagcccacgacccagctttggctttgtcctgtcgccgtcctgtagctcgtccgggacgcttgctgtttcatcgtcaggttgctcctcctctgcttcagcccgacttgcagacctgacaatcccccactcttggtggctggcttgcccccaagccagcgcgccaggaaagcgagcacgcagttcctccatgtcctcccaggtagcttcctctgcaggtgaatctgaccaatgagtaagtaactgaacgacagttttgttaccttttttagtgagacgcttgtccaagaactggagtggaatttgtagttcccctaaagagcttggtaattgagacataaccggtttagagaacccggcagccgctcgcaattgtgacacatggaagaccggatgaatagcactataagagggcaactgcaaacgataagctacagcccccactctgtccagaacttgaaatgggccgaaatatcgaaattctagcttatgattagctctcttagtcacagaagtttgaatgtatggctgtaacttgagataaacccaatctcccacattgaattccttgaaactcctcttcttgtcagcttgagacttcatttgctgctgagctcggttaaggtgttgctgcaagagttgctgcatgaactgtcgctcttgcaaccaaatttttagatcagcaatttgacaatcatcagagctaatgccaaaatgtgctggagtgtagccatataagacctcaaagagagttttacccagagttgagtgatatgaactattgtaccaaaattcagcaagatataaccaggtggcccatttagtaggagtagcatggacaaagcatctcaaatagatctccaaacactgattgacacgctcagtctggccatcagtttggggatggtaagcagagctcatgtgcaatttcgtacctgatctagagaatagttgatcccaaaactggttagtgaatattttatcccgatcagagataataaccttgggtaacccatgcagcttgtagatgtgtttcatgaactcagtagcaactccattagcagtaaaaggatgagttaaagggatgaagtgactgtacttggaaaacttatcaacgaccactaaaatgcagttatagtgcccagatcttggcaggccctcaataaaatccagggacagagtttgccatgcaccttcaggaactggcaatggttgcaagagaccgggatacttggatctatcgggcttagcctgcaagcaaatctggcaatgttgtaacttgttcttaatcatctttttcattcctgcccaagcaaacatagttttggctcgtcggtatgtaacaggaaatccagagtgaccaccaatgggagaagcatgaagttcattaattaatttatcctggagcactggattgttgccaacctagattcttcccttgaatttaagaattcccttgcataactgaaaatcaggcctgctattaggattaacagctaattcagcaatgacttgggtggaaaaagcatcctattcatatcctgagagaatatcttgcacccacaatggaatacattcagatattgctgctaactcggctgaatcaggtagttccttgcgagatagagcatcagcagctgcatttgataatccctttcgataacaaattctatattgaaggcccaacagcttagtgaaagctttttgttgccaaggggtatgcaaccattgttcagacaaatgcattaggctgtggtggtttgtcagaataacaaattccccttgttggatgtatggcctccaattttccatagctagcagaatggctaagtattccttttcataagtggagagtcccttggtttttggacccaaagctttgctaagaaaagcaatgggatgcttgtcttgagatagaactgccccaattccctgatcactagcatctgtctcaatagtaaaaggtttggagaagtcaggaagtgccagcactggggcagcaaccaaagcatgtttaagttgttggaaggctgacttagtttctgcagtccacttgaatggaactccttttctcaaaagcatagtgaggggtttgctgataacaccaaaatttttaacgaacctcctgtaataaccagctaagcctaggaatcccctcaatttttttaaggtagttggttgaggccaattcagcacatcctgaattttggaagggtcagtagaaactcccagtaccccaatgatatgacccaagtaagatagttcttgttgtgcaaaagagcacttgctcaatttaacttgccatttattgtcagccaacaattgcaatacaatctttaggtgttgcagatgagattctttatcaggactgtagatcagaatgtcatcaaaaaagaccaaaacaaacttcctcaacacaggagacatggtatcattcattgcccccagaaaagttgcaggagctccggtgagaccaaaggacatcactttgaattcatagtggccagagtgtgtctgaaaagctgttttgtgttcatccccttcagccattcttatctagtgatagctagctctgaggtcaagtttggaaaaccatcgggatccagccaactcatctaacagctcctcaataactggaataggatatttacttttaacagtgatagaatttagctgcctgtaatcaatgcacaatcgccatgttccatccttctttttaactagaagagttggggaagagaaggagctttggctgggttgtatgacccctgacctgagcatttcagaaacctgacgttcaatttcatccttcagtgcaggtttatacctatagggtcgaagattaacaggttttgcaccttccactaatggtatatggtggtcacacatcctcttgggaggtaatccagtgggttctgagaacacatgagcaaattcctgtaacaagggttgcaccatgtctggaacttctttttaattatgtagttcaacagcctgaagctgaaccaagcacataacaaaacccttcttagtcataccctgcagctgttccccagaaatggtagcacactgagatgtctgtggagtaataccttgcaacttgaccactttacccagatgagaaaactccaaccacttgtgattccattcaatttgcatggggctgaactgctgcagccagtccattcccaatatagcatcatagctgcccaggggaagtaatctgaagtcactagaaaaattatgaccctgaatccaccaatcacactttggaatcacctgagaacatgatagctgccctccatcagcaatttgaaccttcaatggttggggcaggtgttttaagccaataaaggtagagccaattctttcatccacaaaagaatgagtgctgcctgagtctactaacatgagcaactcagttccttgtacccatccccttagtctaattgaagtagaagaatcaatcccatttaaggactgataagaaatagacattaatgcatcatctgcagtttctggtatgtcaccagaaaacttttcttcttcagtattgaactgtaatgcattgagtaattcctccaccacatgaagctgaatagatgctgcacatttgtgatccttgccccacctttccccactcttaaaacacagtcccttagaccttctataagacttaagagctaataacttgtcttctctagttcttacagatttagctcccaccttgtcttcactggttgttcttgttgggaggactggagtaggggtgggtctgcttttcacatatactccagaatcttgtctcctaactccagattgaactaccccttctagagcctcttcctgcaaaagagctaaagaacaagctgtgtccaagtcttgtggcctcagcatcataacagcaagcctgatattgtccttcagaccatccacaaatttagtgacaaaataaatgggttcattggctccacgataggccagcaactgatgcataatgctatcaaacctctcaacataatcacttattgtggagctctgaaaatacgaatccactgacgtatgagtgtctgttgcctatctctagaaaatcttgcacagactctttcacacaattcaaaccaagtggcccctgccaactgagatctaactgattgtaaccaaaaagctgcattcccacagaaattcagtgtagccactttaacccaattccgggggtgaataccatacacatcaaaatagatttcacaatttgctttccacatctgtgggttgtctccattgaactgtggaaatgtcatcgggggaatactatacactagagcagaggactggccatggctactagactggaacgcagaatcatcatgcgggaaaggaataggagagatcagggttgaatcgcgcataccatggtggagaggggttgattggaagttgcgcgaatcctgaggttcctccttgtgggcttcaggatacacagctgtggtcaccttccccgcgaattcatcatccttgcgttgcaacgcaatactgccctccaactgttcgaccttggcgctcagagtcttgcacacggtgttgagggtctccaccttcttttccaccgctggtaggcgcacatccagcgacagcttgagctcggcgaagtccgcacgcgtgcgagcctccgcttcctcccgcttcttctcgttctccgccatcgtcttcaggagtaaatccagtttcccatcttgcgccatgacttcctccacaccttggtacccccttactttgcttccgaatccagtcaacctgaggaaggcaagttgccttttcgtgggatcagttccgaagaacagccccaatccttcccctggattttgcgaccgactcaaggaagcagagcaagtttggctctgataccaaactgttaggactcagtttctcaagaacaatggaggaggatggattgatggaattaggggttcggaaacacagaatgtttagagtctctcgatcctacaggaccgaaccgccgccgccaacgctgccgccgtgttttccgttcatgcctcctcctctgttcttcttagtatttaacaacacgcaactccagctggcacagcacagcttacgcacgcaactcacgcttacaaggcctcacttggcccacaccggtccagcaattctagtattggccttcttgttgcgcagcccacgacccagctttggctttgtcctgtcgccgtcctatagctcgtccgggacgcttgctgtttcatcgtcaggttgctcctcctctgcttcatcccggcttgcagacctgatagattggttggagttggcgtcatccaaacagctgcggcgatggaggagatggcttggcggcagaggaaaaagcagggtgacagcggcggctcgctccagtctatcaactctgagatgaaatcatacttgaggctactgaggtcctagagatgattcctgcacggggaatcagatggtggcactggaaaaagagaaatttggcgatggtgcttggtagccggagttgaggaagaagacgccaatctcccttctctctgtggcattggctggggttcttgagggctttcgaagagaaggtcgaggcgacgcggatggcgcggtggctcggcttgaggcgcaccggatcatcgggaacggcgaagcgacgagcggcggcactctggacaccgagagcggcgatgagcgcaacacagttgtgttcgacccatgcaaattaagaaccaaggaaatgaaagagttaggcatggcgcgcagatcacgttcccatgaatagaatgtcccgaagctctctggagaagattttccacgtacggatcaaacaccttcagctgagaaggagtgagcgtacttggctagacagagaagttcttggtctatctcttagtggaacatgatgagagatgagagaagaatagagtggtggagtggctgctcacatggtgaagagtgtgctggcaggggcatgctaggtgtccttctatggcatagacacgattttggagagagggcaaggttt

SEQ ID NO: 60614 - DNA, 11060 bp, Oryza sativa
  unsure (1)..(11060): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagtgtgccgcaacaactagccatcctcgagccatacattgagggacacatgaacgagataagagcatgcaaccctagaagaccggcgacttggatctcaaaggaacagaagcgcaaatttcctgaatgcctgaaggaaaaaacatgtcgttcggtgaatcgcttgcacaggttggcaactggcccaagtagcctcatgaactcatggcaatggtacgacatcggcggatatacattttacacgataggcaagaacaagaaaagtgcagctcataatagtggagttcgtgtggaggcgttggacgcaataggcgagaagaagtcatactatggataatacaagacatttgggagcttgactatggcattaacatccaggtcccggtgctatgatgccagtgagtcaaagacacaacaggcgtatccatcgattactacggccttacggttgtggaatgtagtaaactaagccacaaggatgatccatgcgttctcgctgaatatgttggacaggttttctatgtgaaggacccatccaacgagcggatggacattactgtagtgggaaagcaacacattattggcatcgataacactaaagacgtgtcagattacaaccaatatgacgacgtcccattattcacagatattcctaaccagatcaagcgaattgagacaacccttgacgaagagaagttttcgtctgtgcggaaggatggtgctgcgaaaattgtgaaacattagtgtgtatatatatctatatatatatatatatatatatatatatatatatatatatatatatatatatatatatatgttgttgtgtacaacctgttttgaaaacgattaatgtatccaacttatagcctcttcaaacgattaatgtataaaacttatggttccatgtttatctgtactatatgtcgttctcaagttatatggttgaataattaagatgtggtttgatcaatatacaagcgatttaattagatgcgattgaaattcatttgtggttaaataattatatttctatggttgaataatttgttggcattaatcatatggatgaataattatattgattaattaattaagttgtggtttattaactataaccctttttagttatagttaaagaattatagttaaataatttatgggtttaattaactataactatatttaatttgtggttgaataattatattgattaattaactatatttagataggatttattaatttatctgcatttatttttgcgtccgggtggcttaagccgcccgcatgaaataatatcatcccgtgcgggcaacttaaaccgcccgcatgggaatatcgattacccgcaggtgataatatggttacataagcacggggcgggtgggcgaaattaccaccgacgctgcccagttgtttgccgccaccgccgccgcctcctcgctgagcccgaaacgccgccggtggcctcctcgcctcaccagcctccacctctgctgtcggctcctctcctcctcgcccttcatgctggcgacgtcctctccggccaccacctctgcctcctcctctactcctctcctcctctcgccatcaagatctgggccgctgccgcctcctctcctcctcgcgctcacgccggcctccccgacctccgccgcggccgtcgtcctcctgaaacaaccggcctccccaacctttgccgccgccgacctcctccccaagccgctggccttaccgacctctgccgccggccacctccttcccaagctgccggcttccccaaaatccgccgccagccacctccaccccaagccgctagcggtaagcgtgttttaggttttttgtgaaaatttgtgatatgtgcaatttgtgatatgtgaaatttgggacttagggtgatatttgtgaaatttgtgaaatgacaatttgtcaattttgtgcgatgtcaatttttattaaaaaatgtagatgcattttttttatatgtcaattttgtgatttttgggacttaggatatgtggtatatatgtaattttttttgataattattcatttatatatggatttagttcctaggttattaaatcatcacagaatatgaggtgctctaggtgccatgttggtttcgtcgagttagtgcattgacggagccaaccaagacaccttgggacgccgaggatcatattatgtcttttataggaaatatatatgtttacggttttttaggggtttagtgcaagtatgaaattgggctcgaataatttatatgtaactttacaattctaaaacacacacacaaaaaaaaggttaaagtgcgtagatatttccaaacggctagcatgattaattgagttacaattattacaaagatagaaatagatttatctaatatttttaaacaacttctatataaaaaaatttcacattaagtattttaaaattttgttaacataaatcggggtaaaaccaaagagtggggcagcggtcgttacatgggcttcaacgactagtacaatgcagaactattagttgctacttccttactagctagacctcacttcaccatgtttgttctgacaataggtataggtgcaactgtacaagctagtgcaataagcatggtccgcatgcctgcatgtccctgcattatatccatctacataatccaaggaagcaaatttgtataggtgataatatatatgcacgagatatgcatacacatattatattatcatcgatcagagagctagcacttagatatttttatactggaatttaattagtctattctttacatcactcagctgatagtacatatccgatcacaatcacatgcggcgagatcactctacgtaccattcgaatattgacctatcacgtgccgaccgactgataaactaatgaaccgaattgtatgcttagtacaccattagtcgatcaccccacaaaattagtctatcatccatctaataaatacctataaaaatgaaaaatccttggctcaaatttattatccatacacaacaataaactagcataccttcaattgaatgcatataaattaatttatgcatatattcatgcattcgtttttcaacttaaaatttttaataacacctatatatctgaaaaattctaagagctagaagcacattacatacaagaaccaatacaagcctaaaatcccacattgggaggcctaaaatttggggaaaaaaaaagaagtttttagggttactctccaatctctaaatttgaccaattaaatcgaaaaaaaagaggaatggtgtagtatatactgctcttcaacttccatgagaggatttgaggaggagaggtataggtgctacttccttactagctagatcacctcacttcaccatgcttgttctgacaataggtataggtgcaactgtacaagctagtgcaataagcatggtccgaatgcctgaatgtttctgcattatatccatccaaggaagcaaatttgtataggttataatatttatgcacgagatatgcatacacagattatattatcatctatcagagagctagcacttagatatttttataatataatttaattagtctattctttacatcactcagctgatagtacttatccgatcacaatcacatgcagcgagatcactctacgtaccattcgatcattgacctatcacgtgccgaccgactctgataaactgacgaacctaattgtatggtttgtacaccattagtgtatcatcccacaaaattagtctatcatccatataataaatacctatgaaaatgaaatatccatggctcaaatctattatcaatacacacgaataaactaacacataccttcaattgaatgcctataaattaatttatgcatatattcatgcattcatttttcaacttaaaattttgaataacacctatatatctgaaaaattctaagagcttgaagcaagttacatacaagaaccaatacaagcctaaaatcccacattgggaggcctcaaatttggggggaaaacgaagtttttagggttactctctgatctctaaatatttgaccaattaaaccgaaaaaaaagaggaatggtgtagtatatgctgctcttcaacttccatgagaaattccgagaaaaataggtccaaatcgactggaattgaggaggagaggagagggaggggagaactgctcctattcgggcacggactggggggaaggagggagggcgcgcgtgactaagtcctattcggatagtggtaatgatgctggtgctgcaagagaggaagggcgccaatgaggttgatgccaaaaagggtctattccagcaattagtttatggaggggtctacttaattatcctctacctcaactctggtcatcactgaccagctcatgagctacactgtattctggcttctcaagtccttgccagtaattttcgcatgtggtcctctttagaccttgccagtaatttaacatttttttgcaggcgaggacttaagacgttcgccagtaaatataggagcggcttaaaaaaattggatcacaaccaacgagcgcaccttgcccctcccacaccctaactgctcgacctctcagcccctcacccgtctcagctctctccctcaccttttccacttccctttccaccacagcccctccactctcttcctagtctggccgaaggggcggaagctggcggcggctgcacttcctttccctccctgtccttgatctagttggagggaaggagggtgtcagtggcatcgactagatgcagctaattaggtgtaacctcaactatgtgattagatgaacaaactaaacatatagtcaaagagcaaataaatcaaccagccgagtggttttattaaaaaaaattaaagcatatgtgatgtcaaatctgacttaacaatactcatagtcactcatacaaaatatcaaataggtgttgccactataggtaacggaagtgattaaaccggtacctatagtgcttttcccaccttcataaaatgaaaaaaaaaaaactaacacctttaaacgaagataggtgtcagttttacagaaaaactggcacctatattttaggtgtcggttcacctataattaattataagtgccggtttttaaaaaaactgaaaccgataaaatcgagccgaaccagctaggggagatatttttcctccagatggggcccacacccacactggcaggagataaggccgagcccttctctcggcttctcctctctctctctgcggcagcggtgggagaggtagcgacgcttctcctctctctctctctgcggtagctgcaggagaggtagcgacgccctcccgtcaactagatcggggggaggggaggtgcagcggcggcggacgacatggaggcggcggcccggaccccccctccccccgccagatcgagcgagagaagaggtgtagcggtggtggcgggttggacctcgcctccgccagatccggtggcgtggaggcagcaagttcacactaacttcactcagaccatcacacaatagcatcatatacgaatagaaatcatctagaagtcatatccataaagcactgtagaaatcccatgaaaacaatccgaaactgactccaacctggagtctgctaatctgaccgttgggcaacccggttagaccggtccaacaccactggtctgaccggcagtccccgcctggtctgaccagccaccaagagccgactaccgaaaacactattcaccgtattttcacaaagcactcacctttgacaattgttcatcaccacgattaaatcatcacatgattctacacatatctagagagaggaggcaagagaaggcaataatatatgttggtaaggacatagctacagtgacagaaagtgatgatgaactccatcggtatcgttagatttgtgctgatgtatatgtttcttttttcacaacagcttagtgccgttttcttttgatatgtcctccacgtgtgttgttgctgtcaagtggccatcgacttaaatttgctagtgtgtgaaataatcactgctagtatacaacattaactggcagcagtactattatcgattggatacatgcgattctaaaatttgggtgttgtaaacagctatacccataggttagcctaatgtgtagtagcgacattttttttagtaaaatttttaacagccacctagctaccaggccagtactactagctatagatgctagtaaggcagaagatgccatgtgattaagcttctatttctcatcacgttcaccacatgggcagcaaaagttttgcatgaaatgggatcagttgcagtctacagaacacagtacacactcggtcttctatatttcgctggacgatagcagttaagcatgtaccaagccatccatatacatgtgtcatgcaataaagtagcttggtctctaaacaaacaaatacagagaacatatcatcaatataactattgtgaattaaaataacataatcatctctatcatgcaggtgcagcttgggcatgatgttggcttcaactataaatagacgcgtcgcactctccaatcagatgcacaaccacaagaccaaggaagcagtagcctttcagccctcttgctttagtttgttgatccccgactaaatctcattggaaaacaagctagaaaacatggaaggagtgaagagtttgatcatgtgtatgctagtgctaggcttagtcctgcaacaagagaagatccaggtggaagcaaagagttgttgcccatccaccacagcaagaaacgtctataactcatgccgtttcgcgggtggctcaagagacacctgtgctaaactttctggctgcaaaattgttgatgggaattgcaagcctccttacgttcaccatacccttcaccctgaagctggtaaattagaaacattaactctccttatctatatttctatcttgcattcaccacgcccttcaccccagctaacctaggcaaattaaaacatattaactctctttgtgtaaacttttgggctattaattttgtaatatctattggtacaagcatttattcatgcatatacatgattttgcagaggaatcggaggtacttgacttctgcaagctgggatgtgcttcgtctgtgtgcagcaccatgagcactcgtaagcaagaaaaaacatcatattaaattaccattgattttcaaccaaaaaaataaagattctttgttgtatatagctaatgtatagattgaatcatttgttttccttttcagtttctagcaatgaagaagcgaattatgccgtcgatcgttgcaacgatgcatgccaccgcttctgtaccaaggaagctgagactgtcaccgttgtttcctaagcaagtgcaacatgcaagcataagggcttcacacatcgaagcccatggaaggctatgccactctggagtactcattaataaaacggatatcatgatatccaagccagtgtgccatcgatcgatctatcttgatttctgtcactctttattttcaataagctatgataatcacgatctaccatcatatattatcttttcttgaggatgggagcatacgtagagtgatgatatcattgcctaataaataaatctttatcccttttgttaaaattttataatgcatgctacatatatcggaactgaggtggcaatgaatatacatgatcaattgagctggatagtccattacaggttttatacacatatacatggtgaagaaaataaattattttccttccttaattaaaaggatacttgaccaaaacacaatgaatgattaattattataaattgacctcatgaacagatggttaaacacacagttaataacgcataatgacttacttctcatctcttctatatgcttgaggaccatccaaaatattcaaatgttttcttggcgacaacacaatgagctcaacaattaccaggtaaccatatttatattcgccatcagaacttacagattcaacctggcaacctcttgtttattatatgcctaaggcctccttgggcattataaaactattacacctacaaacctgcaatgaacttacacctgtatttagatatacacctaatgttgctcagtacaagccaagttgatggaagtactgatgcttattaccttgaagaacaatatatacagtcattgtttaattgttttttgtactgcttgtttgggtaagcgcttatcaatcgtggtgggcagctggtaggtattttgctataacctcaaaattaggaattagggatggggtcgatgtatattcagcctgactgacttcgtcccgactccgagcaacactataacaagatgatggcagggatgtgactgccattcgagctacacgaaagatgagcagaaactactatgagagatgttggggtggggggctttgcagaaaaaaaaaagaaacaggccggaacttcatgcgaacaaagatgaagaattttaaaatcctcattaaaagactattgaagctaaaaattgagcaaattgtcaaaccaaatatcgttggtcttgcttttgggctgttaacaaatatgcaaaagaggtttgttattcctattatatgttttgatgaagagctagctgcaagtaattgctaactccctgccttgtgaggtgaaggacttcccttgatcttatttggttctccctttgacagtaaagaagccttctaaagcggactttctatcccttactgacagagttgctgatgaactccctttgtggaaggcctcactcataaacagtgccagtcgcttagttacggtgaaagcagtgctctcaactatacaagaggtaaccaaacctatagacaagagaaggagcttcttatgctcagagcaagagaaggccaatggtggcaattgtttggtcgattggaatagagtgtgccgactgtttacacccaaatttgacacctatggacaaaatagaggaaaattgccaatgtttggaaagtgctgggtttcctttacagggccggtcagaccatgggtatatgggctgtctgaccgactagtagggccggtctgaccgcaggtatgtgtgcagtcaaaccgtcatggtccaagtctgagtctgttttcgttgggcctcgggtttccttgctcgggaagactatgtttcgtgtttcctttggtcactatcccgagttgaacgtggagaagggcctgtacagggcaagaccaactcctatttaagggacaaggccggttcattgtaaacccccgaatacaatatatttgaatttttcttttaccatgttttctattttaacctaggtttagtccatctttgtcgatttgcgtcgtaaatcatccgccaccgctgcgacagtgcgacacctctatgtaggtttgtcctgaaaaccttccgttttgcccacgagatgggcagttatccccatatcgatctaaatcggcctagaggctgattttgatctctaaatcgaccccgctagtcggtttagctgtttttcgacaaaacccatcttgatttggctgtttgactagatcgaggtggttgacgactccatatcaccaggcgtttaggtgttgcaatcgtgcttgtcgacttatcacaaaaagttgccaacgcgatttttggtgactccattggagaacgatctaatcggccatatcacggtcgaatttcgtttaatctagtaatttctgtttcgtcaaatcgagagtttcggctaaacagccgaaatcaatctatctatctactgccactgtacatatctattgatcattgtgttgattgattcagatcggtgacattgttcttgtactaccgatctggccgcttattttgccggtctaaccgacatatttagtccggtcagaccggagaagtggagcagtagcatggccggcagcttctcagctgtacacggccaagagatcagaaacttaatccaattcggtttgtacgtgttaaaaaaaatcaggctatacaaagtcgatttaatcaataggcaaaactgaattggtttctgttagtacatacattagcacatctaccgaggaaaattacaaaaaatcaaagccgattcatattcggctgttctgtcaaaaattccaaatatttgctaggcctacacggttgattaccaaatagatcaaatatttttgataagtacagtaccatatcaagaaaaatcacgatcgtatattaatttattcggtcaaatatttcggttatgagctatgtggcccaaattaatcaaggaatttcttcatcaaccatggcgagcgggaacgagatcgacatggtcacattggacgatcttgatgagggagcacgcaaggccatataggaacatctcaaggcgtatagccaggagatattgatgaagacgtgcactaggacccgtcaaggtgtggttctcaagcctggttctctttacaaacccgtatttgacgataaggtaacctccaattcgcctgatccatgtcttgccattctaaaacatattgatcattgtatagatgcatcttttagtgcttattttgataaaaatatggtagaagatgcttgtaaaacttattctagtaagaaaattggctctaaaatagccagttgtcaacaatatcatgctacttctacttttgcgtctacacaacatattcataatactatggatggatcagcgggtgttcacacagccgattccacaggaatcggttatacgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60615 - DNA, 13953 bp, Oryza sativa
tacaagcatttattcatgcatatacatgattttgcagaggaatcggaggtagttgacttctgcaagctgggatgtgcttcgtctgtgtgcagcaccatgagcactcgtaagcaagaaaaaacatcaagctaaattaccattgatttgcaaccaaaaaaataaatattctttgttctatatagctaatgtatagattgaaacgtttgttttccttttcagtttttgccaatgaagaagccaatcatgccgtcgatcgttgcaacgaagcatgccgccgcttctgtaccaaggaagctgagactgtcaccgttgtttcctaagcaagtgcaacatgcaagcataagggtcttcacacatggaagcccatggtaggctatgccaccctggagtactcagaaataaaatggatatcatgatatccaatccagtgtgccatcgatctctcttgatttctgtcacgttgtatttccaataagctatgataatcacgatctgccatcatatattatcttttcttgaggatgtgagcatatgtagagtgatgatatcattgcgtaagaaataaatcttgtcatcgggatggatcccttttgttaaagttatataatgcatgctacatatatcggaactgaggtagcattgaatatacgtgatcaattgagctagatagtccaatacaggttttatgaacatatacatgatgaagaaaataaataattttccttccttaattaaaaggatacgtgaccaaaacacaatgaatgtttaattattatcaattgacctcatgaacagaaggttaaaaacacagttaataacgtataatgacttactattctatatgcttgaggaccatccaaaatattcaaaagttttcttggccacaacacaatgagctcaataattaccagtaccaggtaaccatatttatattcaccatgagaacttacagatccaacctcttgtttattactgtatgcctaaggcctccttgggagcattattataaaactattacacttacaaaccagcaatgaacttacacctgtatttagatatactcctaaggttgctcagtacaagccatgttgatggatgtactgatgcttataaccttgaagaacagtatatacagacattatttaattgttttttgtactgcttgtttgggtaactctcgttcagcgcttctcaatcgtgcttggcagctggtaggtattttgctataacctcaaaattaggaactagggatggggtcgatgtatgttcagcccgactgacttcgtcctgactccgagcaacactagaacaagatgatggaacactagaacaagatgatggcagggatgtgactgccattggagctacgtgaaagatgagcagaaactactatgagagatgttggtgtgggggctgggctttgcagtaaaaagaaaaagaaacaggccagaacttcatgtgaggaaagatgatgaattttaaaatcctcattaaaagactattgcagctgaaaattgaggaaattgtcaaacccaatatcttcggtgttgctttggggctgttaacaaatatgcaaaagaggtttgtcattcctattagatgttttgatgaagatctgcaagtaattgttaactcgctgccttgtaagatgaaggacttcccttgcaaaagaggtacagtagatgttacgcccggaatttctatccaaaattccaaacgcttacatgtgtgtgaacccttgtccaggaatccgccgaggcacacaataacaaattgataatagagtacaattactactctaattaataagcgaataaaatgtcattatagaggtagatagttcctctcaatcaataaagatctaagcagcgaaaaaataagataaacggcgcagacgactccactccagaggcagcttgaccagggctacacctaatcctccacaccatcagcatccctgtagaactcctcctctgatgaatgattgcaaggtgagtatatgacatactcagcaagccacgcagcaaatatgcaagtacacaggataacaaaggatggcattgtagggtttcatttgcataaacagcatttaataaacattttagaatttaataaaacagttaagtaataattaaacaatattaacccaacgctttacaacataccctgttgcataggcccaaccattctgaacaaccatcccggctgcacagttctatctccaaaccaggaattaaccattccaaaccaggagctaatcaaattattaccagttatagtatcttttattatgatgagaagtgtgagactaatcacgaaagacattgttagacccgcccttaaccgcgggcacggctattcgaatagttttactctggccagaggtgtaccactgtacccacaagacacagccccacaacatgtcaccatgtgcctcaataccaccacggtacctcggaaagaagctgtgacagtacccctcgcacaacacaatccaccacagtgcaccgttcctggatcataatcacccccttataaacaaggcatggactccccagcgacccccgtgggcttatctccgccacttctcagtctggtgctccgcaatgaaccatgctatacaaaaggtaaagccattgcccacgctggcttgtggctggcacggttaatgtttcacaatcgaaactcgtgaaccggtccttaattgtcatgagcacgaccatcaaaaccatgtgctcacaacccaccattatcaagttttagttggcaatttaattaattaaccaatcacgattgaccatcgtgagctatcattaagccatcattaaataatagtgaattataagttatcccaatagtgtgctaaagtttctaagcatggctaagcaatcatatctaatatcaagctgaaccaatatataaagctcaactagtcacatgctaatttattttaaaatgattaaaataaatatattgtgctaacacatgctaatttattgtgtaaatagatacatacacacacacatatatatatatatatatatatatatatttatctattagtttattatattaaagaggtgaacatgcaatataaactatacacagtcaagctcggccaggctcggtagaagctcgagctcggctcggtaaagctcgcaagcttttgcttaggcttgggttcagctcgtttggtgctcgggccaagctcaaatcgagcctaggatgagccaagctcgagctgctcgcgagcctcgagcttttctgatagccctaattctgattgtatctgttgtgttattagttgaatctgagatggtatctattattaggtttgaatctgagatggtatgaaaaattggattgaatttggtgggctcaaatttaatgggcccgtttagtgggctttgaactgatagttcgttaaaaatatgggccagttttgaattgggcctagttctaaaatgaacctattttaaaatgggctagttctaaaaaataatgggccgctgttaaataattaatggaccaatgtaaaaaattaatgggctgttaaaaaattaatgggtcgtcaaaaaaataatgggacgtttgaaaatatttgctgacgttagctgctacgtcatcagtgacacgtcatcacacatgtgtcaacgaccacgtcacctgccatgttggccgccacgtggcaaccatatgtgacgtaaggtcgggcctggctggactacacgagcccaaaaacgttttatgacggttaaaaaacgtcatagattgtactaatccgtgacaatttcggagaaaacatcggcagatttaatctgtgacgctcaatagatgatggtaagtagaattgtcacagacaaatttctgtgacgaattttcagtgatccatgatgaatttttttgtcatagataaaatagattcttgaagtgaaaaataacgattcgaaaaccggcatgtttagactttatcaagccctagatcgattgattgatacaggtaacaatctggatctttattgcatacagttgaacaaggctccaaaggggatttctttacataaaataataggggaatttacaagcttgtggctaactaatccaactgaagctatagagggactcaacatgaatgttttacttagacttaaaccatctaactaatctagacttgagaactaggttgaaatgagactaacttatatgattgaactcccggcttcggcaagaatatcaaattgactctgaaaaggaggggttgaagcaagagttgtactcagcaagctattatattgagtaatgaatgcatgaaataatagtaattgagtagggctatattaagttgtagaaagcagagaatgtagaagaagaaagcctgtgatgtttgaaatgtgtcagtatttaataaaatcttgaattaggtttctaaccaagatgccatagtgagtcccaatgcccgataacaacgagcacggctattcgaatagttttagggatactcatactgcagtagatgtgcgcttgccaaacacattagccttgtcatgacaaagcttttcggtttctaacatcagtggtacctgttccatgtactctagtgtaacgccccgatttttgttcaggattaaaaatcattaaataatgcattttttaggaattaaatcaaagttaaagcaatttaatcatgtgacattattgagggaattaaaaattttcctttaaaaatcatggccgaggatattttgtaacattctttgtgccctgatatattctctggaatttccctctaatttttggatttcatttaatcaattaaataaaaagaaaacaaataaaatttcccctctttgtctttgggccactcccggcccaatccccctccttttcccctttttccacttcagccatgcctccctcctcccttctcctcttgggccggcccctctccctcgtcccgctcggcctccttcccctagagtcttttttgcctccgtctcccgtctcctctctctttccctcgccgacaggtggacccgtggccccacctgtcagccccatccccaacctccagccgccatggcatccaccccacatcgccaccaatcccgcgccaccctacccacctcctccacttcgcgcggccgcacccgaccgtgggacctcgtcgcccactttccgtcctctcctcccccactccttcccgcaaaatcggcgccgaagcaccgccacttcgccgaagtcagtgcttcaccccgtcgccggtgccccgcctctccccaccactgtcgtgccctccccgaccctataaatgccgccctcgacctcctccctcctttttcccctatttcccgagctcaccatgcccctactgtggtccccacgctgaactgagtgccgccgctctccggagccctccaaccatgtgccgccaccgctcccgccgtcgccgtgctgcgccactgccaccgctagcttcaccgcgtggtgccgcaccccggcctcagctccgtttccctattccatcaccagaaccaccaccccattgccaacccgaaccaccaccgtaattcgccgcctccagccgcccaccaccaccgcttcaaccgacgccgcggctcgccgcttgcgccattggcttcgcgggttgcaagagcaaggccggccgccacctcgtttgcccagtctactgacggaaacacctctttagccatcgaccgaaggccgccgccgcgtttgtcgcctccggcagcactgtgtcgcctctccggtcgagtccgcaccatgtcgccgcctccttcggcttcacgggagcgagggccagctcggcgtccacctcttttagccagaaacctgctagagctccctcaccctctctcgtcggtaagctacgacactcttcaccgtccttggcattgtttcctcgctgctccgatcatccatttccctccctaatgcctccaatcgattccccaggtcctgtcagctctcggccgcccctcctccttcaccaagagcctcctaatcgccgttgtcgtcatcttgctctgcaccggccgccacttctggtgaggactcctactccctcctccttttcctcttcgctggccgtgccgcgccgccgctttcccgcgtgcgctgccgccgctcgtgagcaccgccgccctctagccgctcgccgccgtcctgcgtcgccggctgccaccgccgcatcgccgtttggtcagcccgggcggcgagccggcctctgcttcgctgtggcctcctgatccccttcaggctgatccgggccatccacgtggcgtccgccgtggccgcccgtggccccgccgcgtcggcaccacatcggcgccacctcgtcttgccttgccaccgtggccgccatgtggccgtccacgtggtgcgcccacgtctatgttgcggtggaccgagtccaccgtgggttgcgcttcttgcgcagctgactcgtggggcccgcccgtcagcaccaccctttgatgatgtcaacaacgacccttttcctttgtaaaaataattattaattgcgtcataattcggatttaattatagaaattaatttaaatggctcaaaacttaaaaaattcataactaattcataagaactccaaattgagccattcaagttgcaaaattaatctaaaattgagctctacatgtttgtttactatttatgtattgtttacttggtttttattagagtttttcctcattttgcgtggcagcgtgtagtttcattcgtttcggaagatcgcggtcggaaggatcagagttcagaagattgttttgaagaagcaaggcaagtcacacatccccccttgaacatattgagcctactctacaaacgttttaccgtttgtaaataaatatgcatgttttgctaattacatgggaatagggtttacctatctactcgcttgtgccatattacttgatatctgtcctttgcgaaccttggatgataaatcgactagcttgtgttatttgtgttaacccaggtagaattatttatgcttagccatgcttaattaccactaaaattaagtggccatgtttcattggtcgtaattatccaattaaaatgcgactgagtggtgccttgtggatgcatggttttactagtcgcacccatggcaattaatgactggttcgcgggatgcagtggaagatttaccgcgcttaccacaagcgggaatgggtaactgcttgatttgaagtatagctttcctctggttgacgtaccctggctagggtgggcgtgatggagtttggatgggccctgcgacggcctttgcggcttccggatcgaccgtggtacgaggggggctgcccgttgcctgctggggacgggggcgaaacctgtggtttggtgcgattggttagaggtggttatatgaagggtcttgtcacaatcactcgacatggtgacgtgtccggccaggcgcggtgacatgccggtggattgtgtcttgtgggtacagttgtgcacctctagccagagtaaaacaattcgaatagccatgcctgcggttttgggcaatcgaccagaatcaccgtgattaatctcaccaaataaatcgatccaatgcactgtgtggttcaggtgggatggttgggcctgtacaacgtgctgtagcgttgttcagtagagatttaatattatcttaattaaccaactgctttactgttttgctcaataaaatgctttacaacttcctttatgcaaattgccacaaacctctctttgtatccccttgcacaagtgcatcatttgtgtggcttgctgagtacggtagttgtactcagccttgctatttctcccttttttagaagtgtagtacttctgagctgaagtcgaagttagtagaccaaggcttagaccccagttgagttttgcctgtggagtggagctaaagtcccgctaggatcgccttttccgcggctgtcgttctctttcggtgtgaggactaagcgcctcttatgtaagtatatatgctttatttacgtatctatctgtatattaatttatcattttgtgtgccctggctgattcctggacagggatttaattcctcgaggacgagctgctcaaaaagaggggagtaatgtcatgggctttaggccgggcgtcctaggcccattggataggcttagggtttgttaggattagattaagtggccctccatctatagaaggagggatcctatcgtaggtcaattaggcattagatcaagatttaatttagtgcccatcggcctgccttctcagtgcgacggagagcgtcccgccgtttaggtttacgactgttccttgtcatttcatctactataatccaatctatccccactcatcacgattcttctccacataatccttgctcgtgacatgttcctttctttttttatttaattatttagtctaagtaagttatatttccatctttgcaggttcattgtttagtatttatactaagtgctctagtactaggactccggatagagaaggaagttcttgcgcaagtattagagtagtaattaataacttaggcgtggtgtctaggttagagattacctgtgtttgttgtgtatcccacggatttgtcagaggtaggcggcaggtggtgacagccctgaattccgtcctagtaatcctccactgtcacgtcctgataaattcatcccgaaataaaaatcattccctaaaaggaataatagaattaattaaaattcgaaaagaaattgacaaacactaaaatacgtgccagaaaaattcgaatgtggtccggagaatttttgttaaattctccttggtctaaaaggagcccttaaattttacttgaattttcagagcaccgaaaatatttattaaacaacaacaacaattaacaaagtttattaaaaagaaaaagctaaaaataatccccctcctctctttgggccaagtctggcccaaagtctccctctctccccctcggcccgcagtccaagtccctctcccctccctttgtttttctctctttcctcccgggcagcccactccctcctcctccttcctcccggcctgcctcggcccagcagcccggcccaagccaggccgagccgagccagccgcgtgcacgcgcgccgcgcgtgcgctgattgcgcgcgctgaccgcgtggggcccacgcgccggtcgtcttcctcctcccacacggcctcctctctctcccgtgaaaaccctagttcgttcctccctcgaatccacgggatttaagcgttggattccaaaattaattggggggaattaatcccctttccttcctctcccttttccccctaatctcccctttaatcgtgcactattttgaccggaacggctgccgttccccgctcctcccgtgctcggctcgcttccctccgctacaaaacggaaccccctcgctccgttctctcgttttagccccctcccgcgccctccccgtggctgcaccacctctccccgcctcctccttctctttcctcagtgccggccaccctccagccgcccctaccgccttgcccgagcgccggtcggccgtgccggtgccttctccagcgtcgcagccgcctcctctgcaccggcctgccctctgttgcccatggagacctccggaagtgcatccccgccggcaacagtggcgttaccgccactgttctgtcttcggccggctactgttcatcaccaatacgccgaccgacgtcgccatctcctccgtcgacgtcgcagccgcctcctctcccccggtcagccctccgtttcgcggggaaaccaccggagacacgtcctcgccggtaaaacagtggcgttgccgccactgtaccgcctccagccgcctgtgccgccttgccggtgcagcggctgtcgtcatcgccatcctccctcgacgtcgccgcgtcgccctccaccctggcctgccctcggtttcgccggaacgccgtcgcccgcgtcggtctcgccctccgcctcgccggagttccttcggcaaccccttccgccgtgcctgtgcgccggccgacgtcgccatctcctcctccggcatcgcagcgtcaaggttgccctcggcctcgcctcccctccatctgaaccccgccggtgttcgttatcgtcgtctccgttcgtcctcgttgacgactcctccggtcggtcgttcgtcctcgccggctcgtcgtctcgctgcgctgccaccctcgtcatcatcgtagcggcgtgttccgcgccgtcctcatctccgtgcagctgctgccggctgccctcatcgcctcctcgccggttcctgtcgtcgtcctctcgtcgttcccggtcatcgtggcgttcgtccctccgtcaagccgttctcatccgtcgtccgcgtccgtcaagtgtgccgctgcagccccgtcgtcgtcttcgtcctcgcctccgcgtcgccaagcattgcaccggccgcgtctcaccttcgtccaaggatcgccgccgaagtcgtcccctcgcctttcgtctccgtcattcccggccgtctccgccgcgcccgttcatcgttgtcgttccctcgcctcgtcgtgtggtggtaaggatctctccttcgctgccccgtcctcgtcctttcggtgtcgcctgtgcccgttgtgcggttgtcgaccccggtacccagctcatcagaagggatcaataataatggggtacacaactgaggaggtggctggttgaatgctgtatagattacgtgaaggacgccacacccattgttataacccccgttgtacatgagggtcggttacttgggaagtggaccgtaggcaagaaaaggttctatgataacgactacaaagctgtagcggaagcttttagcagcgtgccgcaacaactagccatcctcgagccatacattgagggacacatgaacgagataagagcatgcaaccctagaagaccggcgacttggatctcaaaggaacataagcgcaaatttcctgaatggttgaaggaaaaaacatgtcgttcggtgaatcgcttgcacaggttggcaactggcccaagtagcctcatgaactcatggcaatggtacgacatcggcggatatacgttttatatgataggcaagaacaagaaaagcgcagctcataatagtggagttcgtgtggaggtgttggacgcaataggcgagaagaagtcatactatggatagagaaaatcccttatatacccctgaaattttacctaatcccttctatacccctgaattttgcttacttccttgtatacccccaaaatttgattttgatcccttgcatacccctcccatcagttgaccgttagttgaccgtctattttccataaaaatgaccattttacccttggatgaacaaagaaattcatgaattacattattaaaaatataaaagcttctcgcatgagactattatagttatgagtttgttgtgcgatgcattatttatcccaaaaatatttttagatcatgaaataaaaaacacgtatttatttttttaaaaaaagtcataaaaatgaggagcattcatataaagataggactaccaatgttcacaacattttttttatgaatgttcccgataaaaaaatccattgtcctattaaaatttgaaataaaaattttaatttattacatttattttattttcaaaatttatgtcaaaattttctgcactaattatttagtttcattagtcttataaaatgcacatactgtgcacccaaacaaaattttttcaattgttttttaagcttatatttaaacctaaagcatctagggcaaaaaggatatttgcaaccaaacgtaacagtgaaatgatggaaaatgtaacggtaggggcatggaagggatcaaattgaattttcaggggtatagaagggattgggtaaatttcaggggtatgaaagggattgagtgagttttcaggggtacacagggaatttactcctatggataatagaagacatttgggagcttgactatggcattaacatgcaggtcccggtgctatgatgccagtgagtcaaagacacaacaggcgtatccatcgattactacacccttacggttgtggaacgtagtaaactaagccacaaggatgatccatgcgttctcgctgaatatgttggacaggttttctatgtgaaggacccatccaacgagcggatggacattactgtagtgggaaagcaacacattattggcatcgataacactaaagacgtgtcagattacaaccaatatgacgacgtcccattattcacagatattcctaaccagatcaagcgaattgagacaacccttgacgaagagaagttttcgtctgtgcggaaggatggtgctgcgaaaattgtgaaacattagtatatatatatatatatatatatatatgttgttgtgtacaacctgttttgaaaacgattaatgtatccaacttatagccccttcaaacgattaatgtataaaacttatggttccatgtttatctgtactatatgtcgttctcaatttatatggttgaataattaagatgtggtttgatcaatatacaagtgatttaattagatgcgattgaaattcatttgtggttaaataattatatttctatggttgaataatttgttggcattaatcatatggatgaataattatattgattaattaattaagttgtggtttattaactataaccctatttagttatagttaaagaattatagttaaacaatttatgggtttaattaactataactatatttaatttgtggttgaataattatattgattaattaactatatttagatgggatttattaatttatctgcatttatttttgcgtgcgggtggcttaagccgcccgcacggaataatatcatcccgtgcaggctacttaaaccgcccgcacaggaatatcgatttcccgcaggcgataatatggttacataagcaccgggcgggcgggcgaaattaccaccgacgctgcccagttgtttgccgccgccgccgccgcctcctcgcggagccccaaacgccgccggtggcctcctcgcctcaccagcctccacctctgccgccggctcctctcctcctcgcccttcatgctggcgacgtcctctccggccaccgccgctgcctcctcctctactcctctcctcctccatcaagatctgggccgctgccgcctcctctcctcctcgccctcacgccggcctccccgacctccgccgcggccgtcgtcctcccgaaacaaccagcctccccgacctctgccgccgccgacctcctccccaagccgctggccttaccgacctctgccgccggccacctccttcccaagcagccggcttccccaaaatccgccgccggccacctccaccccaagccgctagcggtaagcgtgttttaggttttttgtgaaaatttgtgatatgtgcaatttgtgatatgtgaaatttgggacttagggtgatatttgtgaaatgacaatttgtcaattttgtgcgatgtcaatttttattaaaaaatgtagatgcaatttttttatatgtcaattttgtgatttttgggacttaggatatgtggtatatatgtattttttttttataattattcatttatatatggatttagttcctaggttattaaatcatcacagaatatgaggtgctctaggtgccatattggtttcgtcgagttagtgcattgacggagccaaccaagacaccttgggacgccgaggatcatattatgtcttttataggaaatatatatgtttacggttttttaggggtttagtgcaagtatgaaattgggctcgaataatttatatgtaactttacaattctaaaacacacacaaaaaaagggttaaagtgcgtagatatttctaaacggctagcatgattaattgagttacaattattacaaaga

SEQ ID NO: 60616 - DNA, 3037 bp, Oryza sativa
ctcagctgatagtacatatccgatcacaatcacatgcggcgagatcactctacgtaccattcgaatattgacctatcacgtgccgaccgactgataaactaatgaaccgaattgtatgcttagtacaccattagtcgatcaccccacaaaattagtctatcatccatctaataaatacctataaaaatgaaaaatccttggctcaaatttattatccatacacaacaataaactagcataccttcaattgaatgcctataaattaatttatgcatatattcatgcattcgtttttcaacttaaaatttttaataacacctctatatctgaaaaattctaagagctagaagcacattacatacaagaaccaatacaagcctaaaatcccacattgggaggcctaaatttggggaaaaaaaagaagtttttagggttactctctaatctataaatttgaccaattaaatcgaaaaaaaagaggaatggtgtagtatatactgctcttcaacttccatgagaaattccgagaaaaataggtccaaatcgactggatttgaggaggagaggtataggtgctacttccttacttgctagatcacctcacttcaccatgcttgttctgacaataggtataggtgcaactgtacaagctagtgcaataagcatggtccgcatgcctgaatgtttctgcattatatccatccaaggaagcaaatttgtataggttataatatatatgcacgagatatgcatacacagattatattatcatctatcagagagctagcacttagatatttttataatataatttaattagtctattctttacatcactcagctgatagtacttatctgatcacaatcacatgcagcgagatcactctacgtaccattcgatcattgacctatcacgtgccgaccgactctgataaactgacgaacctaattgtatggtttgtacaccattagtgtatcatcccacaaaattagtctatcatccatataataaatacctatgaaaatgaaaaatccatggctcaaatctattatcaatacacaccaataaactaacacataccttcaattgaatgcctataaattaatttatgcatatattcatgcattcatttttcaacttaaaattttgaataacacctatatatctgaaaaattctaagagcttgaagcaagttacatacaagaaccaatacaagcctaaaatcccacattgggaggcctaaaatttggggggaaaacaaagtttttagggttactctctgatctctaaatacaagagaggaagggcgccaatcaggttgatgccaaaaagggtctattccagcaattattttatggaggggtctacttaattatcctctacctcaactctggtcatcactgaccagctcatgagctatactgtattctggcttctcaagtccttgccagtaattttcgcatgtggtcctctttagaccttgccagtaatttaacatttttttgctggcgaggacttaagacgttcgccagtaaatataggagcggcttaaaaaaattggatcacaaccaacgagcgcaccttgcccctcccacaccctaactgctcgacctctcagcccctcacccgtctcagctctctacctcaccttttccacttccctttccaccacagcccctccactctcttcctaatctggccaaaggggcggaagctagcggtggctgcactccctttccctccctgtccttgatctagttggagggaaggagggcgtcagtggcatcgactagatgcagctaattaggtgtaaccccaactatgtgattagatgaacaaactaaacatatagtcaaagagcaaacaaatcaaccagccgagtggttttattaaaaaaaaattaaagcatatgtggtgtcaaatctgacttaacaatactcatagtcactcatacaaaatatcaaataggtgttgccactataggtaacggaagtgattaaaccggcacctatagtgctgttcccaccttcataaaatgaaaaaaaaaataaaactaacacctttaaacgaagataggtgtcagttttacagaaaaaccggcacctagattttaggtgtcggttcacctataattaattataagtgccggtttttaaaaaaactgaaaccgataaaatcgagccgaaccagccaggggagatatttttcctccagatggggcccacacccacactggcaggagataaggccgagcccttctcccgccttctcctctctctctctctgcagcagcggtgggagaggtagcgacgcttcttctctctctgtgtctctctctctctgcggcagcggcgggagaggtagcgacgccctcccgtcaactagatcggggggaggggaggtgcagcggcggcggacgacatggaggcggcggcccggaccccccctccccccgccagatcgagcgagagaagaggtgtagcggtggtggcgggttggacctcgcctccgccagatccggtggcgtggaggcagcaagtttacactaacttcactcagacaatcacacaatagcatcatatatgaatagaaaccatctagaagtcatatccataaagcactgtagaaatcccacgaaaataatccgaaactaactcctacctggagtctgctaatctgaccgttgggcaacccggttagaccagtccaacaccactggtctgaccggcagtccccgcctagtctgaccagccaccaagagccgactaccgaaaacactattcaccgtattttcacaaagcactcacttttgacaattgttcatcaccacgattaaatcatcacatgattctacacatatctagagagaggaggcaagagaaggcaataatatatgttggtaaggacatagctacagtgacagaaagtgatgctgaactccatcggtatcgttagatttgtgctgatgtatatgtttcttttttcacaacagcttagtgccgttttcttttgatatgtcctccacgtgtgttgttg

SEQ ID NO: 60617 - DNA, 5198 bp, Oryza sativa
acggcggaaacgacgaccggagcggaggaaggtggcggcgcgtgtcacgtcctgataaattcatcccgaattaaaaatcattcgctaaaaggaataatagaattaattaaaattcgaaaagaaattggcaaacactaaaatacgtaccagaaaaattcgaatgtggcccggagaatttttgttaaattctccttggtctaaaaagagccctcaaattttacttgaattttcagagcaccggaaataattattaagcaacaaaaacaattaacaaagtttattaaaaagaaaaacctaaaaataaccttccttcctcctttgggccaagtttggcccaaagtcctccctctctcccctcggcccgcggccgaagtctccctttcctccctctctttctctccctctccttctctccctgctcttgggcccctcttcccctcccggcccactccctcctcctccctctttctcccaggccgccttcccccctcctctcctcctgggccagccgcccggcccaaaccgcgccacccagccgccccggcccaagctgagccgctcccctcccgcgcacgtgcgtcgcacgcgcgctgagcgcgcgcctggccgcgcggggcccacacgccaggccgccgtcgtcttcttcctcctcccgcacggccctctctctctcccgtgaaaaccctacttcgttcctccctcgaatccgcgcgatttaagcgttggattccaaaattaattgggggcttttaatccccattgaatcctcttcaattccccccaatttcccccttgaatggtgcccccaatcgccgggaacgcccgcgccaactccggccaccaaccatggccgccggccgtgcttcctgccgccgttcccgctcctcccgtggccggctccctcccccatcctataaaatgcaaccccctccgtgcgttctcttgttttagccccttcccgagctcccccacggccgcagcacctctccccgccgtcctcctctctctcccgtgccgccggccgcctccagccgcctctcccgcctcgcccgagcgccgtccggtcgcgccgtcgcctcctacagcatcgcagccgcctcctctcccacggcctaccctccgtttcgcgcggtgaccgccggaggcgcgttcccgccgtcgccctcctctttccttcgcgccggccgcctccagccgcctctgtctccctgcctgagcgccggtcgacgtcgccaccacctccctcggctccgcgacgccgccctcatccccggcatcacctcctcctcgcccgattttcgccggaacaccgtcgcccgcgccggcctcaccttcctcctcgtcgacgtctcctccggcaacccctttcgccatgcccgtgcatcagccggcgctgccgtcccctccctcggcacggtgacgtagccctccacctcgtccacccctcggtttcgcccggaagccgccgcacatcgccgcgaacctctccatccgcctcgccggagttgttcggccgcccgtccctcctcgcccgtgcaccggtcggccacacctccaccacctccggcatcgcagcggcaaggtcgtcctcggcatcgtttcccctccatccaaacccctccgcggtccatcatcgtcgtctccgatcgttctcgtcgtcgacgtcccgtcggtcgcccggctcgtcgtctcgcggcgccacctccgtcatcgtcgttgtagcggcgtgttccacgtcatcctcgtccccgtgcagccgctgccggctgtcctcgtcgcctcctcgccggtcctggtcatcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtcctcggctccgcgtcgtcaagccccgtgccggccgcgtctcgccttcgttcaaggatcgccgccgaagccgtcccctcgccgttcgtctccgttgtgcccgtctgtctccgctgcgcccgttcgtcgttgtcgttcccgcgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacggggtccgcctccgtcgacccgtggaccgtctctgtgtacccggtctaccgcggtccttttggttgacatgtggggtccgcatgtcaacggcgcagccttcctgtcttttccaggctagcgcttacacatgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgcgttctttttatgtattgttattgcttctttataggcttgtagctttgcttgtgtgcttcgcgtagctttcgtcgttccggaggttcccgaagcgtggttcgcggtcgtcgctgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttaagacattattattgctattgttattattaccttgttcaccctagaataaacaaaaccccaactagtggacactctatttatggttctactagtatgaattagggtagatgcttcgctgattaataggacaacattaggtggtttttataactttagactttgggaattctcatatcatttggacactatggaatggttggcttatggtggaattggacatacccctctcttcctctttcaaaacccctaaaacctgtttttcggtggggtttgggtgcatgccagttgtgggaagtggcaccccggccaatataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgctgaacaactaaaatgtggaatggttggcctgggttggcttgggacgagctgggacccagggtcgggttgccagttcggtctgaatcatcgtaggccttgggttaaggcaggttcgtgtgggttcatgaccttgattaataatatcatatagctctaggatcgtgtttacaaaatagctttgggtaactaagtgacttttaaatgctgtttactgcaaaacttaacccctatattattatccccttgtactcccttgcattaattatgcatctgccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgcgctgtaccccggcttttcctgggacggggattaatacactagcgttcgggaaaaggcaattttcccggtcgcgacagcgcggttcggatcgacgaggacggcggcgctccgacggtcggcgggcgaaacgaaggggtggacgaggttgacggggacgcggcgaagccgaaggaggtgacgccgagacgggaggaggtccggggcgacgacggcggcgaaccggagctcggcggcgacggcggagagagaggaagacggcgcgagctcgaatccgaccgggagagagtgcggcgagtggcggaaacggaggagcgaagcaggaggaacgattatatagcgtcgagagtgagagagggcggccggagaggaaggaaaccggcgcggcgatctcggctccatcaaagacgccggcgaggatttcgggaataaatccgggcgaatccgagggagagagagaggggaaagtggggggaaagagggagggaatcacggggagtgatttccccctctttatggcgcgcggggacggcgggatgcggcagattcggcggcggcggcggcgttagggcacgggcgggcggcggacgcggcgcgaggtaggcgatgacaggtgggccccacccgtcagcgagggtggcgggcgggcccgcccgtcagcagcgcgcgcgcggggaggggccgatgggccgcgggggagaggagagagagggagggagttgggccgagccggcccaagagggaaaaagggggggaaagaagacttttagggattttctttttataaaattattttaactttgtttatttcttctcaattattatttgtgctctgaaaattccactaaaatttgagggctctttttagaccaaggagaatttaacaaaaattctccgggccacatttgaatttttcttgtacgtattttagtgtttgccaatttctttccgaattttaattaattctattattccttttagaaaatga

SEQ ID NO: 60618 - DNA, 8326 bp, Oryza sativa
tgattagtctcacacttctcatcataataaaagatgctataactggtaataatttgattagctcctggtttggaatggttaattcctagtttggagatagaactgtgcagccgggatggttgttcagaatggttgggcctatgcaacagggtatgttgtaaagcgttgggttaatattgtttaatattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaggagttctacagggatgctgatggtgtggaggattaggtgtagccctggtcaagctgcctgtggagtggagtcgtctgcgccgtttatcttatttttccgctgcttagatctttattgattgagaggaactatctacctctgtaatgacattttattcacttattaattagagtagtaattgtactctattatcaatttgttattgtgtgcctcggctgattcctggacgatggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatagcacatgcatttcataatctcttttagtggttctcattcaaaatttattccaatgttattagtactgtacatctattactgtactaatggctcatttaccagcaaaagttttacaacattgttttatttaatcttgctgcaatgaaataaacttagcgtgttgattttataactttcttttattttatttcttttgaagcctgttgttcaaaagtgcaaaatttgtgatcttgtttccaactgtttcaacttatcttgcaagcttggtttactttatttacttaccttttactttgattttctaactttattcaaattaatccaaaaacttgtgctattaattggataaaatgtcttaactccctcctttcacttgtcttttgatgccgcgcttcaagcctgagtacttgtttggtgttgagggatttgtccaggagttgcatacgatgtcctttgccataggatttgggactgcccctttgtatgcccagattcctcatgatcgtgatgaagagaagtgccgagtcaaagtcaccatgaacagtaatagtgaagatatcccatcagtgatgttcgaagctggaggaggaaactacattcatgcatgtcaggaggtggcaaggatggccataggagagctccgcgatcgctacagtgatcagttggccgacactgagtatcgctaccatcctcgccaaccccagggaagtgaccgtggcagttaccttgagactgtggggattgagaatgatgctaccacaaggcatttggttgagatgctgtgagctatggatgagacccgcgcggagactgtgttagcagctcaagatcgtgaagaccagaatcgtggtaagatttgcaagctagaggacaaggtggatcatttggagaaggaactagccgcgttgaagggagaagcaccaccgcagaaggccagggttcgtcttaccgcaaggaagagagctctattcgtccctcgctaccaattggcgccaaaggttcgtgtggtggagaaagaagttaccccagccctagcggatcctccggtcgtcaatgtaagtaatgatgataaagaagaatccaagcgcacccattccaagatcgagtggggagcaactcaagatgatggagacgaaccgaacgagccttcaatcaactccgatgcccggaagacctagaatgccttgtcaagccattgtctttgatcgttgtgttagtttgcttgttttaagtttggttgtgtgtgtctcgcatgtgatttacatcagtggtgggatgtaagcgcatgtgtttgtttgctttcgagtgttaggtagttggtgagtttagtggtgtgagagtcttcagttctgtaataatgaaactcagttaagatcaataaaagttaagttagtagaaagattaattctctgtcctaagtagtttttcctcggtttctcttcttgtgatcctgcccatgccagatggtgctcactcgcagcaacgggaatggtcccaacatcatcaacaacaacaacaatggagagaatcccacgcttgcccaagtcctagctcaacaggcacagcttatgaacatgatgatgcagcaactccagaaccagcagaaccagggaaataaccatgcacctccccagaacaagttagcagaatttcttcgtgtgaggccgcccactttctctagcaccactaatcctgttgaagctggtgattggctggatgccatagagaagaagttggatttgctccagtgcactgatcaggagaaggtctcatttgcatcacaccaactgcatggccctgcctctgagtggtgggatcacttccgccttaacaggactattgctgaacctatcacttggcttgatttcaccgctgctttccgaaagatgcatataccatcgggagtggtgtctctcaagaagaaggaattcaggtcgctcatccagggatctcgcacggtcaccgagtatctgcacgagatcaatcgtcaggctcgttatgctccggaagatgtgcgcactgatgaagagcgccaggagaggttcttggaaggacttaatgatgagctttcttacccactcatgactggggattatcatgatttccagaagttagtggataaggctattcaccaggaggacaagtacaaccgcatggagcagaagaaatgccggattgctcacttcaaggcacaacaggggaatagtcagaggccgcatcttactttgggacctcagtcaatgtcacagggaggttcttcgtctgttgttcgtccccagcgtcagttcttcaacaacaacacgggcaacaacatccgcaatcaagctccacgccttgttgcagctttgacacagcaacagcctgccaagagggagcaaggcagcaagcccggggtgtgcttcaactgtggtgaaccaggccattactctgacaagcgtccaaagccccgacgcgtgaaggttgtccctgcccaaagcaactctaccgcaccagcatcaaaggctcgtgtcaatcatgttgctgctgcagaagctcaaggtgctccagatgtgattttgggtacgttccttgttaactcagttcctgcaacagtgcttttcgattctggtgctacacattcattcttatctatgagttttgcgggaaatcatgggatggaagtagaagatcttagacgtcctttgatggttagtaccccgagtaatcaagcactctctttgcaacatagcccctctgtcagaatagaaattcaaggagtaccatttcttgccaatcttattctgttagaagccaaagaccttgatgttatcctagggatggactggttagccagatataaaggtgtgatagactgcgccaacagaaaagtaattctcaccagcaatgatggtcgagttgtaactgttcatgcattgtcttctgagtctttaaggtcaagtctgaaccaaatgactttggaagagattcctatagtccaggtgtggacccccgtttttataataggaatcattcgtgtaaacagtaccatttccctggatcaagtagtcttgtacacacgagttcatagctgaaataccaaaagcacatacacgagagtctagtgctaattattacatcataagcccgcaggcattgtcttaaatcatcggaccgagcggtccggaatacatccaaaatgcagcaatagataaggcagcggaattcaggcagcggcatgccattgccacaggcaacgaccgtactaagacctactgagcgccatcgtcttcatctccctcctggtagtaggcatagggatcctccgaagcttcatctcccgtttctgattaattttatatttgcaagggtgagtaccaactgtactcagcaagccaccacagcaacaatgcatatgaaaggggtatttcaaaggatggctatggctcttttgcgctaagccagttttgtaattcttttcacaaacctaagacttagcatagactgatcaagttttaataccagtgttcacattaaacaacgacggttctgtccaccatccattgtgatcccaaggatagcttcccgccattgagtcctcatgtttttctgaggacgtctaccttccctcctctcaggaagtggctccatcagcataaaaatcaacatgcaatatcccatcccacacaggttaagaatttagagtatagccaagtgtaatacatgtcccggtgctcaataaccgcgagcacggctgttcgaatagatttggtttactcacactgcagtggatgtacactttacccgcacttcgtgactgcccaacacatgagcctcgtcccaacacatgagacgcgccacggcaaagccttttgataacctcgaattggcagtacccgctccgtgaacttaaatcctcatgcactctaggcatccatgtttctagcagtgagaggagttctggcgctcccaggaaagagaagtctcgcacacatattaaattatggttcaagttaagttctctctctcacacactcatggcagtcctaccaatggtgacaccgatgtagggcacgcctctcggccctacctcaacggctgtcccaccgtagcgcacctgcctcactcaggggtgaaccatctatgcagggatactgcctccgctcggctatctactctgctaggtctatacccatacgagaagtgcggttgtacgggggtcgtttcatgcttaacttcatggctcggtccttaattgaccggggacggtactagccttttccagataccacccaaatcctccgtccgccccagtcgaaaacagttatttagtttatttctcctttcacaaatcatgtcctcaatatcatggcaatgtggcgctcatgtctccacatgccgcatctcaattaccttcccaaaggtaattgcccaagcatataacatttgacaaatatgagtatgcatgattctagaatagcatttctaagcatttgtcatagttgactagggactcatacgtaaacatggttatgaaggaataaggggtaaacaataatcaaggcatggcataatcgcaagtaggatgttcatctttgcatgcaattttatttgtaaacaaaacaatttcgcaattgggatcaatatgttcaagaatagtgatgacttgccttgctcaaagtcttgcgggtcctagccttcacttggatccgcaactccctcgggctctatagttacgtgcgaaaattgatttgaattcggttaaaattcaaataaaaatccaaataaatccaaatggaagtcgaacgcgaaagtcgattcttttatattaactttactattcgcgaactagggcaaacccaatttcgatttatatatcctaaactattttgcgggtataaatattttgtcatcataagtttttaatttaatctacccgagcattatatccatataataggttggaaatttctatcgcaagctaaatatcggacggaatcctaaaattatcttataatattatacgatttaattttagtctaggactaaacgactaaatataatatacgtctaaaattcatagtcattaaatccgaatttctaccgtgaatcgattacttatagagattacccaacataatctataatagtctataagaattcatctaatcgtttagttcttaattacatttaaactactaccgcgaattgatttcttgtagaaattaccaagaataatccataatttatattaaattacgcaattctatgactataactaatctataactaaattctaatttttttaaattttctaaacttccctaatctccctctaatttcctatttattttccttttctttttcttcccttctttttctttttccttcctttctttttcttttcttttttctttctctctctcttttcttttctttttccttctctctctccctcccggtttctctcctccttccttcttctttctctccctcggcttctcccttcctccctctctctcggctctctctctatccggcggcacggcgacaaacagggggggggggcagcggctcaccgacggcggtggcggcgacgacggcgcacggcgcggcacagcgtagcggcttcgtggcggcggcgcggcggctcgaaggcggcggcgcggcagcacgacgacggcgacgcgtggagaaggggagggaaaagggagaggaggaggggatggagtggggagaggggagaatggtgggcttttataggggaaagagaggataagggggagagggaagagaagggaagggcggtgggggggtgaggcaacggcggtgatgtgacggcgcgtggcgcgctggcggagatggcgacggtgcggcgcggctcggggcgcaaggcggcgcagcacgtggcagcggcgcggggcgcgaggcggtgggcgcacgacgtgaggcgacgggacggcgcgtggcgcggcagcggcacggctcgaggcggcgattgtcgcgtcccaaaacgactctaaaatacatcctctaaattatgcctagaataattaaaatccgtgtgaaagcctccaacaaataaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtccccttcccctccctctctctcttgggccggctcggcccatctccctccccctccctctcctctccccgcggcccatccggcctctccccgcacgagcgccgctgacgggcgggcccgcccgccaccctcgctgacgggtggggcccacccgtcatccccttcctcccgccgctcccgccgcctcgcccgcgccctagcgccgccgccgtcctccccgcgtacaatcaataggggggaattattccccgtgattccctccccctttccccccaattttccctccctctctcccttggattcgtttggaaaccctcccctaatcccgccggcgccattgatggagcccgagagcgccgcgccggtttccttcccctccggccgccctctccccccttccaaccctatataaaccctccccgcacctcctccgttcgtttccgcctctcgccgcccttcctcctcgccggaatcgagctcgcgccgtcgctctctctctccgccgtcgccgccgagcaccggtccgccgccgtcgtcgccctggaccacctcccacctcggcgccgccttcttcggctctcgccgacctcgtccacccctccgtttcgctcgtcgaccggtggagcgccgtcgaccccgtcgacccgagccgcaccgccgccttcctccgctccggccgcctttttcgtcgtcgccgtcgacctagagtgagccggggaccgccgcttcttttcccccttcccttcccctctctcggccgccgctccgccgcgctagtggtcgccggcggcgaccatcggggcgcaggcgcgccgcctcccgccggctgcgccggctaggccgccctcgggcgcgccgagtggctgccgcgtggggcccggccatcagccgcccgcacccttaggtgcggctgacgcgtgggacccacggcgccggccggtgtgagcccgggtgcacccggtccaccgtcgaccgtgaggctgcctcgtgggtcccacccccgtggacccggtccgcgcgccccctcccctcggctgacgcaataaacttttttttaaattaaaatttaaatgaggaaatttacaaatattaatttaaagagcatataaacttcaaatggccataacttggccatttgaattcggaattggaccattcaagtctctaatttttccttaagaagtcaagaacccatttttgtgctttgttcctgcttgttatatggagtttattagagtaaaagccttttcttttccgttggtcgtgtagacgctgtagcttcggaagatccgcttttcgtggaagttgaagccgacgtttgggaaagcgagcaaggcaagtcgcat

SEQ ID NO: 60619 - DNA, 15757 bp, Oryza sativa
ctcttatcacctggacactatggaatggttggactattgtggaattagattcacacctcccccactattcaaaatcttcaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcagagggccggtgtcctgctgctaggggctcagtcctgcctacctgtcccggaggttccggccgtaggtggggttgggtcggtactcttgtctatggctaggatgggttggaaactatgtcacgtcttcagtccgtataccgtggtggtatgcggcacgtggttacacgtgaggaagatgtgtcttgtgggtaaagatgtacacctctgatcagagtataatctattcgaatagccgcgcccttggttatgggcaagccgagcaatgtacccaagttagtgttttaattctcaaaacctgcttaacaactaaaatgtggaatggttggcctgggttggcttgggacgagctgggacccagcgtcgggttgccagaacgccgcactcctcgccatcggcactcttcaccagcgctacccggacgagttgcagcactcgccctaccgctaccaccctcgtcgtggaggagcccgcgactacgccatcttccgggatgctagctcggaggatgacgctaccatcatgcacctggcgcgcatggtggaggcgtacgacgcgacccgtatcgacttccatcagatggtgcgtcgtgggttggtcgagaacagcatgaagatcctggagctgcgtcaggagaatctgcagctgaagaaggacctagacgcagtggaggcgcagctgcatcagcttaagatcgcccagggagaggtctgtcgccccaagcgtcgccgcgtctgccgcagcctgaagatcaccgcccgcaagagtacctccgggcccgagcttgttcgtcagtccctggcgtggacctgcttcgtcgagacccctcgtgccgagcccgcgcccgtggttccttaggaggatggagcctccggcgttggcagcacggaggatgcgctgctactcaccttccgccctggcccgtcgcagcagtagacgagcagttagtaggcttgcgtgtgtgttcttctcgtttgtttttctgctagagtcgtatggggcatggttaagccggtgtgtggtataactgtgtcggagcctgtctttattttatttgcttaagcaacttgaactttaatgaaccaatttaatagcagtaataaattcaagaattatggtagtcatgagtggttagttttagttgtcagctctctctgtttgctggttctgtgtggggttttcagatggtgacaaccaggagaagtgctgctacaggtgaaggcagtcaccccgaaggcagcaaccacaacaaccatggcagcccacctccacctcctcctccgcttccaccaccaccaccagacaccaacgccatcctcacccaaatcctcgcccagcaggccaacatgatggctgctttcctccaccacatccaaaacccgccacaacataatgctccaccaccacccccacaacactctaaactcgccgagttcctccgcatccgtccgcctaccttctctagctccaataaccccgtggatgcgttggattggttgcatgccgtggggaaaaagttagacatcgtgcagtgcagcgatgaggagaaagtcatcttcgccgcccaccaactgcaggggcctgcatctctgtggtgggaccatttccaggctacgcagctagaggggcaacctattacttgggcccgcttcaccacgtctttccggagaacccatgtgcccgccggagtcatggcccttaagaaaagggaattccgagagttgaagcaaggcaaccgctccgtgatggagtacttgcatgagtttaacaacctggcctggtacgccccggaggatgttcgtgaagatgaggagaagcaagagaagttcttggcaggaatggaccctgagctgtccgtgcgtctggtctccggggactatccggatttccagcgtttggttgacaagagcatccgcttggaagccaagcagaaggaactggagtcgcacaagcgtcgcttggcgaatttccgcaaccaacggggggctaaccaaagggtccgctacaccaatccctatccagggggatcctcctcgcagcagcagcagcagcagcagcctcgctccgcgccccgacctcaattcgtggtgcgcgtcccacagccgcagcaacagcagagtcagcaagggactcgtgcgccccgtccccctacgccagctctgcagcctggtcaaggccacagggacgctcaaggtcagcagcgtctgtgcttcaactacttcgagcccgggcactttgcagctaaatgcccaaagacgaggcgccagcaaggccaagcgcctccccgctctaacaacggtggtaaggatgtcattcggggtcgtgtgaaccacgtgacggccgaggacgtgctgacaactccagacatcatcgttggtacgttcctcattcattccatccctgctaccattttgttcgactctggagcttcccactcgtttatatctgtgccattcgtggggagaaatcggttgggggtagaaaggcttaggaaccctctgctcatcaccacccctggaggggttatgacagcaaagtattatagccctgccgtttctatagaaattcagggaattcattttccctcggatctgattcttctagacaccaagaacttggatgtgatccttgggatgaattagttggctcaattccaaggagtagtgtattgtgcaagacgcactgtcactctgtaccgagggccggaacaaccggttgttttctttgcacccccaacctctgttggcagttcagaacttcatcagataagactgtcggaaatccccatcgtcagggagttcggtgacgtgtttccggaagaactacccggtatgccgccgaagcgagagattgagttccggatagatcttgctccaggaaccactcccctgtacaagcatccctaccgtatggcagcaaatgaactggccgaagttaagaaacagttggaagagttgaaagaaaaggggtatatacggccgagtacttccccctggggtgctcctgtgatttttgtggagaagaaagacaagacgaagaggaggtgcgttgactacagagctctcaatgaagttactatcaaaaacaagtaccctcttccccggatcgatgatctgttcgatcagcttaaaggtgccacggtattctccaagattgatcttcgttccggatatcaccagttgcgcatccgtgaagaagatatcccgaagaccgcattcaccacgtgatacggactgtatgaattcacggtgatgtcgttcggtttaaccaatgctcctgccttcttcatgaacttaatgaacaaagtgttcatggaatacttggataagtttgttgtggttttcattgacgacattctggtgtactcacaatcagaggaagaccatcagcaccatctccgtctggtgttgggaaagttgcggcaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaaattcgcagtttcttgggtttggcaggatactaccggaggttcatcgagaacttctccaaaatcgctcgacccatgacccagttgttgaagaaagaagagaaatttgtgtggagcccacaatgcgagaaggcgttccaaactctcaaggaaaagctggtttcctcgccggtgttaatcttaccggatactcgcaaggacttcatggtgtactgtgacgcttcacgccaaggactggggtgcgtgctcatgcaggaaggtcatgtggtagcctatgcctcacgccagctacggccccatgaaggcaactaccctacccatgatttggagttggccgctgtggttcatgctctaaaaatctggcggcattatctcatcgggaatcgctgcgaaatatatactgatcataagagtttgaaatacatattcactcagtcggatctgaatcttcggcagagaagatggttagagctcatcaaggattatgatgtgggaattcactatcatcctggtaaggccaacgtggtcgccgacgctctaagtcgaaaaagccattgcaacactcttgaagtccgtggcattccacccgaacttaatcaacagatggaagccctgaacctaagcatagttggtcgtagattcttggcaacgctggaagccaagcctaccttgctcgatcaaattcgcgaggctcagaagaatgatccggatatgcgtgaactcctcaagaatatgaaacagggtaaagccgctggtttcacagaggatgaacacggaaccctatggaacggaaatcggatatgtgttccagacgacagagaacttaaacagctgatacttcaggaagctcacgaaagtccttattccattcaccctggcagtacgaagatgtacttagacttgaaagggaaatactggtgggttagtatgaagcgggaaattgcagagttcgtggccctttgtgatgtgtgccagcatgtcaaggcagagcaccaacgaccggccgaacttctccaacctctccaagtaccagaatggaaatgggatgaaattgggatggatttcatcaccggacttccaaaaacccaaggcggatatgattctatatgggtagttgtggactgactaaccaaggtagctcggtttattcctgtgaagaccacctatggaggtaacaaactagccgagctctacttcgctaggatcgtgagtctccatggcattcctaagaaaattttatctgataggggaagccaattcacctctcacatttggaagaagctccaagaagagctgggtacccgattaaatttcagcaccgcgtatcacccgcagacagatggacagaccgagcgtctaaatcaggtcctagaagatatgcttcgcgcatgtgtcctagatttcaggaagacctgggataagagcctcccctatgccgagttctcctacaataacagctaccaagccagcatacaaatggcaccctatgaagcgttgtatggacgcaaatgccggacactgctattatgggaccaagttggggaaagccaagtgttcgggactgatatcctgagagaagctgaagctaaagtcagaaccattcgggataatctaaaggtggcacagtcccggcagaagagttatgcagataactgacgccgtaatctggaattcgcagtggacgattttgtgtaccttcgggtcacgccattgcgaggtgtacacaggtttcagacgaaagggaagctcgcacctcggtttgtgggtcctttccgtatcattgctcgacgcggggaagtcgcttaccagttggagctgcccgcctccttgggcaacgtgcatgatgtgttccatgtgtcgcaactcaagaaatgtcttcgagtgccatccgagcaggccgattcagagcaaattgaagttcgcgaagacttgacctacgtggaaaggccagtgaaaatgctggacaccatggagcgcaggaccaggaactgggtaatccgtttttgcaaggtccaatggagcaaccacgctgaggaagaaactacttgggagcgtgaagacgagatgaaagcaacccatcccgatctcttcgccagttcttccgaatctcggggtcgagattccgtttaaggggggtagctttgtcgcgtcccaaaacgactctaaaatacatcctctaaattatgcctagaataattaaaatccgtgtaaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtccccttcccctccctctctctctttggccggctcggcccatctccctccccctccctctcctctccccgcggcccatccggcctctccccgcacgcgcgccgctgacgggtgggcccgcccgccaccctcgctgacgggtggggcccacctgtcatccccttcctcccgccgctcccgccgcctcgcccgcgccctagcgccgccgccgtcctccccgcgtgaaatcaatagggtggaattattccccgtgattccttccccctttccccccaattttccctccctctctcccttggattcgtttgaaaaccctcccctaatcccgccggcgccattgatggagcccgagagcgccgcgccggtttccttcccctccggccgccctctcccccttccaaccctatataaaccctccccgcacctcctccgttcgtttccgcctctcgccgcccttcctcctcaccggaatcgatctcgcgccgtcgctctctctctccgccgtcgacgccgagcaccggtccgccgccgtcgtcgccccggaccacctcccacctcggcgccgcctccttcggcttcgccgcatcctcgccgacctcgtccacccctccgtttcgctcgtcgaccgccggagcaccgtcgaccccgtcgacccgagccgcaccgccgccttcctccgctccggccgcctttttcgtcgtcgccgtcgacctagggtgagccgtggaccgccgcttcttttcccccttcccttcccctctctcggccgccactccgccgcgccgcctcccgccggctgcgccggcttggccgccctcgggcgcgccgagtggctgccgcgtggggcccggccgtcagccgcccgcgcccttaggtgcggctgacgcgtgggacccacggcgccggccggtgtgagcccgggtgcacccggtccaccgtggaccgtaaggctgccgcgtgggtcccacccccatggacccggtccgcgtgccccctcccctcggctgacgcaataaacttttttttaaattaaaatttaaatgaggaaattcgcaaatattcatttaaagagcatataaacttcaaatggccataacttggccatatgaactcggaattggaccattcaagtctctaatttttccttaagaagtcaagaacccatttttgtgctttgttcctgcttgttatatggagttttttagagtaaaagacttttcttttccgttggtcatgtagacgctgcagcttcggaagatccgcttttcgtggaagttgaagccgacgtttgggaaagcgagcaaggcatgtcgcatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagagtaaacaaaaccccaactagtggatactctactcatggtaccactagtatcattttaggtagacgcttcgccgcttaattaggcaacattaggtggttttataactctagactttgggatactcttatcacctggacactatggaatggttggactattgtggaattagattcacacctcccccactattcaaaatcttcaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattctcaaaacctgcttaacaactaaaatgtggaatggttggcctgggttggcttgggacgagctgggacccagcgtcgggttgccagttcggtctgattcatcgtaggccttgggttaaggcaggttcgtgtgggttcacggccttgtttaataatatggtatagctctaggaccgtatttacaaaatagctttgagcaactaagtgtcttttaatgctgtttactgcaaaccctaaccctttatattataacccccttgtactcccttgcatttattctgcacttgtgggtgtgtcttgttgagtacggtggttgtactcagtgtcacgtcctgataaattcatcccgaaataaaaatcattttctaaaaggaataatagaattaattaaaattcggaaagaaattggcaaacactaaaatacgtacaagaaaaattcaaatgtggcccggagaatttttgttaaattctccttggtctaaaaagagccctcaaattttagtggaattttcagagcacaaataataattgagaagaaataaacaaagttaaaataattttataaaaagaaaatccctaaaagtcttctttccccccctttttccctcttgggccggctcggcccaactccctccctctctctcctctcccccgcggcccatcggcccctccccgcgcgcgcgctgctgacgggcgggcccgcccgccaccctcgctgacgggtggggcccacctgtcatcgcctacctcgcgccgcgtccgccgcccgcccgtgccctaacgccgccgccgccgccgaatctgccgcatcccgccgtccccgcgtgccataaagagggggaaatcactccccgtgattccctccctctttccccccactttcccctctctctctccctcggattcgcccggatttattcccaaaatcctcgccggcgtctttgatggagccgagatcgccgcgccggtttccttcctctccggccgccctctctcactctcgacgctatataatcgttcctcctgcttcgctcctccgtttccgccactcgccgcactctctccccgtcggattcgagctcgcgccgtcttcctctctctccgccgtcgccgccgagctccggttcgccgccgtcgtcgccccggacctcctcccgtctcggcgtcacctccttcggcttcgccgcgtccccgtcaacctcgtccaccccttcgtttcgcccgccgaccgtcggagcgccgccgtcctcgtcgatccgaaccgcgccgctaccttcctccgctccggtcgtcgtttccgccgtcctcgtcgtcccggggtgagccgaggaccgccgcttcgcttccctcttccctcccctctctcggccgccgctccgccgcgccgttggtcgccggcggcgaccatcggggcgcgggtgcgccgcctcccgtcggccgtgccggcgaggccgccttcgggcgcgccccgcggctgccaggtgggcccggccgtcagccgcccgcgcccgtgggtgcggctgacgcgtgggacccatggcgccggccggcgtcagccgcgtgcacccggtccaccgtggaccgagaggctgacgcgtgggccccactcccgtggacccggtccgcgcgccctctcccccggctgacgcaataaatgagtttttaattaaaatttaaatgaagaaattcgcaaatatccatttaaagagcatataaacttcaaatggccataacttggccatttgaactcggaattggaccgttcaagtctctaattttttccttaagaagtcaagaacccatttttgtgctttgtttctgcttgttatatggggtttagtagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttacaaaattatttttaatttaaattaatgcattatcgctttatttaaattcccgtgttatcactgttttatttagccatgcctatttacctttgttatgaccttattattattgctattgttattattaccttgttcaccctaggataaacaaaaccccaactagtgagtattctattcatggttccactagtatgaatttaggtagatgcttcgctgattaattaggcaatattaggtggttttataactttagactttgggaattctcatatcatttggacactttggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggggatggatgaagtcgggggtcgatggacattctccagggcaaatgaaggctacacgagctgcggcccggtagtcgagatgtcgtggcagagggttggtgccctgctgcttggggctcagtcctgcctgcctgtcccggaggttccggccgtaggcgggattgggtcggtactcttgtctatggctaggatgggttggaaactatgtcacgtcgtccgtctgtataccgtggtggtatgtggcacgtggttgcacgtgaggaagatgtgtcttgtgggtaaagatgtacacctctgatcagagtaaaacctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgtttaataatactgtgtagctctaggatcgtctttataaaatggctatgggcaactaagtgacttttaaatgctgtttactgcaaaacttaacccctatattattatccccttgtactcccttgcattaattatgcatctgccggtgtggcttgctgagtactgtggttgtactcattcttgctcaatctttcccctcttcagtaagagaagctttggagaagatgtcttaggtggagtcctggcttaaaccccagtggagcgcctgtgaagatggagccgtaggcccgctagtccgctggtgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttacaaataaaactatttgcgaaagttcctttttctccttcccgtaatgctatttgcaaaatggtttactcttttcttccttcttcaaatttcaactagtactagatggtcagctttgcgaagaagaagatgtcgtcagttgtttgccgaagctccagaagactgcaggatctgctagcgaagtataggaagcagtgaagccagctgtgaaggagtgaagatcttgggaacccatcgtagaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagcctaacatacatcataacagcaaaagacttagatctgttaaggtcctatccttagttcctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcagatacaacctcaagtgcagttggaggcagtccaagcactcacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagaaaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcggatgatgaagatgagaagtctccccaaggtttcaaccagaataaaatggaacgtaaggcatgctctcgttgtggagaaatcggtcatgttgccagctcgtgtgccactacatgcgttcattgtgaggaagaccatccacccgacaggtgtccaacgagcaggatcacctgtttcttctgtgaaggaactgatcatgtaccaaaagattgtcaatccagttttctgctgacgaagaagatggccaaccaacccgccagttccaacggagagaagcatcaaggcaacacaaatcctcgccaagattacagtttcagcctaactccagtgccaggacagaggaatcaaaatgagaaaagaaaatgccgagtccgggaagatatctgttgcttcaattgtcaaggaatgggtcatttcaccgacaagtgcccaaaaccgagagacatagctgccagcacgtcagtccacgcaactccctgcaatcagaagcttgctcctcagcgaattgtcatccatgcatcccgaagcagtcctatagcccgcgttgcaacagctccaactccagcgagtgcattaccacaaggtgtcaatgctcaatttcagccccagccaccggttgacaagacagaggccagtatcggcattgtacctttggatgttccagcacagccgccaagaaatcaagtacaagatgaagaacccgagcgtaagaaagttatttacaactgtagtacctgttaaggaagcagacatgccaatcgccaagtggtcactggagcaaatgcagtacctgttaagcctagcgctagtcagaagcaaccataatactcttatatcagtgttcaaatacttttgttttatagttgttccccgtcaatcatgtaatgacagagaaacatgagattatgaaggagtttgataagtttatgaaggatccatgttaagattgcaagtgctgtgagttgtgtacattttgttgttgattagggagacctagggtctcatttccgtaaactcataatctattatgaatcaaataacctagcgattgatggcgaagaaaatcaagtgattaacccaagagacatttgtttggactaagagtttcagatgtgtcttcttcggatcaaaggcctgcacccgttgtggagaaattggacacgttgctagcatgtgtctcacactctgcactcactatgaagaagaccatccaccaggggagtgtcccactcgcaaggtgacatgttttctgtgcgaaggaacaaaccatgtgcccaaggattgccaactcagtgtgttgttgaccaagaccgcagaaatccaacgaacaaccctacgattgtctcgtcagctagtcagctccaacaacaacatcgatgatatcatccacagcaccaatgctcctcttgctccacctaactctgcaataaatcatggcaataataccttcagcactaaccattctctgcaccgacggcctcagcaaagaattgtcgtcgatggaagaagttgtgtctctccccgacctactccaggccgagcgaagggcaatcaacctcaggagggtgataccaagcagaagaccgttattcgcctcaaccagcaatcagaaggaagcttctcctgtgaatgatagcaatatgcagtcccatcacatcatcacagaaccaatcaaggatgatgcagtcactagaacaatgccagctatacctctccagaatcagaatgagtagccatgtttgtgattttcagttcgctacttatcactgtaatcgaaagtttgcagcaatcatgtaataaataaatatattcatgtctataaacagtgagcttgctatgtttatggataattcctgttgaggatacaatgtaccgatgttaagcaccttccctttttgtttaaggcagggccttgtattcgtataataagggagaaatgtgtaatacagacaagttctaagaggattcttttggaagatgcggatatgtgatcatgtgtataattgtttactgacaaaggagacctagggtctcgtgtcagaggaactatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtatccgccatgcctctacattgataagttcggatatacctgcaaacagttaagaagatccaggagacatcaatatttgagaacatagtagtcgatggttggtgattagtctatcaggtatcagaaaaggggtcaaaggtgatatggcagaagaacaatttggatgctccccatctcgaggaagcactaaagatgatcatcggcaattaaaccctagtggcatagatacagatagcaagcaatgtatttccctgaaggtagtcagtgcagctttttgacaaaccacatcaaggtttcactgaaaggcagcaagccaaaggacgtcatcgtccccagaagcgtccgcaatccacattaaagaataccacctgttagagataagccgaaagaagattgataaaagagattggcaaagatgttctctagcatgaaagaagtaggccgaaagg

SEQ ID NO: 60620 - DNA, 6615 bp, Oryza sativa
gttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgtttaataatactgtgtagctctaggatcgtctttataaaatggctttgggcaactaagtgacttttaaatgctgtttactgcaaaacttaacccctatattattatccccttgtactcccttgcattaattatgcatctgccggtgtggcttgctgagtactgtggttgtactcattcttgctcaatctttcccctcttcagtaagagaagctttggagaagatgtcttaggtggagtcctggcttataccccagtggagcgcctgtgaagatggagccgtaggcccgctagtccgctgctgtttatttttgattgtcaggcctgaagcgcctttgtaataatgtaaattttatcgatataataaagatgtgtcttttatatcatgtttgtgtggtgtaccccggcttttcctgggacggggattaatacactagcgttcgggaaaaggcaattttcccggtcgcgacactcagtcttgctcaattttttcccaaacccagaagaggagttcctggaagatgaaggctttggtgtctagctcgtgcctgccgtcaagtgcctgtggtcgtcgccctaatcttccactgtttcccgtttgtctttgtgtgtgctgggccttcgccgcccatgtaataaattaactatttacggttccgcttgttaaactctgaactgtatcaacttttggtgtaccttgcctcctgggacaaggaataatgcacgcacgtaaggaacgcccgttgggttatttccggtcgtgacagcgatggaatgcgcgcgcggcgacgggatggcgacggcgacggcgcggcagtggtggtgcacggcgcgaggcggcgatgggatgcacgcgcggcgcgaggcgggacgcgacggcgcgacagcggcgatgggatggcgacggcgacaggcggcgatggcgacgacggcgcggcggcaggcgacgatggcgacggcgcgcggcggctcgggacgcgaggcggccaggcgcgacgggcggcggcgcgtggtgacggtggcgacagagagagggggaaagaggaggagctgggttaggggaccacgtcgaacacctggcggccgatgaatagtgtctcttcctatttaatccccattttaccctatttcttgtgtaaatttgattctataaatcctagattttgtgtaaatgaagtttactcaatatttgtgttattccaaccaatggatttactctagattaatattagtcattttttttatttatataatttatttgaatctttaattagggttaattcttattccatcgcatttaaattcaattgatccaaatatggtcgcgacaatattttatttatttctatccacacctaatctttattttaaattatatttattttaccaatttgtttttagggtttattcctacttaactattctttactcatgattaatgaacttcgaaatcaaatcaaaataaaataggcaaacaagatcggcatgatgcaattaatttaaaaagtttttgaaaatccgtatttttagagttttgatttttgccggtcgaattttcagggtgttacaccgggagaaccccgatgtgttcccagacgatttacctggtataccgcctaaaagggatatagagttcagaatagatttggtaccaggaacaactccgatccataaacgaccttatggaatggcagccaatgaattagcagaagtcaagagacaagtagatgatctgcttcagaaaggatacatcagaccgagttcatctccatggggagctccggttatttttgtggaaaagaaagatcatacccagaggatgtgtgtggactatcatgcactaaatgatgtgactatcaagaataagtacccgctgcccagaattgatgatttgtttgatcagcttaaaggtgccaccgttttctccaagatagatctccgatcagggtatcaccagttgagaatcaaagaggaagatatacctaagacggcttttaccactaggtatgggttgtttgaatgtactgttatgtcttttggacttaccaatgcccccgctttcttcatgaacttgatgaataaggtatttatggaatacctagacaagttcgtggtggtctttattgatgacattcttatctactcctgaaccaaagaagagcatgaagaacatcttcgccttgcactagagaagctacgagaacatcaattgtatgccaagtttagcaagtgtgaattttggttgtctgaagtgaagttccttggtcacgtcatctcagccggaggagttgccgttgatcctagtaatgtggaatccataaccaactagaaacaaccaaagacaatctcagagattcgcagtttcctgggtcttgtaggttattaccggaggtttatagagaatttctccaagattgctaagcccattacacggctgcttcagaaagatgtgaagtacaagtggtcagaagaatgtgagcagagttttcaagagttgaaaagtcgcttaatatcagcacccattttgattttgcctgatccaaagaagggtttccaagtgtattgcgatgcatctaagcttggcttaggttgtgttctgatgcaagatgggaaagtggttgcctatgcatctcgtcagttacatccgcatgagaagaactaccctactcatgatcttgagttagctgcagtggttcatgcgttgaagatttggcgtcattatcttttcggtactcgtacagaggtgtacaccgatcataagagtttaaagtatatctttactcagccggatctgaacatgagacaacggagatggttggaattaattaaggattataacatgggaattcattatcaccagggaaaggctaatgttgtagcagatgctcttagcaggaaaggctattgcaatgctacggaaggacgacagttgccattggagttatgcaaggaatttgaaagattaaatttgggaattgtcagtagtggtttcgttgcagccttagaagcaaagcccactctaattgatcaagttagagaagctcaaattaacgaccctgatgttcaagaaattaagaagaatatgagaagaggaaaagctatcggtttcttggaagacgagcaaggaactgtatggttgggtgagaggatctgtgtccccgacaacaaagatttaaaagatgcaattctggaagaagctcatgatactttatactccattcaccctggtagtaccaagatgtaccaagatctcaaggaaggattttggtgggcaagtatgaagcgtgagatagcagaatatgtagcagtatgtgatgtttgtcagtgagtaaaggcagaacatcagaaacccgcaggtttgttgcagcctttgaagataccagaatggaagtgggaggaaatcggtatggatttcatcactggcctacccagaacgtcgtcaggccatgactctatttgggtaatagtcgacagacttaccaaagtggctcatttcatcccagtaaagacaacatattccggaagtcggttggcagaattgtatatggcaaggattgtgtgtttgcatggcgttcctaagaaaatagtgtccgatcgaggtagtcagtttacttcaaagttttggaagaaacttcaagaagagatgggttataagctgaacttcagtactgcttatcatccgcagacagacggacaaaccgaaagggtaaatcagattttggaagacatgttgagagcttgtgctttagacttcggtggaagttgggataagaatctaccttatgcggaattctcgtacaacaacagttatcaaactagtcttcagatggctccttacgaagcactgtatggtcggaagtgccgtactccgcttttgtgggatcaaacgggagaacgtcaggttttcgggactgatatcctaagggaagcagaagagaaggtaaagatcattcaagaaagattgcgtgtggcatagtctcgccataagagttatgctgacaatcgccgcagagatttgagttttgaagaaggagattatgtgtaccttcgtgtcacgcctcttcgaggggttcatcgttttcacaccaaaggaaaattggcaccgcgtttcatgggaccttacaagattgtcagtagaagaggagaggtcgcttatcagttggagttacctcaatctttggcaggagtccatgatgtgttccatgtgtcacagttgaaaacgtgtttaagggtacccaccgaggaagctagtcttgaacagatagaaatctaagaggatctgacatatgttgagaaaccaatccgtatcttggaaacagatgagagaagaaccaggaatcgagttatccgtttttgtaaagttcaatggagtaatcactcggaagaagaatcaacttgggaacgagaagatgaattaaagtcagctcatccgcatctgttcgccagttcttccaaatctcgaggacgagattccgtttaagggggtaggtttgtcataccctaaaaatcctaaatatataaattgttgtctaaattggaattattagaatttattttaaaagcctagaagagaagatcttattttaattaataaattccaatataaaatggggccagataaaatttcattaaatactttgcttaattctataattcctagatttttctgggatttatttgagctaaggaagtatttttaataaatagaattgtatttaatgaataatttaaattgaaaaaggtttttaaaatcctcttttggctttgggccgaaagtcggcccaaaaccttctctctctctccccggcccaagccggcccagtccgcccgcgacaaccgcgtgcgcgcgccctcggacgctgactggtagggcccgcctgtcaggtcgtcgtctacctccggccgcccgccgcccgagccctagcgccacgccgccgcaatctccttccaaatccggccgcccctttctgtttccgatgaaattaatagaggggaaatgatccccgggatcccctctatcttttctcttatggaatcgtcggctaatttcgtttggaaatccgtggattcgatctcgaatcggattcatctctctccccaaaccctagaccttccttcgccgtcgccagtcgctgtgggcctccgacgccgcctccttgcccctataaaaggacccccggtgtctccgctacctaccgccaccctcgccttcgcctctcgtcgcccctagagccctagcctcatgcagcctagcgtcaccgtcccgtcgccgccgtcgctccagccgtgcgccgccgtcgcttcggtcgtcgccgtcgctcggggaggtcaccattgtggtcgccaagtcgtcgcagtccttgtccgcccctccgccgtcgctgtcgaccgacggatccccgtcgccgtcgtcaagccgaagagcgccgccgcttcttcctcgtcgccgacgtcgtccggtcaccgtccgtcgccgtttaggtcatcagtgagttcgccgcgtcgcccgcattgttttggtgctctctgttcgcatcgccgcgccgtcgttcgccgacgggcatgcgtgcccgagtcgtcgccagtgatgacgtcactgctgacgtcatcgttgtcgttccccctggcccagtcatggaccgatggatcttggccgtctgttttggatggatcaatctcggccgttcgtttccgtgagccgctgctgtgcacccggttcaccgcgaaccctagccactgacgcaataaacccctttttccttttcaaaaataattcattattgcgtcataattcaattaaaatctaaataaatgatttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgttttgctcctttctatttagattccgacatttccggagagtccgttttcgcagcagaagaatttgaagagttccaaggccagcaaggcaagtcacacagatcccaaacaaccctttgagcatgttgatcccgtttaaagttgttgtttttattcaactattacatttattatcgaatgtcattgggtggaattaacctattgtttgttatagcccttttgttcttgattactttattgcttgataccttgggttattataacttgactagttgagctttatatattggttcagctatatattagatatgattgcttagccatgcttagaaactttagcacactattgggataacttataattcactattatttaatgctggcttaatgatagctcacgatggtcaatcgtgattggttaattaattaaattgccaactaaaacttgataatggtgggttgtg

SEQ ID NO: 60621 - DNA, 1185 bp, Oryza sativa
  unsure (1)..(1185): unsure at all n locations
tccgacaccagcacgcacggcggcttctccgtgcctcgccgcgccgccgaggactgcttcccgccgctggtacgggacgatatcgattgggacaagctacctcaccgtgatctgtttgattgcttgtgtggtgactctgttcagcttggcgcctgcaggactacagcctgcagaggccattccaggagctcgtggcaaaggatctgcacggcacggaatggaggttcagacatatctatcgaggtgattcgccggtttagcctatcttggtgactgggatatcagccgtactatcactaactaccatatatatgtcatacagcttggttgttaggcttctccctgggaacatgggattaattttcttaatgcgtgagagaacctagtaacctacgggctgtacagtcctacatcttcctatagtacatcacaggctgtttaggttgaactactgtactttgttcaccgaataacgcattagtatatatatgttttttcttttagtaagattatccaggtctcctttttagatacatctatcatgtctaggtattggaagcgagatggctgtccagtttagacgaaacaagcaaaccaaactgtaacttggctggctggatgagataaaaatgagcaaactatgctattttttctcattaggctctgctcacttactctgggagtgttttcaataaattattttaatttatgcatagactacctatttctacagctattgcgacataatctctaatagttaagctaattgcaatttggaggagtcttgagaaaattatggtccatgaatatctcataggtctgcctctaattgttacaggccaaccacggaggcaccttttaaccactggatggagcgggtttatcaacaagaagaagctagtatctggggatgcagtgctattcctcaggtaggcctatagctcatgtgctcatgaaccactaactcgaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60622 - DNA, 875 bp, Oryza sativa
gggatttttttaaaaaaaaacaaggtaatcagtaaccatcagttacacactgaaatatactcttacgcgtcagaggatatgtatttgttttttctgatcatatgattatataaaatattgaataattcctcgatttcatgttacataatgtgttggactgtaaatagattaatgcaaggacgtatgtatatgttccatataagtgtccaatttatatatatatattagtgaatttagatgagaaatggatatgccgaaacatcttatagtgtgaataaacggagtagaatataagcggttttgaggttagagtgaaaatgatatatattactctataaagtatttcaaaagcagatttctagacaaaatctacccaagataattatcaccggtggagaaattgtcttcactcccggtttgtaaccccccatagtcccggtttcccaaccgggactacgaatccgggactaaagatcgctatctttagtcccgggtgaaataaccgggagtaaagatgtcccggttggtaaataaagagaggatagggacaataccggatggtccccttttctttttttttgttacttttttattttctcacgaatcggatggcatgcacatcccaaatcaaacctcaaatccccaaataaagtaacatcccaaatccacatcacaaatcttaaagttattatacacacaaatctaaaacatcacaaatcctaaaaaatttacatacaaatcaaatacatcacatattatacatctcaaatccatacaatgaatcacaaaattacatctcagtgaatcacaaaatatcaaaaaaaaagagagaacaagtaactttaggggagggaggacgtttgtgcgcatgtgct

SEQ ID NO: 60623 - DNA, 6976 bp, Oryza sativa
ccttttctgaaaatgacctgccttgatggtattctattggaacgctgcccttctcaaggtatgttacatagattgctcatggtcaaatagttttaccaaatgctgtttaaacttaaactaaaattgagattgctccgcaggttcatacaggcttccagtttagattagatggatgctagttctatgtacaggactctttatcttgattcttcttaactcaatttacacatggatttctatggtagagatgatacagtcgatcgaatgggttgtcaatttggtttatattcatggttggagatttggtagcttattagaaattttgtagcgaaacagagctgtacaaactttatcgtgaatgcacctgcttatgccgtgcgtagatctcttgaggtggctgccctttttgttgtaaagtttattgtttgctgtttgcgcatacctgcacatacaccttcattgtggtgagatagtaattttgtactcccaactgtcattagaaatgccatttgttggctcgttcgagcatcagcatgctgaatccgaatggttctacatctatctggtcaatgtgttttgttcccgctgatggctatgctgcgcaggttttatacaacgtaccgttatcgtaaacctcttccgaggtattttgtcggttttcatgaaaaactggtgaaatttggataaattttgtcaataagccgggttaaaacctcaaaatcccgaaaaccgcggttttctgacagtgacacgtataactaaatcttgggcttgccccgccgctcgtgttcacaattatgcgtgtgcggagctgtcgtttcctcttctcaagtcattgccttatattttcctcgtttttcagcaactagattggtaagatgctcgtttcaccactggaacgagtttttttagttatttcgtgctattttaaatttcgtactgattgaggctatccgccgctgcaacgattgacagcggaagttataatttccttctgcccatcgacatcatttgctatccactaaccctcgaagcacaataatgcaatccagcgatctctgttattttatgctaccttcgcagggttgaacttgaacctgagggcgcccacggagctaaactgagccttttgacacaggtaacggcattagctctcacaggtgcactcacaagtgataaggttacagttctcgaatggaattttacctctaagcacttgagatgcagatgcagataaccaagacaatttggcacttcgatgattttgcctactctataaagtacgagatgtgatctgagtacgatatgcgcatatccttggtcatccacgttgcaggccgggtcagtcagcgcggaattccgcggcagccgtcgtccacacaaagagcaacgctattgcggaatcgcaagggcagatcatgaaaagaaagtagagactcggtcccaagactccaagcacagcatttttgtgtgtttcacatcagtatctgcccaattgctaaccctggagacatttttgctgagttgattcgatataaacggtgcttctgcatttgcctttgcattgtacaacatgtaacagctttatgtttgtacaaaccaatgttcctagacagtatggagaggtacaacaacgagttacagtcaaggtgtggctacccgttaattcataaaaagcaatggtacagggcagctgacataaattaaggtgtgtatcatgcccaaatcaacttcgcgctttactgaagcgaaagaacaacggggcaccagaagcacatccatctcactgttgacgaatcagattcaccaaatcaggtggaacattgcgcttttatgggaaccagcgagaggaaacatgcatctagcaagaaaaactagggctacttgaacagtcagtcttcaaataaagtggagagcaccaggccttgcacaaaggttgctctgtcagtggcttgtttccgcttttgttccctttcctcactcgtgagcgatgagtcgatcctgccatggaaaaaataaatatttcatatttgcatatctcttaaggagtttataagctgctggtttgaaacatactaactgagcacatatatagacctgaatgctctactttacctaattggtctgaccatctgaatgctaggggaaacggcaagtattatgtagacctttatagttgtgaatatggtcaatcttagagctacttaacaattcattgacataatatggactgttttcatcaaatgtaaaagcgtacagctagtgaacagtctaaaaaatcacaaggacacaactgtttaactggtggttgatagtctttctgacatatgtaacaaaattgacagtaccttctcagacaagaaggtaactgtgaacagtttgtgaaagtgctagctgaaaaataaatcatagagcatggcaggacatgggaactaattggctaatactcaatagtgtttgctatgctttccagacaaactaggatgattcttgaagtaatgctgttagtagtggggttttaggtggaagaatatcaggccactaatgtgattcggctgagcagtgtaaatatatataccttgattcccatggctgagcaggagtatccttatgaattgatgtatcatcaggaataggaactggtgcttttgatcgttcctctgaatccaatgttgagaagcccaggccaaacgaagaaagcagaggatcagcagaaatgtttgtggcagtagtgttgcttcttcgctgacgatgaccacctcctagaagtgcctgtaactgagcatcccgcagatctcggctcagtaaagaaagtgcctggctctcgggaatatcgaatctgcgcatcctgcgaccactctgtacatcacaaataattttgaaaaaggaatcagaacattcctaaataattaagaaaatttatcaaagaattagcatatgcttgtgcaacagaataggtatggaaggagattaaccttgaacaagtaaccatgttgcatggtgatatgatttaacatatctcttgtaatcttttcgaagcagatgggacagggctgaaagcaaagcaaagcaaataaatcaggagaagaacacaatgcacattttatatgcacaatatatgaacataaggtgctgatttaatatactttgaaccaatgtgcttatttgatactaaacttagcgaaagattcaaataagcacaatggttatttcagattctaggatttctgcagttaacatctcgaacttcagacgagattataacattaaaagtatatatatggcattctcaaacacctctgtttcactagaataaaatgaatccaaatcttaaaaatggaccccacacaacagttcgagtcttttaaatctaaatcacattaccatcattaacttttctaggttattttgtgccattgcaaaatcaactcctgttgctgaagttagatgaataacagaggattacgtttttaagtcatggtattcatgaacatttagtttatgacaactgagcagctgtccaccaagagtagggtgcacagtcggcgcagtgacataagtactatagtggcaatcaaataaaaaggaaattagctaccttgtttacagaagtaggccttgaaatagaacacacaactacaagctagagcagtcaactacagaagtgaacaatgctggctactgatttaaaaccttcagtcaagcataatctacagttcttataagaaatatataattatccttgcccttaaaactacaacacaacttccctacctacgaatcacaaaatcacaatttcccggtccaaatcgctagtgttttcagccaagttctgaatccataagcttatgctccgtagttgactgatactatacagataccaaagattctacctctttgctcacaaactattgcaagccaagccatagagaggcaagaactcaaggctagaggagctttgcataatactatcatctcaagaattttggctatttcaagaagataccccgcaagtttgctactaccgcaactccacaagtagcccaaatattgagttcattcgccaagtcaacccctaaagctacagcgttcctactaatcgaacaaaaggagcagctttgccagactttgtgcgtcatgtcatcagagcgtcagagcaaggagccctgcggcgcagggcatggcggcgaggagctcaccgaggtgtggggctcgtaggggtggtcctcctcgaggtgggcgcagagggacgcgatgtcgtggtcctcgtagcagtaggggcaggccacgtccggccacgtcgcctcctccagctgcatctccagctccagctccatgccctcgccatcatcctccatctccatctccacctcctccattccaatccccgccatatctgcgcgcccaatccaacgaatcaaatcacaaatcagcaacagcaacagcagaaagccaaacaaagattcgagggaaaagtcgagatggccgcataccgtcgacgtgaccgagctgcgccgcgtagaaccgcttggcggcggcgaggctcgagatccagtgctccgagtccatgattccctgctgctgctggtacaaccaccaccccgcgttcgagcttaaggctagaccccctctcaagctccctcttcagcctccctaatataccggttccgtgctccgagtccgagtccgtctccctcacctgctcgagcttcgtcggatcgccgatcgagtcggacctgaatgaatcggagactttgccctcgggaagcctctcgtgattttctccgaagggttgtttgtttctaatccctcaccctccctctgcttaagccttgtggagattttttgatggagcggcggaggaagggaaagaggaggaggagacggcgaagcttcttatcggaaaggcgaggaagcagcagcgggtgggaagaaatggtgcgcgccgtgggattttttttatttttcctttcctttttttttctctctcttttcgctccaccggccgccgtcgagtcagcgccgggcgtgccaccaaacggcaggcgggctccggcctctcctcccataccacacgccacgccaatgacgggtggggcacgcgcgcgcgcgggccccggttgtcggtggacgtcgtgcgtgtcgcggtgatcgcgtcccgcgggaaaccgcgtgggtggggtggagggacgcgcgggcggtagcggtggtgacgcgggcgcggccgtgcgggcgggtgcgggtgcgcgttgcgcgtgtggttggtttcggttcgtgggggggatcgcttgcgcttgcggggttggggtggaggtggagccgtgccccgattgcctcgcgtgggggagccctttcgtttcttttttggtgtggaaacgacggctcggcgcggcgattcggtcgagcggacggcgggcgaggggggttggctggccggttgggtactttgggtgggggggcgtggggtcggtcagtggggcggccgcgcgggacccccgcggcgcacgggagaaatccacgggaaatggccgcaaacgcgcgtttttctgcgtggcgtctgtcctctgtcgtccttcacctgcttgtgtcgctggcgccgccgtgggacgtaacacggcacggtttttagaaggccggttcgtcgcggcggcatccgatccgaaacgcgagaattcgttaagcttttggttcgagagagagccaacaaccaaattgagccgagcaggttggccggtatgcgcaaacgacgcgcagggtattacttaaaaaggattaaaggttgcttagagcgtttgaataacttcttctctggacaggaccttgacttgatcgatttttcagctaccctaatctgatgggttcaaccttaccagattggattattatattaatatgacgactcaaaacggtctttgtcctataatagttgttgtatgatgaaacgcatcaatcgttgtacgggtggttgtgcaggagtagctctaattctcgtcatcattgggcaacagaagttgcttttgcttagtagcacctttgttcccaaacatttgccaccagctgttatttctattcagattttgacggatatatttatttatagtactgcaacaaatctatcaaattttttaataaattaaccactaaggtacgttacatgctaaatgtaaccacctgatttgtgtacatcaaatatgatttttatagtcaaagttaaaacaacatatatcaatggtgtcaagcactctctccattacaaaataacttgcattcaaaattcatttcaaaataagtgatcattttttaagtatgtactagtaaatagtagagaaacgtctaggggtctttgttctagctccacaaggtggtgggctagtcggtctgggtttaaagcctcctcccttctaattatttgatactaggtcatttcctaatattcacgtttttttactagtaaatagtaatgtggaggtatatatatagtacattgaaaacttttttctcataagaaataaacaaatatgttttcctagtaaaaagtaatgtggaggtatatatatagtactacattgaaaacatttttctcacaagaaataaacaaatatgttttcagattcttttcagctttttcaccgaatcatcatcgtggtctcgtggattataaaagaacctttttttagtcacttatccctccttcctatttcctatatagttggtacccactagagtatttactcctataaagcttgctccatattaatccacgttatcagcacctttaaatcgttcaatctaatcccatggttttttctgacggcacgttacatcggcttaatactgaacgatacgtcatcggcaacccagccgatcggctgttgtttatagatttaactttgtttcatctttggtttcttgttggttgcaggatcaaaccaaatagcacgctcaaaactcgaaagcaattctttggacctgcact

SEQ ID NO: 60624 - DNA, 1009 bp, Oryza sativa
aaatctatcctgatgaatgggagttctttgtagaacgtatgaagcgtgaggggatgtctaatatcaaggagctgtacagtgagaagcagaggctgagagatctccggcactgggtttcatacagggggcagacactatcacgtactgtgaggggaatgatgtactactatgaagctctcaagatgctgacatttcttgattctgcatctgaacatgacttacggactggatcccgggagcttgctactatgggctcatcaaggataggatcttcgagacgggaagtgggttctgatgggtcaggatattacagcaggacatcttcgtcacgtgcattgagcagggcaagcagtagtgtaagcaccttatttaaaggcagcgagtatgggactgtccttatgaaatacacttatgtggttgcatgccagatttacggtcagcagaaagctaagaatgaccctcatgcttttgagattttagagctaatgaagaattatgaagcactacgtgttgcctatgttgatgaaaagaactccaatggtggtgaaacagaatatttctctgtccttgtgaaatatgatcagcaactgcagcgggaggttgagatttatcgtgttaagttgcctggaccactgaagcttggtgaaggcaaaccagagaaccaaaatcatgcactcatcttcacaaggggtgatgctgtccaaactattgatatgaaccaagacaactattttgaagaagctctcaagatgagaaatctgctagaggagttcaatcgccattatggaattcgcaagccaaaaatccttggggttcgggaacatgttttcactggttctgtgtcttctctagcttggttcatgtctgcccaggaaacaagttttgttactctggggcagcgtgttctggcagatccactgaaggtccgaatgcattatggccatccagatgtctttgatcgtctttggttcttgggacgaggtggtatcagtaaagcatcaagagttat

SEQ ID NO: 60625 - DNA, 5781 bp, Oryza sativa
tcctgcagccccaaggggatatttcccaccagggaatgcatccccatctttattcccgtccccaccaactgcaatgggaacatcctcccatagctccttacccgcttaaaaacatatttatactttgatatatattatgtcaatatattagtagatatctattaatccatatgacaagaatacattattgtccacattcactaatcatagcacgctaaaacatgtatagataccacatggctaccatccctctttcctaataggagaatttccataggaaagggatgtgggcattgtcatccctaaaggctagaatggacatatatacaagtaggatgaaatctttgcttgtagagagagaatgagaaaaatgttttttctttaacgagtacggaattggtttcttcgtagctttcatatatccaaaagtcacggcttcgtgaaaacctgacgagaaaatattaattacggacatgacttgttgaaaacaattggaaactagtataaaatctacttcggttgaaagcaacacaaaatttcacatacaccggacgcaatagtgatttcaatgccttccttttcacttcacactatgaaaaaaatatggtccatgcaaagtaaccgattcaatatatattctagacaaaaagaaaattattttacagtactatatacatatattcttgaacatttttctgattaagacgcaaaatttacaacaattctgttagcatgtgttttaaactatgaaacgatacgtttcgtgcaaaaacttttcatataaatgttactctaaaacatcaataaagccattttaaattgtataataattaaaactcaattaataatatgctaatttttttcgttttacgtgtccttaatccttattttcatccgttataaacggggcctcaaagtcaccataagtaggcacgataaggttgtatatttccgaaaggagaacatgagttctagatccgtttggacgcagaaatattctaggttgtttttccctgtccatgcatgttgcctttatagagaaaagaaaaagaaaagaagaagaaggcttgctcggtcagcccactcaaccgccttggctggattctctgtcccatcggcgtggccctatcatcacctgtgcttgggacggtgccgcggtgggattcgccatcgaacgggcacggcgtgcgcgtaccgcagcagcgaaacttcaaaacctggagggcgaagccgataaacgcccatgtgcccgtccgcccgcacgtcggcagcggaaaaaggctggaaagccggaaaaagccgttgaacgtcaaaggagacgaccgttaacgtggcataccgaatttctagtactacttgcgtgctagtagtagtaactaacgtggacgtggtattaccgaatttcgccatgacctgggggtgagtacctgacagttggactcgtgactcgtctgcgcggagaagcatctgcctgctctgaggtccagatccggcacgaccggcctgggcacttccatgtgacccggccgcggggccctccacggtttgcctcgtatagcactctcctcgcttgccgtatgctcctgcgtgtacttgtccgttgtgtagtacttaggcggtgtttggttggagggactaaagtggggctaaactttagttctctcataaaaacataagttcctacatagggacttgtacttttgtgagatggactaaatttagttcctaattcccaaacacccccttacatgtaaagggcatgtacaatgaaggccacaagcataagtggttttaagacgtacatcacgtaggatagaaccatacaaagatcatactgcccggtgaaaaccactccaaaacgtatcttgtatttcagtctctgtttatttatatatcagcccttatgttgtatgttattatcaaacctattaaaactttatattttagactctataacaaccaaaataagtacatactatgcacccttaaacactatgcggacccattgtcagcctcttccccctctctttttaattctctctccctctttccccctctctctcttgagccatctctctccctctctcatttgccatatttgccggcgagctccccatctcggtggcggatccgggttctcgacggcggatccggacgcgggctcgacgctgccgtcctcctcccccacgacggtgcggacgagctcgccgacggcatggcgagcttggcggtggcgggctcgctggttctggcggcggggccacaacgcgatagttcctctccccctcccttcttcgcgagcgtcggcggcggatccggacgcgggctcgacgccgccgtcctcctcctcccacgacggcgcggacgagctcgccgacggcatggcgagcttggcggtggcgggctcaccggatctggcggcgggtcctctccccctcccttcttcgcgagcgtcagcgtcgggaagtagcggtggcggcggatctgacaaccggacgaggcgacgcacggggctccagctctgccaccgcgtggcctcgggccgtggcttcgttcttcctgggctcagacgcggcgcttcgagcggttcctccgcaagcgcggaatcggtaatgcggagccatggtccccgctgccacgggtacacgcgtccgatatagagccgtgagaccatgagcaagagccacacgttgtaaatggcctaagactacgaagggtatgcttgtggcatggcagccagcgaaccataataacgggacccttatgttgttattatggtgatcagtattttcttatgttgttattttttaatgctataaaaatcatataacttgatttattttgcatcgaacttttgcaataataacatcgagttctaaagatttgtaaattcatcgtgaaaaaaattgtggtcaaaactcgtataattcagtcactactaatagttattaaaaaagatagatgtagcatgagatatggagtagttatgtaatattattagggtgcttttgattaggctaaaacgagaagagttattagcacataattaatttaatattaaataataaaaacttaaaaatattttttttaaaaaaaaagttattatagcagttcggtaagtgtaattaccaaaaacaatgtagtagccaactcaagaaactgattcaaactctagatgaatctattactactacgtcaacagtaagaaaacatggtatctttgttgctttcaaagttaaaaaaaaaagtccatcttgattcttgattactaaaatatccgaataataatggcaaaacctgtctctcaaatcctaataccagattaatcactcccctaagaagaagaattagagagatttattccacacctttaaatatggaaaatggaaatggaaacaattttcttgtatacagaccattttccaaattttaccatatatttacagaaactactattcttttatattatgttaattaccacatttttaagtatgccaaaatctatggtacatttctttctttgacatatagttagaagcccatgaactcttcaaccaaatccctatatggaatactcctacaaggttaaaaaaagataatctatagtttacatagtgtaacattcaatttatttcatcatattatatacttgtacaaagttaaatgtgtgattttagagtttaatattttttatatttattacatgtttttaatcgatatcgacatgtttctgtctgtataattccgtttccggctttccgatattttgaatttcgtttgtatttctagctgtacggttttcaactctattttcgagaaaaatgtgattatggaaatggttgaaacgttttcggaccgttttcaaccctatcgggatgaacccctctctccatctcccatgcaaacattaagtacacaaataaaatagtttcagcgaaaaatgaagggaatcatgcagtaacccatactcctatgccagattcataagttgttcgggaagcacacggcctccgaggtttaatacatgtaacctgatgtaattcagcaacattgggattgccacacattcgtttctcagtaaaatactccagagagctagaataccttgattctctttgccgactgtgttcatcgttttgacgtttatcatttgtttatgtgccacataagagcgacgaccctcactataaaaatgttgcaattgatctggctattaattcactggtgctacgggtttccgacataattctgagatgatgagaaaacggattaaaataactttgtcgacaatgaggagatgccgtactcctgtctttggtcggcgcaacaggatagaccgatcaataagagtcatgtagctcctcctatccacaacaagcagctgaagaaaaccagagtttgttagactgttacaagtcagggtcatctcgtcgtctaaaattagctgaacaaccccatctgtccgaaagaacgcctgaaacaagcaaatgatgtgtgcacaggagataggaccaaatggttaagtatcttggatgtgtggcggtacttttaacaaaagcacaaatcacggtagctttcggtcttggattctgcgggaaagaagaggagacatgcatgcatgtcagcatgtggggctgaatcgctgagaaagggggagaggaaagggccatgctcatctactgatctatactacatgtgagcttgcccgatctgattcgctaggagaacagatggaaggcctggtatgcacagcaacaataatagatcctttcttaattactccctccatactagtaaagaaagtagtttataacagcgacacggtctccaaaacacaactttgacttattgtttctataaaaatatttattgaaaagtgatatatgtatacttttatgaaagtatttttcaagataaatctatacatataatttatattttcaaactcaacaacttaagagtttttcatgatttatattcctcagttttgacttaaacattgttttaaacgacttttttttatgagtatagtgggagtacgtgtcgacagaagagacaagttcaagtttgaagaactcaggctataggccgggcagctgagaccaaattaatcaagttcagactgaagaattcgcaacaaggacaaataaggttcatgacatgaagatacataaaggccaatttcaatttttttcttcaagtttctaactttttcgtcacatcgaacttttctacacacacaaactttcaacttttccatcacatcgaactttcctacacatataaatttttaactttttcgtcacatcatagaaaagttaaaaatttaaagaaaaaagttggaatctaaatagagcataaacacagccttaagttccagttctagctaaagcctcaggtacgggtcatatccacttgccctgaaaagtcagaacatcgcattcgatcaatacaagttagcgcgtaaatttagctgaactctcttgggggttaaccgggtaagcgacaagttaaccatagccgcacatgaagtctcagatctccgcaggggggaaggagccgagccgagcgaacacacacagcaccgaatttcctcgtttttccctacccgtcgcactcgtgcccaacccaacgcgtacgtagctgtagcggggtggctgtctggctgagctaccaacaagccagtgcaagtgggggatcggttttgtcctgtcatttatatatatgtaagcatccagcctgagatttgggtgacgctagctgatcgctgactgctaccgt

SEQ ID NO: 60626 - DNA, 943 bp, Oryza sativa
agattgatatttttttaattgtattttgatatcaagctactcgcgatatgctctttcatgacactcttgaagtgttgcctggaaactatggtgttataaacttgggagtgtccacatggtgttaataagcttgagtcagtttatatggtttcaggctggacattttgactgacgcaatactgacatattgtctatttcttacagagattcttgacttctgtgactttatatcaccttctgctgaagaacaatcttcacgaacagctgctgtgaaagctgtctccaatgttatcaaacatatatggcctcaatgcaaggcatagtaacacacattgtccctctcttgccatgtgcgcacgcatttgatcagcattagctgcaagtcatttggtaattctcgttttgcattgcaggtggaggtcttcggatcttttagaacagggctgtttttaccaacaagtgatatcgatgtaagggattttctttttgtgctctccagtggatttttgagcatttaacttgctgttctgttgagttgtatgatcccctggagcataacatttactttgatagcaatgctggaatcgtcatacttaacattttgatggatgaaatagcaatacaggagaaaaagagtaaacacagaaggaaggtgtagctcagcatgcactttctgttttcctgttttgcagaacagggaggaaaaaatgggatgtatataattagcaatgtttactcagttttcctggagtaaagtatgaaatatgtttctccagagtgattttcacccttaattgcattgttagctacttccactttcatatcaaagggatacccttcttctgctattctatgattatgattagaagaaaaccgtgatgcatagcctgttacagacgtgttaagtgttaacccctacttttcacctgggaacaatgaaata

SEQ ID NO: 60627 - DNA, 3169 bp, Oryza sativa
tcatttttgttgtggatttggtttttggtttcaaacatctgcgatagggttgaaaagggtatggattagcactgctatttttttaggactgcccaattatggcacattttcccctactttactaaaatttaagtactaagcgaccttccgctaattttcagaaagtgtttaggatcatgtgttattattgctattttcaatgtagcaattgcttcctgtattctccattccatagtcatggctcgctgcaggtcctgggtgggggatgagttctcgacaagcatgttacagttatagtcccaaaagagtattgattatgagcctgtttctatgcatgtatgcaattttattttgcagctaaatggaaagtaattgtatgtgttttttctttgaataaagggcatccattcttgtctcgctcaggacctctaaaatgttaggactggccctggatgggggtgaagccatgaaagggggtttacatacaaactgggtaaagcggttcatcatatggccaaatctccaaaacattcttatcattttaaaactgccaagacattttaaaagttttgggtaagattacattgtcatggcaaaacattctgggtaagacacatgtcatttcactgccatgacatattaaaactgccaaaacattctgggtaagattacattgtcaattcactgccatgacattttaaactgaagcaatgctactccaaaaggtaagcacataaaaccagagcgggtttattcaatggaaaaaacacaacacacttcaagtcacaaacttacttttggaaatttcctaaaaatatacctttaacagctttgaatcatgcctagaatatatctttgtatcataagatcgcacatgctgcttttgttgctctggaactgttcataatacataaggaaaggaatgtcagcaattaaaattatatgaataaaccggttactatgtaaatgctatgaacagagtctacataatacttctattcaccaatagataagctcagcaatacaaaaattagactgcctttaagccaggctcatctattgtttcctagtataaccctaggctgagaatcgagtgtaaaaccctctttggggctctaggcccatcttgcaaaaacacactggccattggatgagattacaatagattgaacttaaagaagcttcatgtggtgggatccccataagtaaatttctcgatgctgttggatgaaaattatcatccatgcagtgttcaagactccttaaatgtaacccatccaagtctcatctaactgtatgcattctgagttcccatgatagcattttgggttcatattagatggagcatgagcaccaaaaacaaattagaaatagtcaatatacccctgccagttgtagattcaaatttgaatctgctcctttttttaatatatatagacctttttaaataatttgaaaccgctacgaagttcttctttctgaaatataccatcaacgtgttcctctgtttcaagataaaccacaatgggccaagactaaattgccccttcttccaccctctccccttagtcctgacaaccttgtacaaacggccccatgcacttgacgtcacccttgccctcctctatatgctctcctggccgaaccaccactatgcctctcactaactcatttaagagactacaacctgcctcagtcatcccctctccctcccagtcctcccctccctgcttgtggtaacctcaccatgaatgcagagacaaaacaatgtggaagattcacacaatgtaaattaaaaagaagatagctagaatacagaaaaaaggtaatttttcatgactaactactacaagaatgagcagtagaaaagcaaatgcacaaaatgtctattttcatgtactacaatgtgcaaagtaagtagttattaggaggctgtgcaacgatggcaatagagaagtgtagcaatgcacagggaagatgataaaataaaaggtaagagacaattgatgacaatgagttagggtggatagtgttataatcagggatagaactaatgtatatttactagtatatactattcaataaaggctaaaaggagccatcaggctcactttagaggtacagaattaaccatgttaatcataggcaaagagaaagatttataccattgatcatggtgggttcattaataacagtgtacattgatcgctgcagatgcatgaactgtctagctctccaaaatttcacacaaagtttcagctagttttgttaaacagcatggtagcttttcagtttatttaaaaattcctgcaatatgtcctttttgctaaattagtcattgggaatattaacactttataacatggtcttgctaacatagaaacttggcaactggccaaatactcaaaattcacctttgcttttgaaacattatttatcaatcaatcatttttgtgcatcttcgtaacaagtccagttgattttctttatttaactaaacagtgtccatcccataacatcctattgcgatttccctacttgcaggaacaacaagcaattaagtaaacaaaattatttgatttcaacaactgcagagcaaaacacagttggcttaacagtactataaaaaggtgacagcctgcaaaatatatatcactagcattcaagtttgaagttttagcttaatcctacgaagtgcagggttttgggatgcatacctattggtgcaccgaaggagccagggggaagtggatcaaagtcaattccgagcaccggcccgtcatccctcagtggctccccaagctgcgactccacagaatgaatcacccggagctcagatggcatgagctgcatcgatgccaccggtggtggcggcagcattactggtagaggttcataatacctccgcccaatatctggcgcagataacctgggcactgctgaggaccgccctgcaccccttcgcgagtgaactgggggcagcggcggctcatcatacgggctactagcaccgatcagtagctcgccacttgacagcggcagtgctggtggcggcaacactggcggaggtgccatcaatggcaccgctgcagcttcttcctccctccgttgccgctttgtggggggcttccgatccttcagccgccggtgacagaaccacatttgcagc

SEQ ID NO: 60628 - DNA, 3608 bp, Oryza sativa
cgcctccgggattgggttccgatttggaacgcttccattctatgcggccgcgcttaacacacacactcccctcgctcctataataaaaccaaacccttttctttttctttttggcctcctctcctcaatccaacttccctttttattttattttcttttgcgtgactttttttctccttagcaccggtacgagttctgacgagaggaatatttggatgggcagaataattagtggtggagtgcttggatttcttgggggtttgatctttgggggttgcttttgtgcttttgacgagcgcggggacgttttctggtggggggaaattggcgccgtatggagggtgacgggtttgttggtgttggtgcgcgaccgcgcgtgttcgtcgatcgatcgatcgatcgactctctcgtgcagtacgagggacggagggagggaggcgttcgttggacgaagcgtgggggctagattagaactcgcgcgggatcttctgcggcggatggacttgtggcaccgggcgtgtgcacgtgacaggggactgtgaggcctgtcagtgtccgggctgatgtgcttggcgtactgaacagggtttttgtttcctggtgtgtgacaagggcagtgatgagttcagacagtggatttaacggggggatatcaacttgagtggatgggtgagtgagacttggtcgcgagtcatgatggtgttggtgaatttatgtgtgtgtcaactgttaactgtgagcagtagctccaagagaaaatttccgctgtcaacatgaatactccatcaattcaaaatgcatagtaactccgtcacatgaagaacgaatctatgatcgaatgtattatccaaatttatagtattagaatatattattagattaactttatgttattagtttggtgttaaattttgcctaccaatcatttgacaactttaattgtatatactacctccgttctaaaataagtacagtcgtatatccgtgtaccgtccgtctcatatgtaaaatttattactttttttaaaaaatagtcacacataaagtactattcatatttataatctaataacaatataaatactaatcattttttttaataagacgaacggtcaaacattggacatgaacagtgtaaaactacacttattttgggacggagggagtactagccatttagattgatgctaacttatgccaaaatcaatagagttgatatactcttgcctaacaaaaaaaattggtagtacctaaacttacatctcggtagggttttaaaccaaacatgccctatgtcttaaagcggaggaaataagaattatggtatcacacgtgaaagggagagttttcttcaatacctatgctatacaatagcaacttaaaaaataatactcccttcatccaaaaatataaggcattttagatagatgagatatatcctaatactacaaagttggatactcccttcatccaaaaatataagacattttggatagatgagatatatcctaatactacgaagttggatagagagccatatccttataaatatggatggccatatcctatacaactttgaccacaaaccaaacacacccttatattttggggcggagagaatactattatgaatattagtagtgttcaacacagcggcccctagttccaactgaagatagagatgtagaacagaaactagagtaaataaacagagcaagaatagaaaaaaaaagtaaaatccataggctcaagcatcaacggagcatagcattcaacaaaaagtggtgtttactagttcaggatggtggtggagttgagtagccggcggtgtatagatgattaatggcgactagtagcatggagatggcacgttcaaagcaaagccaccaacaagggtgtcactaattcgagcatcgagagccttgacgcataggggcacaacaactggacttgggggaatcgatgaattgaggatatggacaaattgcgttggccagtagcagtgagttgggaacccaattcgtcctcctaatccctagccatctctgggtagggctctcaggtttttcccgcccactctaatttgggaaagatagagtttgtcaccttgtaaactactatttcgcaccccgtctagtcacctcggcacttgcctcgtcactttcgtgccatcgtgtgactaggcctactaaggtggtgtttggttggagggactaaagtaggggtaaactttagtccctctcacaaaagtataagtccctaccatagggacttatccttttgtgagagggactaaatttagtccctagttcccaaacaccctctaagtgttaaagttgaccaccgaggtaatccaaccgcctagctcactactagtaggcaaaatggggcatcaaccccttacctagcgccaaatcaccacctagatatatttttttaacaccagatattaaacctttattgaaaacttttattggatttcatcagtaaatctattcaatcattttgtgcaaagaagttagatggaacatattgatacaaaggtcatagaaatgtatgtaggctacatttggttacatgtgtagagggtggctcgcacgcatgagttgtatgagatggatgaagattaagaattttgtggcacactttttaaactgctaaacggtgcgtttcgtgcgaaaactttctatataaaaggtgctctaaaatatcatattaattttttttcaagtttgtaatagttaaaactcaatcaatcatacgttaataccacctcgttttgcgtaaaaaacttattcttcatcttcagaagaaaagaacaccaccttagagtaagtataaaaagatgatgtaaacggactatataagttgccacatcagttgtgtgctgaattggagaagataaaagagaagaacgggctcaaccaagttttgtgagaaaaaggtggatcggttatcaatggtgttagtatgtatgatagtatcatggtgaaaggcatgaatcctgttgacatgtttcctccctagcctcccaaggttttaatctcatgaggtgtactcgtcactcttccacggtcattaggaatgaaatatcattaccttttcgatagtaaattgcacagtgaactatatgtttttatcgatgtgatagtttggactaggggtaaggcattatttttagcttggactatatataagtttgcaaaggtttcaatttggacccttattctccatcctcccgtatcaatactctagattgtcatgctggtgagctggtgttgagctcgcgatctttttgtagtgtctcctgctaccacatctatgacccactccattgtcgtagccctgaagcatcgcctcatcaccaccattctcagataactcccactgtattgttcaaaagcggctccttatgttgcagccatggagcaccaccgcccgcctccatcttatccctaagcagcctcgccatgcacaactcccactacaatgaccttggagcgtcacccattgtcatagtccttgaggactggtcttgccttcctttttgtccccatgctccgactatctaagcttgacctttatcagcaccatttcatcctcatgc

SEQ ID NO: 60629 - DNA, 3864 bp, Oryza sativa
cctccgccagcctcctcccgctcgcatcctccctcctctcccgctcgcgcgagctcttcccctcgcccggcgagctcgagcccccgttcctctccctcctccgcgcctactcccgcgcccaccagcccctcgccgcgctccacctcttccgctccgcgccctccgccctcggcctcccgcactccgcccgctcctacaccgcggtcctcgccgccctcgtcgctcactcccacctctccctggcccgctccctcctcgccgacatgcgcgccgccggctttgcccccaccaccgccacctacaatgtcctcgtcaaggcccactgctccgacgccgccgtccccatcgacgacgccgttcgcgtttttcggaacatccccaaacccgacgcgtgctcctacaatactgtgatcgatgggctctgccgccgcggccggctgccggaggcccgcgacctgttcgcggagatgattgcgaatggcactgcaccaacggtggttacttacaccactcttatccactggctcgcgcgggaggcttgctttgatgatgctctgaaactgttcgatgaaatggctaggagagggatcatgccgaatgtggtaacatacagttcactgatcgatggattgtgcaagggtgggcgtgccgcctcagcagtggagctgctggacaggatggttaaggagaggaagcttccaaatacaatcacatacagttctgttattgatgggctctgtaaggagggctgtctgggtcaggccatggagattttagaccggatgcgtctccaggggaggaagcctgatgctgggttgttcggtaagctaattgttgggctatgtgatgcaggaagggctttggaggcttcaaattacctcgatgagatgaattttgctggcatccgaccaaaccgcttgacttggagcctgcatggcaggataaatgatgcagtggtgacagcactgtgttctaagggtgaagttgtaagggcttttcaggtgtaccagagcatgcgtacccgtggaatttctaccaagccaacaactttccatctccttgtcgagtgcttatcgaaaaagaacaatttagagaaagctgctcatgttgtgcgtgacatgttatcagagagatgcatccctgagagggaaacatgggatacgattgtacgtgcatattggagtaagaaaaaggtaagacaagaagctgaggaaatgtggagccagttaaccgtttcaaattgaaataaaggtacagactacactccactgatacatcgtatgcgcgagctgttgccaagcaaacattgtgctcagaggtcatatacttcttactctttctatgctgttacacaagtgggagatttgttgtcgatagatcttacattttggtgttcacttttccaggttatgtaatgatatctgtttttttttgaagttacgagcagttggcagtgttcaggtatggtgcgatgttgttttccatagtcccatacatcttgttcattactccctccggttctatattaattgatgttttggacatggttgaggttaaatttttataactttgaccatcaataactttaaaaatatttagtttaaagaaactagaaaaacatatatagatttgtctttcaaaacactataataaaagtaaacatgcatttatttattgtatatattataatagaaaaataaggtcaaaggtatatcttgtagagcgtgtcattgtccaaagcgtcaattaaaatgaaaccggagggagtacatacgtaaatatactaagcattaactttaattgttcatatatgtggagtttggtgataaatgatcaaaacctgtagctcaaactattgcatagcaagctaggcagttaagtcaaatgtaattattgacatattgtacaaccaatgttaggtagatttattgggaaagtgaaatgttagctaggttattgcactgtttcatattttcatatgtcgattttattctattcatttttctttcattttcttatggactgctgagtagcatatcaattgttcaggtttattgcacggcaaaagaaaatctctacaatgtgaacctccctggaaatgcacagtttctagtgatgttttccatcggttccctccataaagattaaatcaaatatgtttattactttccacttgcatataataaccttgttttccaaaagaaattcactgtacttttgttctgatagctttctttagagtttatgctgcttaattgtcatagtgaatcctctgcttatgacatgtctaacatgcttaatctatgaattcacttaatggaacaggctaaacagcatcgcaaaatatggaattatggatcttcattctattggctaggagtataaccatgagaaaaagtcaacagccaaaatatcaagtattgagatacatgctactgtatgtttttctgtctatgttgaggggattacacctgtttgatcaatcaacatgaatttgagcgagcaagatctttgattaccagactgttgtggagagtggaaagccaatgtcatggtgggtggctgggaagctgacaaactgcattctgccaataaccactataatagtcagcaatattatgagaactttctttgcttactcttacggtattggattgaagcaagacaccacattttggtctaacagcgctatagaaacaaaagtcattgctgaaacagttcaatggacaaagtctagaaattgtattcattcaactacaacgtgtggatcaagaggtgcttgattgtcgatgaccccacaatcccttgaatgcgacaaacctatagcgcgcattcccttccttatccctgaagctatctgtgaaactgagaacaaagcagggcaacgcacaaagaaccatcatgttaccatttgatgaatgtaacattgtcactgcaggggccttgtgctgccgttgccaaggttggagccaggaattggaagacagggacagtgtctgaaggaagaaatttgatgttcttatgtctgggcggattgttttctgcatgggctcatgttgctggtacgatcaaatatattcaacaaaagaggattcctctgatcctgccagcaattccatgttgtggtgacggtggtgtggagcagacatagtagctgtcctcttcgtccagttcgttctatttagcgttggtgatcttttgttagaggagacgcaactagggattttatcaatggaaaaggaagggatttgaagggaaggaaggtaatggtctgttactctgtttctgtttgttgtccgtttatggatgccttcttgcaagaaagatgcaaaaattaaatgaactgggagttctgctggcaagaaatgcgagaatgtttggtgttccagtttctcttttttgagctccaacagttgtagacgcacattggtaacggaaagaacagttttttgggtctaaaattgttctgtggcagttatatatacacgtaaatagatgttccctcctagccgtgcttaactggattatgcatttggtttgattcttttcatctggtatgaagaactacaatgccttgctcatagatgtggatccaccgagccatgcatatgtcagaggcaaaaatgggctgatccaaactcatagatgcaaagcccagcccaatataaggctgcaaagcctgcaaagagaacatcgatcatcctcgacaatcttcagaacaacagcacttcttttttcttttttgagaacagaacaacagcatttgagagtagagacaaacctgcatgcatgcttgcctcacctaggcgaccacataaagaccattggaacaaaacagtttaggctctccaagtaaaacacttt

SEQ ID NO: 60630 - DNA, 7671 bp, Oryza sativa
taagtaacatttgtcttgtctcttggcttcactaggcgagttcagttcttcgtggtagcttagctagaggtggtatcactcacatggatacatcaggttcagttaggtacatgtactctatcgtgcgatatatggaatgcatcagaagcaagtccagtgtcagtgtcacacgaagcaacatctaatcgccaatggtcgatatatgtcgttgtccatcatgtaccaaatcacatgaaagtcctacaaaagcaatccctgtattcgtagtaattaactgctctctagattttttttgggggttaaaattctctcgaataaaatatgagagactgtcactgagaaattactagtaatatctttgactgccaatgttcatttcataccgatcgttcattcattccttgatgttgagaaaagtactctgaaatatcaagagaaatgagaaaaaaaaacgtgcctttttctagctttctgcgaaaatttaaggcgcatggtagagtcagagagcaagttggagaagtgattgcatccttgaagtctttgtgcattttcatacccatctgttgaaaaagtgtggtaaaatgtcaaactccaacataattccgattctctcggatcgaagtactgcctccgtttttcaacatgacggagctagctatagatggtgagacttgccctacaagttaaattaaatagtattagtagcagtggagtacctgattagattacactacttaccaacgacgcatatacctctccaactaatcgacgacgcgtatatttgttgtagtctaacgcaaagattgtcacagtcgaacaatagggagacgcttgcatgtcaagatacatatggaccagttatttttaactcttcgagggagaagcagatacgtgcacactttgtgctttttatatgccctcctgagaagcacaatgagattatatactcagattaaacttttttttcttcaaccaaatatgcatggagaaaatacatgtgaaaaataatattattggtgtgtagaaataggttgcaaatctcgttgaagaaaacgaataatatacctcaactgttcttttttttggttttttttgggggggttgaggaaagggtgttaaattattttttcgtaggctgtatattattttctaaaaagtattaaagtttaaactttgaccattaagtaaaacatattcaaggtactttttctgaaactaaagcaattcaaggtactttttaatacactaaatgcacgaatctggctaattattgatcaaaccatacaacattaaactttcaaaataaaatatacattctcccatctattgccccatctggtgtactaatttgacacatgtcgactatgctaaaaggtagcctaaccatgtactcatctacatctatctatctatctatctatctatctatctatctattctttactaattagacactttgagagagaagtctaatgacccctcgcaaacaccctacttctatttttttccgctcacacggttttatttttttcttaattaagtttatatacacaaggtatatatatagaaacttttaaagtagaaacatcctttaaaagacatttaaatctgagtgatcatacatttaacataatatttgaatttcaatcttaaaataccagtaattatagtccatataatatcctcaagggttggcgactaacacgttgtaatcagcctgaagttatgcttgtggttgtttgggtcactcccttattttgccaaacttcaccaccctttctaggatataccacttccgtcccataattaatatagcaatctagtgtcagatatgacgcattctataactatgaatttggataggggcgtgctggatgtgacacatcttataactacgaatctggacatgcccctgtccagattcgtagttttaggatgtctcatccagtacaaaattgccatatatggtacatatggagtatatttgtttcactatcaaagttatggcataccatagtttttcaattcaaaggcccacatgtcttacacccatcttttagccaaaccttgtctaagaggtgtggccatcaatttatgaccacacctttggctaggttttgtaaggaggtgtggcaatgtttgggagtataatgctataccttaaatacccttgttaattctcacctacttcatttgtttcacattataagatgtttggattttgaatatagttatgcatggatccatatatgtgcttcatatatgtgtccaaattcgtatagatgttagtggatctaaacgagcgatggaaatgccaaaacgtcttataatatactccctctattcccaattgatcatcatctaacttttttggggttattcccaagtgatcatcatattattatcattacataagtctattcgttatctgtgtatgggagtaaatgaatattggtgcatgtatccctgcacataatattttacaaccaaagtgatgtcttggtttgttattagttagaaaatagtgagaattgtccacatgcatcgagtttgttaccaaagtaaatataagtatatgagagttatggatttttctttttttttttgatcttggtgcgctcctataatacgatgattaattggaaacggagggagtagtgcctagtactacttatactccctccatactcataaaggaagtcttttagaacaatgtttaagtcaaaccttgaaaatataaattatgaataactcttaagttgttgagtttaaaaatgtaaaaattatatatatagatttgtcttgaaaaatactttcataaaagtatacatatatcacttttcaataaatatttttatagaaataagaagtcaaagttgtattttggaaaccgtgtcactgtctttacgagtatggagggagtattatacttaattaactaatctctgattcctgtcaatctgatccaggggcatgacgtatcgcttagctcatcgcgaccggccggaccgatacgccgaagatcaatggtcccaaatccacgccctcaaacttagatcgaccggtccaaatcccgcaggtgcgcatgttcacgcacgccacgacgcatctgcacatggcccccaaacgcccagatcgatcaacgtacgggacggatcaatacacgcgcggacgcgcctcgtctcgaccggtggatcgacgacgtacgcgcgcgcccccccggctcggtcgttcaggagtccttttgtcgctgggggctgggctctatacactactatcatcatttctctcttccaagacactctacggtgacctcatatctaaaagtccctctctctcccaaatccatccccatctcacgcggtcacgcacgcgcgcgcacaccgcagccagcccagccgccaccccccgcgactcgatccatccgcgagagacgactgactgacaggcgatcaatcgtgctgccaagtagtagggtgttgtgcgtgttgcaggtggggcggtgtggtgtggtgtggtgtggtgggacgtcctcgcgatcgaatcaggttgccccatctccactccaccctcctcctcctcctccccctcctccacacgtacgcttttggccagccggtctaattccctctctctcatgcatctagctacctcctctctgtccctcctttgccttttcccccaaccctctcctctctcatctgtattctattgcgaaatagcttagggtattcgcaatcccccagtttgatagagttatatcgatcgaacgtcatacacaccataaatcacagatcgaatggaataatattaatcaaagtgtacgtgtatagtttgtttaccaactgattggatagctatagagctagctaaccgtgttgaaacgatgaacagtggttagtatatgtgtgcgtatacgtatttcgcagcggctacctgcacgtacatgcacgcacgcacaccctgcgcgcaccgtaccagccggggtctcgcgcgcgcggaggagaatgtaggtcatcctgccgcctttaatttaaaccccagccaaagtacacgcatttcgcgcaaccttctcctcgaccaatcgcttcgtcatgcatttcatatgcgtttggtgtacgggtcttccggttaatcgcaagtgtaggtgctttcttgcaacgcaagcctttggccatggactatactatagtagtagtacgtacgaccagcgctatagcagcagctaagctatattaacaccggccggtgtcatttctgacgtgtaaatgttaaccgtcaaattggtgtggtgtgtacgtgtggtggccggacgtccatatctcgatcgggagatgtacacgcagcaactcgcgcgcagagaatccggcgcctggtttgcggctcacgtatacggtttgcattagcaagcccagacttgagggccaagcaacaccgcatcattcgcccggatcgatcccctgcgttctatgattcgctctcgctgttcgcctagcttaattagctatggagtttgattgattgatttattgtcagtttatcatccgcgcgtgttgccgcacacctcgcgacgacgacacacatgacacatatccgtccatgcccatagctgtcaaacgctcattgttcagcctgttaatcgatcgctttagcctttcattttgatctcctagctagctgttgcacgtacgtcccctatagctagctcgatctctctctaatcctagtctcttgctccttttgtggagtgttctttctgtagttgttgcctgcactacacagctgatgcactgccggttctgcctctgcctgcctcgccagagagagagagagagagagagagagagagagagagagagagagagagagagatcagctcgtggcgatcttcctgggaagcgccaaccgaaaagttggtgtgagaattgatgtattctcctccggaaacacttttaatcacctaggtagatacacccatttgttgtatgtcaactaaatgtgtatgaaaaaaattcaaaaaaatttgacaagatagattcatatgtaatatatcaccccacaaatatgcaagttcaaattcaacttctataagttgtaacaaaaataacaaatcaaactctgattagtgtttagaatccaccttcattctcctccttggtctgtaccagatggagatagaaaatcagtagccgcgcgcagcagctgggccgggaaggcaggcagggaggattaggcgattagcagctagtaggagtagcttttaacagggacaagcttcctatagctcccctctcttttctctttgttctccctctcgtcgatcaggccgctttgttccctcctctcctcctttctctctccctcctcccgcgcgcggggtctcgccttaacgtttgccgcatatgggggcgacgagcaaagcgtaggccggagggagggacagggagagagagagagagaggctttctggctcgctctctctgcacgatctctcgtcttgttggattatacagccatgacatggtgcaacagcttcaacgacgtgcgcgccgtggagaacaacctggccaccgccgccgccgtggccgcggccaagaagcagcagcagcagcagcaggtctcccagcacgtcaacctcatcaagacctgcccctcctgcggccaccgcgcgcagtatgagcaggtagctagctagagcttcctccctgctcgatcgatcgatcggtctcctgtgtacatgttggatggcattgagcatggtgtagagtcagttgcaggcagcggcggcggcgacgatccaggacctgccggggctgccggccggggtgaagttcgacccgacggaccaggagctgctggagcacctggaagggaaggcgaggcctgacgcgcggaagctccaccccctcatcgacgagttcatccccaccatcgagggcgagaacggcatctgctacacccatcccgagaggcttccaggcacgtataatatacttacatgcatgcttttcctacgactcatcgacatatatcgaatcagttttagtttcatcagttcatgatctacataagtgcatttgtctcgatcagctagcttgcatgcttaattacattgtgccatcagctatagcaattgcaaagatgatcagatctggacgggacgtggaaactataggtgctgtccgtcacggaagtactcctgacaaaacattttcttgcttggttgattctcagtttaaaattccctattttgatataaagttttactggtcgtttccaatttgatgaccttgcttcatatatgtcaatcatgcgtagccgcttagtatttgtaacatccacactagggtatatacatgtcgatcgtccttgcgtttttcattaatttcgtgtatgtccgatcgtgtgttgttgcatttgagcacgataccgtataaatattgctaaagtttgcctttgaagtaattgcttctcctacttgcataaaagtttatttcacattgaaaacgagtgattgtgacagcacagtgcatcaaaggtccacgtcatgcaggatacacgcaacatcagatcaaagggagaataaactttgaaaagacttgttgcaatatgaactggtttttcccttatccttttatattcctagtatttaatttgcctatatataatggtgtatttgcatgggtaggatagtcattgtatatttgtgcaataaggctatgtttagtttgtgtgccaaattttttttgaactatacggacacacatttaaagtattaacgaagactaataacaaaacaaattacatttgaagtattaacgaagactaataacaaaacaaattacagattccgtctataaactgcgagacaattttattaagcctaattaattcattattagcaaatgtttactgtagcatcacattgttaaatcatggcataattaggctcaaaagattcgtctcgttatttacatgcaaactgtgaattggttttttttcatccacatttaatgctacatggatgtgtctaaacatttgatgtgacggaaaagttggaagtttaaagaaaaatttttgaatctaaacatggcctaagaataactgacagatactttaaattattatgagtgcctttcctgcttttggaaatataatattatattcttcaggggggttgcattccattccacaggataacttgtactattttctaccatagtgatagaaatattgcaccaagagacattatagtgcactgatcatattattttcatggaactctattttcatataagcagttatcaataataaaccacgtgtcaccattgtactatatattaatccagtagaaaatgatatattacaaatacttttatctagcaagaattaattatgattaaaaaaccaatgcaagtggctctttatgtcgtttacaacgcaaacattttttttctttgttggtgctggagctagcggccgttcgtggggtattctcatgggaatattggtgtggtagtctgttagacatatgcgtgttgagctggaaaacaatgtgcatgcaggggatgctccttccatggtacaaagtaattttctttacatttcatagattacagctgacctaaattaattctatctgtaagaaaataattaagccgacaaataaaa

SEQ ID NO: 60631 - DNA, 9792 bp, Oryza sativa
attcctgcagcccacttttataaaagtttaaggttgtagttaacatgcataatcttttcctttttttacaacctgggaaatttcatttctatgttaagagatgcaaaacacaaatacgcccccacctcctctttaaatataattttattcggtgaaactttaaagtttaaccatcaacatctctcaaatatgtatttaatttgaaaataaaaatcaaaagagcagtttttttaagtacttttacaatactaaatttttgttacacattattgttatactaatagaaaaaaaatagtcaaagctatacgaacgaataaagttggtagtgtaatactccctacctcagaataagtttatttttgtctctcccatttattttaaaataaatttatttttgaacactcattgcactagagtttgtgaaagtaaataatagatgcactggaatgtaggtaaaatgaggaataattgcattaagatttgataaagtgagggtatgtctttttgttttatattggtacatatgggatgagtgtaaaataaatttatttttggaacagagagaatatgtattgaaacaccgagcaagtatttttcttatgatggaaaggacgcaaaaaataactaaacaataacagttcagggggagagagatagaatcagagaattgctggagtcggcccaaaaccatcattaactgggcccattcgtcatatagtttgactgaatggtcttatgctgcgtcagccgtcagccgtcaggacattggaactggtcaactggatactacgattacgaagccactcttgttgtgttgctgacctgctgttgcatgcatgcacgtaatataattgattacatttgcatctcttaactcattcgtgagagcagtggcagtgtggcactctaccatattaaccgtactgttctctttctgccgctgttaatttcaggagtcggcaaggacggcctgatccggcacttcttccaccgcccgtcgaaggcgtacacgacggggacgcggaagcggcggaaggtgcacaccgacgagcagggcggcgagacgcggtggcacaagaccggcaagacgcggccggtgttcaccggcggcaagctgaaggggtacaagaagatcctggtgctctacaccaactacggcaagcagcgcaagccggagaagaccaactgggtgatgcaccagtaccacctgggctccgacgaggaggagaaggacggcgagctcgtcgtgtccaaggtgttctaccagacgcagccgaggcagtgcggcggcggctcggcagcgacggccaaggacctctccgtcgacctcgtcgccggtaacaacatcaaggctagcaatgctgctgctgaacaccaccataacgacggcgtcggcggcggcggccacggtggcaacaacagcagcatgctgaaggaagctgcaggcattgtagatttctacaacccagcggcggcgctaatcggctacagccaggcggctcctaacaacagggcggctgcttctgctcatttgacgatgcctaactttgaggtgcacacaggaggtgcaggctttggcccctgatggatggaagaaaacaaagcaaattaaacatatttgactgatgatatatataggttagatggagagggcagggcaggtatatgatggcaaatgtgcatcatgcatgctagcatggtgtaatttgcatcgagtgaaaaaaaaggagtttactaaaccgtctacgtacgtattactggacaataaggagtgtgtcgagtgagttgctgcacagatgttgaagcgtaggggggtcgatattcttacagtgttcattattgttacatgtgtacacatatataacttgacattctcaatttttttgtttaatgatatatatatatatatatatatatatatatatatatatatatatatatatatatgttgttctatacaaaaataatgttggaattcaatattgtacattgatcgcttaaatataaggacttgctttttcataaatataaaaaaaatgttatgcatgtgtaaagtatcatttttcttattatttagctagacaactagtaagaatatcccagcccaaacaataattctctattgaatttttttcttagtttgacaatctatgtataggtataggaagtaatattttagtatctagtttattaagaaacaaattaacccacaaattcaagacgataaaaagatccacattcttccacctgacagttaaaaccaacatttcccaccagccaagtgagcccaggtgagctaggctcatgatcagagtagtcactgtgggagtgtgttgcaatcggtctcatcgtctttctcgtttgtaccaacaacatcgccctcactgtcagagtcatcgtttcgatcgctagtttccgtcccctgacttagctagaggaccaggttatcttcctcttgttccgtaagctgtgggagcaaagtttcttggaataaatgaggtatcgtgccatcgtcgtgttctgttccctccatattagaatataataagcattttagagttagacacggttattaaaaaaatatatagaattgaatggtggagggttgtgattggttgagtagtggaggtaggtgagaaaagtgaatatagaagagtgttgtgattggttgggaatagaatgatggtggagaagagggctaaaagttgttatattttagaatggagggagtagattttatggtgaccatgtagaaccctccccagtaaatcattattactttgtacttatattgcatttgcatcctcaagcatttattttgcatcctcctcaagcaacactagtttctatgaaaaaggtttttatgtataaaatttctatgccaacttttatgtataaagttcctattgtatactgaatgttgctattaagaagtttcatgtaccaagttttttaatttttagctgggctaaatgtcaaatgagctcagaactctgcgtacgcactcttgtaacccgttgtgggcctaataggcttgaagtgaggccggcacatgggctagacacgtttgcaggccattgacacaacatcccctgccgtatctgcctctcgctcccacgtcttgaacacggcgctaaacttgatccagccttcgatgacaagtggaccaccaaatatatcaaaagagtaaattgcgttggcggtacaaaaacttggcaggtgggtacgattaggtgcaaaaacttgaaaaccaaacgtatactactagaaaaacgatttttcatggcgtcgccctataattttcgctggtggccgtacgcgaaaaccgccagcaaaaatgtaacgagtgatggggggctacggaccgccagcaaaagtatattttccctggcggccacgctaagagatccgccataaaaaaactctatttttcgaggcggagcacttaagcgtccgccaagaaaaatcgtgttttcactagcggctactaacacctccgccagaaaaatcgtgtcttatctccacccactgcgtctcctctgtccttgtcacgccccgaactagtcccgaccggaactagcccgtgacgctccaaattaacctgttaatcgataccagtcccaggaaacagtgctggtatcacagggagacagagtatcacagcaacagaggtctctttattaaagagtagaagtatagtcatgttgggctgcggacagatcccgagctcacaactgcattacaaaaggaaagcggaagccaggacttggaccaatcatcacaggcacgacttgggaactaggccgaaaccctaaaactcatcgtagccgacttgctcctggaagaactcctcgtcagcaggatccacttcatcttcttcagcaactggggggggattatttatatagagcaagggtgagtacgggagtactcagcaagccaggggaaataagtgtttaatgcaggcttcaaggaaaggctgttatttttgcaatttattttatttgaactcttttctaaaatgattaggtgagtgcttctcaaacgactcggatgagacagtgcgtctcgtccggtcggagtatgtgcaatgtgtcactctttaggattgcaacaaggttggcacccggccaacagcttttcaaacggccacccgggccaacaacttttcaaacggccacccgggccaacaacttttcaaacggccacccgggcctagctgatcccgtcagctgctgatttttcaaacatcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcattttgaaagccgatacaggtttaccatatgccaacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttatcttatgtttggatgaaattccaaggaaatcggtccttaagtgcgagagcgggaaaccgtacacccggtacgttccccggtccgcggttctggaaattcatttagttcgcaagcaccgacccaggtgtcgggttttccaaatctttcgtaaaacccaagttttacccaagttgttattcagattataagtttgaaggcgtccgtcgatactcgcacaggatgcacgaatatcaagacgcaactaggtggttacaaggggacatgctgtaacaattaacaaggaaaggatcaaatgcaacaatttaggtaggtccgccaatctgccttgcagacggaacaatagattaagtgcgatcctatcaatgcataatattttgcaagcaatataattagatttcaaatataggctcaagatgttcaaaggtggcttgccttgctcgagatctggagcttgatcctcgaaatcctcgcactgcgggtcttcgggctccggaactacacgcgaaacggaacaactcaacaaacggcgaaaataaagccctattaatgacctctaagcgtgccattagatagatctcgagatttgaggaattttggaagttgaacggagtcaaacggatttacgggtgggaagatattgaatttctaagattattggatttttggtctaacggaaaaaggatttaattaaatcctttttggaaaagaaaaagaaaagaaaggagggagggaatatagacttttctcgggtggctagggtgcggcccaagagatttggggcagctcggccgagcttaacggaccggccggcccaagacggcccaagcgcgcgcgcgcgggagggaggagagagagggagccggtggaccgggctcaccacgcgtggtcccgggtgggacccgcttgtcagcggctcggctcaccgtgcggagggtgcgcacggcgcacgcgcgcgggcggggttgggacgcggtgcacgcgcgcggctcgcggtggacgcggatgcggcgggcccacgcgcagcctcacggctcgcggtggaacgcgcgcacggggagggaccgaccggggtgggctcgacccggtctaggctgagctggcgccgacgtggcgcctacgtggctgccacgcgggccggcgggaggtagacgacgacccggccgcgaatggacggcgggtggcggcggcgagcagcggagcgaaccacggtgatacaggcaaaagcgagcacaccgggcggctgcacgtgacaaggggagacgagccaacggctcggattcgtcggaggttgctcgacggcggcggattgcggcggcggcaaccggcggcgggagaagagggaaacggcgacgaggtcacgagaggtcgattcccggcggtgagagcatctacgcggcgtcgggaactcgacgctagcgtcggattgggcggaactacgccgagcgaggccggcgacgagcgggtgctacggagctcgggcggcgacggcggcgagcacacggcgagcgacggcaacagtcggggcggcgccggctaactacggggaggctactcgagctactaccgaaatctaaggggaggagatggagcgaggaggaagaacggagggaggcactaccgtgcgggacggggcgctgtgacgagaggccgacggcgcgggagtaatctctccggcctcgggccggggaagaggaaggagagggcgcggccggagtcctcttccgcgtccttgctcgtgccggctcctccgacacgcgcaacgacgatcggcgacggcgaaacagagggcggcaatggcgcggaggcgaaaatgagagagtttggagggggagggcttgggcttaaatgggcggcaatgtcggtttgggcgagggaaaccgacattgaacggtcaaggcgcgagctggcgctcggcgcttgcagccaaagcggcggcaggaggatgacgccggcgaggaggaaaaagggaaaaaggagggggagaaaggggcttgcccctttgccgattcgggaaaaaggggaaggggagcgggagcgtcgcggcagagggaggaggggcgcggctccgtcccttggcggcttgcgcgcggagtggcgggggccgggcgatgacgacgacgatgacggggggacggcttggagcggagcggcgacattggcgacaggcgcgtgcagaggctgacggcggcggcgaccgggcggtcgaccattcggcacgcgcgcgcggcttgcaacgggcggcgtccgcgcgggcgcgcgcacgcgaacacggcgcgcgggaagcggcagcgagggagcggtgagggaggacttggctcggcgcgggcggcttacgcgtgctggctcgcggggccgagcggaggggcgcagggcgcggctctcgcgctcgcgcgcggcgcgcgagggaggggcgctcggcgcggcgacacgcgctcgcgcgcgcggcgcggggcggagcggagggagagagggagagagcgggggcgcgccggggaaagcgagagagagagccgggagagagaggggaagatgggccgagggaaaatcggcccatcgaccctgggggaggcaaaatggacttttgcggaggaatttgatttggagggattggattcggaattgaactcgacgatagatcggggattgagatcttagatggcacggactctagacaacaagcaaagaaacaaatttcgcaattagggtttttaagagataattttcccgctaggcgccacgacggaacgggcgaaacagtcctctccacccacctctccctctcctcttctctccacccacctctccctctcctcccccttcactccccactagcagcggcgacgagcccagcagcagcagcacgcggatcgaggcggcgcccgtgcgtcgcgatgcggcggcgctcgtgcagctcacggcggcggtgcccgaggcggctcgcggcggatccggcgacgggaccagatccggagcggaggagcacacggatcgaggcggcgcacctcccaggtctctctctgccaccaccacacactctctctctcagatctggcgcacgggccacgatggaggctgcggcacggctctgtagcggcggtggcgaggtggaggcggtggattttttttaagaacaacggatgaatttttttggtattttattgtgatttgtgaatggatgtgttaatttgtggtgattttgtgatttgtgaattaatctgttgaatgtattatgagatttggggtgaatttgtgatgtgtgaatggattgggatggttgatgccatactgtagccacgtgctaatgattcaaatttttgtgatgctcatgcttgggtggatggagctttgatggaggtggaggcggacggagcgttcgctccgttcgtcgttttttcttataaacttggtcagtattttctctggcggctggtatagtgtaaccgtcagaaaaaaaaacattttcgctggctgccgtcttaaaccagtcgccagcgaaaatggatttttgctgacggctggcttaaggcggccgccagcgaaaatgttttttcgcttgtggtcgataaccgctagcgaagatcttgattttcactggcctttgctttgtggcggctccaaattccgccagcgaaaacccaaaatagccaccacgaaagatggttttcgtagtagtggtagcggtacaataacttggctggctaggtgggtgcactcatggtgcaaaagtagccacgtaaaagaaattgccaccttactattccaccttagcaaaattgccacatcagctttgacatgaaagaactatctcatttcatagaaaacccctaatagcttttttttttccaatcacattcctttttaactcaataaacaaaacaaacgtatgcatatcttcttccatctttcttgacgtgatcctaattgagaggtagctgcggtggtggcggtggcggtggccgcgacagcaacgacaacgagcgaaaccattacatcgcggtggcgatgagggctccgtgtgtcacattagttcaatccctaaaccaataaccaaaccaattcaagtcgataaattgctgctgtcgacgtgatcgccgcaagctttgggatagctccgactcgacgagtttttggagcatatgctcctagcttgttatggtaaatcacttgctgatggttgtagacttctattttttgttcatttgatggatgattgcaaagtaaaggtttcattgatctatacaatggctgtattttttttgggttttcacttgaatatcatattatttgttattacaattcaatgaagtgatctaatggtactagccacgagattggttgcactaaaattattggtgtttcctgtagctgtatacgatataagagtaacattggcaatgagaaattcttgctagatgtgttgtaccattatcagcagcatatagttagttggataatctgcaaataatcttagtgtattattttccttatgcggtatatcacatcaaccaattattttgtagtgcaggccatgagaaagaagaattcacaattgaactgcatcatggtgggtttttctttttttggagttggcagtagtagaatttatttggatgagaagatggactggtttgatcattgcgacacgaggaaaacagatacatctaaaaaagaagtaattgaaatataaaagttactagggacttttctgtaaaatgataaggtcaatgctcatgtgtcactttcgctgaggtggaacaatggcgtggcaacttttgcaccatgagcgcacccacctagccaagttattgtactgctatactcggcttttaagtttttgcacctaattgtatccacctgccaagttcttatacagccaacgcaaattactcatatcaaaatgtgcgtgggaagtgtccgactccggtccaatccatgatgcatgaggtagatgagtgcgtatgtcacacaaattaggggctagttggccacataatcacatatccgaagcgcgaaatgcacacgctttatccgatatcaaaccaactgtaacagatggcagaggatttgcttcctagttcccaactcccaagtggccaacacgaaacatcttt

SEQ ID NO: 60632 - DNA, 2068 bp, Oryza sativa
aggcggcgggcgcctggggcagcgtggtgcggctagcccgggcgcggaggcggcgggcaggcgcagcctgcccagcgcggcagcagcggtgcggcggcttcgcgacggccgctcggcccggcaacccaagacgcggcgacgtctcctgggatgcgcgggacggcgcgagggccgcgcgtaggcggcggcaacggcgcgttggccatgcggaggtggcgggttggaggcgcgaccagcgacgctgggcggcctgggtcgccgttggtgggcggcgaggtggcggcggagcattggcttcggcgaggccgccgttgggcttggcggcggtgtggagcgcgctggcggcggggtcgtctttcccgtggttggccaggcggtcgctgtgttcgaagagctcctccccttctttgtggggagcttctaggcacggtgaaggcgttggccggtctaccagaaagactcaggttgccaaggcgaggttgttcccggtccggtcccataggtcggattcgacgtggaggctgaagggcggcgtggcggaggtggcctgggtcagcgtgctagggcgtggcggcggggtcgtcttccttgttgtcgaccaggctaaccctgtttggcgagctcctcccctctctgcggggagcttcttgacaggctggtggcggtggtcagttgacaaggaaaactcaggttgccgaggcaatgttgttccatgtccggactcccttaagttggattcaacggggaagccggcgggcggcgtggcagaggcggcttgggtcagctacctggcggaggtggttggtgctgtggcagtcttgtcgttggcaagactggaagccggccggcggtggggcgtcggttgggtgtggtggaagccatgtgccgccgatgtttagatggtggtttcggattgggcaacggaccatggcggtagggggtaccgagcgaaagcttagcccaacctttgggccaacagtgactacgctttcgggtcgctttcgggtgtggtaaccctcctgagggcatggttgaggtacccctcctcccttggcaaggagctctgggtgaaaaccttgttccgtttttgggacggatgacgacggcgtcttttggcgtcgcgaccttcctgagggcgtcgttttagagtcttcgcgtcgtggtggtgttgttggcccggtggcgatcggtctcgcatagcgacggccggttcggtgctcggctcccctctctgtagcgtgtgtttgcggttggcacttggttcggggcgtgtgctctagtgcacatccttcctcgacaaccagctatcgatgtaaaaccttttcttgtaaccttttcttccaatcttaattgaatgacctccttcggtctttccggcgaaaaaaaagtggccaacacgacaagttagcaacacccagcacctgaccgccgagagtttccgcactccgctcgcctgcgcggtgcaccggtgacactgtaccgaaccctgcgcaacccaatcacgtaagctcaactaaatttggcccaaccaaatgctcgctgctagtactagtacaagcgataggggggtctagaatgctcgctgtccatatattagatagataaactggtgagattttacagtcgacggcttgctgctcagcacttgcgctatatagaaagagaagtaatcaacattacagagaaaaaaacgtgcagattggtggcaggacacatattagttcatccagcaaaactttagactgtcacagacaacaaacgctatgtcacacaatgtatgtatagctccctctttgggatgtggacagcggacgtacagggttactatcagatactgcccaatgcaaaaactacaccagtacagaaaaattacagtggaacgcatacatctgcatatgaaaaaaatcgtcacactgaaaagaatcgaatccgacagatttatatagcaggaaaggtggtgctggtgatggctgtgttgaagatggcttatctgctgattcggtagaaggtgcaccattgtaacggtgatattagaatcaagatcacttgtcgcgtccgtcatcaccgg

SEQ ID NO: 60633 - DNA, 3775 bp, Oryza sativa
ttccttaacagttggtgcgtgatccagctccttctgtagcatcttattccgcgttatgactaaattcctcaatgatagacgaccatgggctgaaaagtgaaagatcctttgtaagtgcttgataatacatatatttgagcacatttagtcaaataacaaatgaattctttagggcaacaacaacaacgaacagattgaataaaaaacacttaatggtttggctaaactcatgagagaggattggaaaatatgcaaatccttctctctctctctctctctctctctctctctctctctctctctctctctcttaaagaaatcaatgcacatcctctgtatttctaacaggttcatggttcattggtctgctcaagccatacgccctaaaataagtctaagcacatattcctattgacattttactgatcatgctatagcttgcttaaacatacataatcgaaatatgaataaagacagtgtatagcacataacttatgagatgcaaacaaggaaacataaggttttatcatgtgcatgcatgaacaatttgccactccatattccacaaaatgtgatcaaactggagaaggaaattacagacacttgtgtgtggtacaactctctaataatgacacttttgcagacgagatcatgtgggtgagaacttaatttctttatcacaaaaacagtcattgacaagaaccaaaattcttaatggaaacatccaaatcttttgaggaagtagcaacgctaattaaggaagacctagacttacggacttttgccttcaagcctccctaatttcctttctttctttccctccgatgtatccttaagttgtattctccccctgatctaagcccctttaaaacgttgtaacaactcttttttgccctttttccttctaatataaccggcagccctcctgtcctctaccgtttcaaaaaataatagaaacttactactgataaattttggtcaaagtaacataccgacagcctagtaagttcatggtttccaacatggagtgccagacctcgtagaatttctccatgtaaaagcacgctttatagaagtcgcagcagccaatctcagcaatgctagcctgtctggtggactctgtggcatcgataaagtctgaaaattcgttgacaaacttcaagatcgatcccttgcatgccatctgccatactttcttgcttagctactggtaaattagggtgtgtttagttgggaaaaaggaaatttttaggtgtcacatcggacgtttgaccggatgtccgaaggggttttcggacacgaatgaaaaaactaatttcaaaacttgcctggaaaccgcgagacgaatcttttgagactaattaagccgttattagcacatgtgggttactgtagtatttatggctaatcacggactaattaggcttaaaagattcgtctcacgatttcccctatgactgtgcaattagtttttctttttatctatatttaatgcttcatgtatatgtccaaagattcgatgtgatgtttttggaaaaaaaatttagggaactaaacgggcccttaagaaagtgtgtaacatcggtagcagtagtttcttgtcccacatcctggcaatggtcattgtcaaaagcatgcaagtgtccttttcaagtcatttagtactttgcagggtgagattgaactccaacctgaggaatatcagcagaagtttgaattcatgaagaaacacagaatagtttctgtcaatatcaaccagtacacgtaatttcacaatacagtttaaatagaagcatatcaacataaagcaactgagaaataatatgcacctggggatgaaaacggagcggatacggacggataatgctcataccatattcgttttcatattttttttaccggatacaaaaacgaatacggataactcgaatacggatagctcgaatacggaaacaaatacggattatctcgaatacaaataagaatcgaatatgatcggacacgaatacggaaacaaatttttctcggaacacgaaaaccaactcaacttctaatagaaacaaatatcaacatatataattagctcattttatataaaataaggtataatttataaatattttttaaaatttaaataatattaatagtatggactagtgttaagagataaactactattaaaatctataaaggtatattgaaggttatagagttagaaagaaatggggtatatctcatgggtcctgcggatattcgaatagcactgttcaccggatatccgaattattatccgtatccgacggaaaccctgataccatattcgtattcgtatccgagagaaaatatccatattcgtatccgtatccgaaatatccgagaattatccgatccgaaaggtatccgtatccgtttttgtccggagcggacggaaactatccgctccgttttcatccctatatgcacctcttggatattccaggtaaatgatgaaatgcttcaacagcatatccattcccagcataaacttagttaggtcatcggtgctcacgaccaagtctagtggccctgcataattagttttgggagtattacatatttacgtctcgcactaaaaaatgtcaacaagatgcaatgttctaagaataaacatataccattcgcgacactaactggattgacatatcctgcaaggcaccgacatcctataccaggatggctgaggataaggcatgtgcgcacatatacctacaaaaagggagtgtcaacagttacaacccgatgtaattcaagataaccataagaaaaaggtaacacccctttttcttctttgcaaactttattccataagaattcgttcatgaaatgagataattaaaagttacacacttacctgtcaacaagtcagagaactccatctctgacactgacaccaatcacaacaagggatacaattggtcatttcagctcaaggggaggtggcttactgtaacagatacccctcctccagcagcagcaactctagcatatcttctatcatccatttattttctgaaacacgcccggcgattcttttttttcttgaaacactggatctccgcaatctgaaacattgccaatgaggtggtctaagatgaaagtttggtaaaaataacttacccaatgtgcaatttaatataccaaagagagaatgggttaaccagcttgattttgactaataagtaaataatgacataaaagctataatagaatttttgcaaaagggcgatatgagactacaggtcacataagtaatattgcacaacaagaccacatcgatcacattgcatcaaccaacaaaaaaatcaaagatattcaggaagcacgaagcccttacatggatatctcaaaggcaacaaacacacctatacatgtataactggaaattctaagatgacctttatttggaggaaaatggatcatctgaagcaaatgatgacccacttcccccaaaacctgataaaggatatagctgttgtgaactgattctacaagatttagggtgtgtgctaagcaaagcacgtccaatgcaatctaattatctgcacgatcacaaccataaataccattttattgaagcaaagcagtactgagtaccgacaatagcatgcttaactagttaactggagaagataatattctactgctgaacaagctgaaaaattaggtctccaacacactgatcaaccaactaaatgctcaaaggtgaaagcaaagaacaacttatccgtacctgttg

SEQ ID NO: 60634 - DNA, 3023 bp, Oryza sativa
ggtgaccacgagcccacagagaaagcaccggtggtgctggtgccccagcctggatttttcacattttggtccttttaaaaaacttatttcgcaaatagacccctagaaaaacttatcctaaaaatggtcctttttggggcgccagagtggctggcgccgtcgtccaacaggacagtgccagcctctctggcgccgtccccctgccgacgtggcggggcgatgctgaggtggctagggagtgcgccagagtggctggcgcccccccccccgaaattttttatttttgttttatttgtttgatatttttttcacgcttagggacacataaaaaccaaccatagaaaaattgaactcaaatggacgtaatatgtgacctgtagaatttttcctctcctctcctctctctccgaactagtgcaaaggagagatgtgcaacttttttatttttattttattttttgatatttttttcacacttaggaactcacaggaatcaaccatgtaaaaaataaactcaaacggacgaaatatgtggtatgtggaattttccaaagttctaccgaaaaacttctctcctcgaaaacacaatcttgcaagcggaatttggaggttttaatatcgccgaacccggcaaagctagagagaatcggatgtaacattttctatagatgtccgtgcatatattatttgcctgattccgagtccgtatgagaaagttacgcctattttattagatgacatattttgtccgtttcggtagagttttggaaaattctacaagtcacatattttgtccgtttaagtttattttttatacggttggttcctatgttctcctaagcgtgaaaaaaatatcaaaaaaatgaaataaaaataaaaaaaattacatctctatgtactgtttaacttatatatgtcatttcatgtggttatattttgaattagattaagtaatttcatatagtggtagagtgcattatgtttaacatgctgatcaaagggttttactaaaggaattatggtctaattttagtgaaggtgcaaagtagactgagtggtatgctagctattttcagacttagttaagtggtagttcgagtttaaattttttttgtggttggttgtatcgtgatcctaagtgtgaaaaaacatccgaaaaaataaaataaaaatgacaccgttgcaccttcatacagagaaacaggaatggaggcggcggcgccagcatggctggcgccctcctcctgccacgtcggttcgcgtgcgccactgtggcaggaggacggcgccagcctctctggcgccgtcccgttggatgacggcgccagccactctggcgcccaaaaaaggaccatttctaggataagttttttcaggggtctatttgcgaaataagtttttcaaaaggaccaaaatgtgaaaaatccagctgccccagccccctgcccgttctccatgtcttcgatgtgatcacacgtgggggagaggaggcgttgacgtgggatgaccagtgggagagagaggaggggttaatgtggggatgacaagtgggggagaggagaggatcgtgttgcctaattccccttttataataggtgagcagataactatgtgcgtcaagccgtcgattaatgtaccgttgatgtacagttgcttcccgtgtactttaacgtgacagaaaaaactacaacaccagttagctcgattggatccaaacaaaatatttataataacaaaaataacttacatatttggactccatctttagcacatgacaaataattttagtaccgaaagataaaaagatacgggggctgttcagattgatgtcattttcagccatactattttttttaaagttgtcaaaaaaatatctacgtttagtttgttgccaaatttggtaaatatataaaaaatcttaccaaaattttgacaatattaccattttggctacaatctgaacaggcccataaaatatcgagagagcgaggtcaagtaactcaattgattagtttctgtctacttaagtcatacatttggtctacttaagtcatacatttggtacatatatgcttgtatttacgattcatttatgtgattttttcggtccgatttttatccggcgtacgtcgccacctccgtcactccgattttgctgcgcaatgcggcccacaaagtctggagtctgtgcgccaccagcctgcagatcgctcctatcgctacaaatcagacgggggagttgggactcctctctgtctcgcgtcggcgagccgttgacacagtggttccagggcgcaccgtacagcatggatggagcaatggagagtagtatcaggcgcagcagattcttttttcacctgaagatgtacttcagcacttaagtctttacggatgtgtataaggcaagcgattaaataaacaatggtcacagctgatcataatagtgattattttttaaaagtatacatatatatggttatcaaattcatatactctgtatttatatgtttttcaataatgaaattttattttggcctttatttcaaacataaatctatatccatatatctttatctatacctaattagaaaataggtaaggcttccgggtcgcttggttccggcgtacgattacgaggatgacggcctggatctcgggaatcctgtcgtcgtcttccgctgttgtctcggcgccgatctccatcgtcgtcgtcgatacggcggcggccatgaccagtattgtctggcacccgtcgttcgcgatcgttgtgatcgtgatggttgtcgtggtcccggtcctcgtttgagcggtctcctcgatttatgttatcatggcaccgtgaagagacatgacgccgagagcgattcacgttgtctcgtgtgcgtcgtgcttctcggcggccgttgatttgatctcggagatcgccagtgccgcgaggtggaggggtagctcgttgaggtgattccctccgttccggatcttcaccattggcctcgccagttggtggctgctcctggtgtgct

SEQ ID NO: 60635 - DNA, 6989 bp, Oryza sativa
tcctgcagccccatggcgccgagaaagactttgcagctcgagaggtcatgattctttgtcttgtgaataggacaatagacatcctgagttggagaagtacgttgaattccatgttctttgcaggcgcgaatttcaacacggacgttgaggaaaacccagcaatcttgcagagtgtgtttcttggttttgtggataggacaccaagaccttgtggcttcggaagtcatctttgtcgactcgtggttcatgtcggaaggacaaggtttgaccgtatcagaatccttctcgagcttagatgtcatcgatattccgttcttcgtctcgatgggaggatttttcgacatggaatcgccttggttcgtagccactgcgttctcgtctccagtcattggaggactggttgagatcggcgtcgtggtgtaaaccgggaagacgatttcgccgacttgagtccataccagcattgttgaagcagggagtactgaggctagtgctgacgttgttgtcgacgaagctggatgacatagtagtagaaccttgagtaccaaggccccctacctggcgcgccactgtcgacgggtgatacccgtagaccagatatagagggtattggggtacgttggtacaaggacctacgtagtacgacatcaagcaaacaaaagacaagaattatactggttcaggccccttgataggtaataaccctaatccagttgatgtgggattatatggtagaaaacacagattacaaagggaacaagggaacttgtcggatccggcgagattgtagtcgagttgtttcgactagccctcgacgatttggctcctcgtaggctccggcttcataggctgtgtaggttgtgttggctctgagattcgatatcttaaaccctccctagggggtcccttttatatcgcagatctagaggtctccacgtagaactcggacgtatcagaccctatacgatacgccaacgacccagttctgcccgagtaggattcttcccgtctataaattccgtgaaaggtttccttacaatatacaggaaatattcgcatgcgcgtggatatgacatatcgatatgtaacgtatatcgaagggcaaagggtatgcctaacccgtaaccctgacaagcatcattttaattgcttatgactgtttattaatttaattctagataaactaaaccaactagaaatttgcctacatatttctcatgatgtgtatttattttatgaccaacgttgattataaattcatataggttttatttatattcatgtttataaattatttatgcctgacagtgacgtaattcatgaattatttctgtttaactttgtaattaattgagccaacacaaattaattattttcatttatccacgtgtttcgtgttttacgtgtcgcataaaagatttttaaacacttgattaacaacactaacccacacgccctccgtccccatactcactaggtgttcatcgcgtacgcaggtcaaaggaaaaaaaaaatcagggatcagagatcgaatcaaatcctaatcacatacagcgggcaaaccacaaaatcgaatgtcgattaaaaacccaagcgacaaatatcattcaaagtctatatcaaataacacaaaaaaattaaaccaaagtaaggaaaaagtataatatatagcgatccaaaacgtttttacccgttgcaacgcacgggccattttttttagtaatgataaaattataatcggatagtagcgcacacaggtgcatcaataactttttccacattattaatttgatttagagaaaagaaatcatagcatcgaaggagtaacccaaatttgtgggggccaacttttcatgtgtactcctggtaaaggcatcggcttcatcaccttagccttcaagtcaaaaactccaatatcacgtggcatttgtttacggtcccaaaaaaaacttaaattgtcttcagtgaagtagatgcaatctgcacctaatccggggatcctatcactcaaaaagaatgttgccgagttgctaccaatgaagattgacgcgccaccaaaatcatgcacctctctccactcgcttcctctaggacgctcgtcaagaataaatgcttggaattttactgttggatcgggtttaagctcaggctccggctccggatcatagcggtagttgtggacttgtgggctgcattgtaattgtccttgtcattttcctcctcaatagcagtgacatcgtcatcgctttcagagtcacatcgatcggtactatgctccctcaaaatgagcatcaggtttccgttcggtgactcggctaggtacttcctaatgtagaggggcaggccgtcttcgtctcgggacataaactgtggagcaacgtttcttgggttaaatggtgttgtgacgtcatcatgttcccaggtttggactacgccatctaaggcccctcacagtgctcctagctgtagcgtggcttagtactgccacgtaggtttttttcacccgtgtcgctcggccacgcttctctgcttggacgctcgtgagtaaactaggatgcgcaaaaccaagcctggaaaagggaccgcgcagaggaatcgaggggaggcgctagcgctgtgggcgtcattccctcgccgcccggtgctctcgcgcgggattcggccggcgaaatcccctattcaccctcccaaaatcccctcccgccacaacattatttctcccgccacagataggattggaagagaaaaagcaagaaaatcttgaagattggaagagaaaaacagatcggattcacggcaaaatcatcacagaaaaatcatcacagaaggcggtgccggcgaattccaccacaaaccaccactcaagtcaactcaaatcaccccaaaccacgctgaaatcaactcaaatcaccccaaaccaacagatctggacagtgcaagaaaagaacagcagcgacggctcatgctcctcttcctcgcggcggcggcggctgccgggctcgccgcggcggcctgtgccgcgcggctccgccgctccccggggtccggcggcgctgctcgaggtcccccttcggcaaggtcgttgcggtggaggcttgccccgctcgagcctttcccctcctcctctgccgccacacgaggccagcgccgcgcttttgcccgccatcagccgcttgtctgctcccgtctccggccgcccgtcggcgacgcatcgtccactcccgccgctcccaccgctcccgagtccgcgcgggaggagaagcgagcggcgcggtcgacggcgaggcgcacggcggcggcgtcctcggcgcggtcgccggattcgcctcggccaccggagggaggggaaggaggcgcaggggagaagcggagcggcggcacgggaggagaagcgaagcggcgcgggaggagaagaaggcgatggcgatggagtggaggaggagaaagtcgctaggggtaggtggggaataaatttcgtcccgtaccccgtgtctacacgcttgggtaacgctgcactgtgggttcggttttcttcacttgtggctccatccaattaagccacacatagtatgggtgcttgcactgtggggtgggtgtctttgggccaacttttttggcgagagctacgggccccatagctcgcactgtgagaggcctaaggtgaccatgtagaattgtcctcggtaaacgatcacatcttcatacatgtgtcgcgtttgcaagggcatccattttgcatcacgcccacgagcaagcacaaccctgttccttggacaatgcatcatcatgataaagtattcaccagaactagggtcccacaacgggacggctttaaggagacgagatgaccggatttcctccgcagaaatctcaatgtcggagcaccatccgacaaacctggtgtggccctccggccagtaggtttccacgaatgaggctactttaaacaagaacctagcttcatcaccgtcagttcttggaagggcatcaaagtaaccggtagtggtgatggatggcagcgagtgttgagtgccggagatggggttaaggaggtgcagcccgcacttgtcatctgttgtcacaagccaacccttcgccgagccaatccacatacggctttggatggcaggggaaggcagggtgattgagcgacgccgtccatccgagaaagagtagaagtccgcgacggctagatgttggggggaatcaccggcggccggtagcatgagccaaggcggttcaggcttcggatgaaggcggaggttcatgccgtatccgccgcccgcttccacgtcttgcagacggcgccaaacttgatccagtctgcgaggactaggcgggttacaaatgttagagtttgtgtcgaatatgtgtacgtagtcggttacagtttaggacttggagttgtaataggtattaggactagagtatgagtcggactctatcctaggatccctcataaatagaggggcgtgcctgttgtaaccgcatggcgacttagcatagcgagagggagcggctgccggcgtcgaccggccgtgagtcgttgtaactctgatacgctatatatgatggatcggggaggagcgcccgtaatcagtgccccggagatgtaggctacggctgaactccgttaccaaatatcgtgtctcggtgtcgtcatcgttttggatctcctatggagttttcttccgtatttagctatcgatgtcgatttcggggctggttttataacaagtggtatcagagcctgcgggaggtccatggtagaggcgcgatggaggtgctccacaccgcgtagcctgctataatgcccagggaggggcattggcgcaaggtggagcacggcggcgatcaacggagtcttgatcggtggatcgaacacttctggcggcggccggaaccgtcgatggctgccttcaacagggagatgactagacatggtgctcgggttgatggcggcggaagcgattggcgatccaatcggtgggtcggacacttcgggcgggtggcttggactttccggtgagctactctcgatagggagacgtgcggccgcacgctcgggttgattgaagctggaggcaatcggcgttctcgatcggtggattcgaacactctgggcggggtggcccgggcctttcgatgtgttgagttcgacagggagatggctagacgtagtgctcaggtcgttcggcggctgggaagacggcatgcgacttgtcggcttcggctcgcgactagattgatggcgttcaatcgaaagtcggagcgggtggatcctataggttgttttggaggtgttgacgaggtatttgcgtgacaaactgctacggagaaggcgcacatacgaaaagcaacggaatcaggcagaagggcagtcaatttcagaccgtcaatgcgctgatcaatcatgttagcacagcaataagcattggttgcaactgaccggcggtattcgtcaccagcgaggttcagcgggaggctaggtggctgcgctagaggtcgtacgggtgcgtggaggctgaggaggtcacggagatggcggtgtgcacgtgttggtgttgaagccgggaccatggaacgtggccagagcccgagtagcaggaagtcggattgcgcaggactcgatctggagaggttgtgacatggaaggagtcggatatgtttccaactcggatgcatagcacaacagagaaatagattgagggagagacctagtcaagcacggaaggggaatcggacgaggactacgattcgttcatgaatcggactcgatttttcccaaataaaagcagcagaggaccacaggattgcaacaacgcaatcgaaacaaatcatctagcagagggcgagattcgtacccgattttcgcagaggcaaaggtggtttgggcggcgaggtcacgggcggctggagacgcgtcattgcaggtaggcggcgcacggcggcgtggtactcggcgacgttcgtcgcagctcaggcaggagcttgcggcggcggcggcggcggttcccggcgaggaaccggcggcggacttcggcggcaggcgctcccaggtggcaggcggcggcttcccaaggtaggcgacgcggcggctcctcgcggggtcggcgcaggtgacagcggcgggaggcggcggcgccccaggcggtttctgaggtggggggcatggtgcttcttgcggggccggcagcgtgaggagcaggaggcggcggcgcatcgggaaaagcggcgcgggcgcggtttctgggaggagcgaggaagccaaaggaagaagggagacaggatcgatctgtttttctttgactggtggttgaccaagtaaaagaaaccggtccggttttttggagaaagaaaaaaaaaccggttcggtccggctggtactgttcgagttagtcggtggggtcgattgaaccaaggcagatcaatttaacagggcaacagctgttgagttgattatcgtcgatggcggtgacggtggtttccaaatttgagatggtgaagttcgatggcactggaaatttcgttctctggcagatgaggctgaaggatctgttggctcaacaggggatatccaaggctcttgaggagacgatgccggaaaagatggatgctggcaagtgggaggagatgaaggcgcaggcagctgcaacaatacgcttgagtctctcggattctgtcatgtatcaggtcatggatgaaaaaacaccgaaggaaatttgggacaagttggcaagcctgtatatgtccaagtcgctgacgagtaagttgtatctcaaacaacagctgtatggtttgcagatgcaagaggagtcagatcttaggaagcacgtggacgtcttcaatcagttggttgtggatctaagtaagttagatgtgaatctgtatgatgaagacaaggccataattcttctgtgctcgcttccaccgtcgtatgaacatgtggtgcctaccctgacgcacggcaaggatactatcaaaactga

SEQ ID NO: 60636 - DNA, 1002 bp, Oryza sativa
gagcgcccgtaatcagtgccccggagatataggctacggctgaactccgttaccaaatatcgtgtctcggtgtcgtcatcgttttggatctcctatggcgttttcttccgcgtttagctaccgatgtcgatttcggggctggttttatatcaacaaactcgatcaaaatgtccgtgggaagtttggtccaatccatggaggagggagtcgatgaacacgaacacgtcgcacgagggagtagttaccaactcaccacagagatatataggccgtgcaactatgcaaagccatccgaaacggaaacgtcgtaggcagggttttccgatacacgtacagacaaacaaagcaaacagacctggatcgaaatcttatcgcgcagtccaacacccgagttaatgattttcgcgccccgctagctcgcccgcgcggtgcaccgctgacgctgaacatgtctcctttctcccgatcccagcgctgcccccacgcgcgcgcacgtacgcgtaagcccaactctttttggcccgtcctcgaccgcgcgcaggcatgctaccgacgccggatggaataagttcacttcatgaccctcaaatgtgatcgaaatctaaacgataaccctaaactacaaaaccaaaatcagatatctcgacccccaaaatcctaaaaccggtacaatttgactccctgagcggttttaggaggcggttttgctgacgtggcgccacgtggtgcctatgtggcaatattgaccgaatctttgttacacacggcgttgacgtggcacctacatggcggtagaaataaaaaatatacgtgggacccattaatcattcacacaaaaagaaatatgggcccattgacatgcggggcccacatgtcagtcctccttcctcctccctcactcccttctctctctttctcttcccttcttccccttcgccgccgctccctaccaccggcgagctccagcccctcccacgcgcgcagacggttggcgagcccctc

SEQ ID NO: 60637 - DNA, 927 bp, Oryza sativa
gtagtcatgcactacactgaagtgactgatcactgttgcttgcatgattggattgactatttagatgccgagtagtaattcggatatctcatcgaaccaggttacaaaatgcatgagagcaagttgtttaatagtatagccaaatactggctccaaatcaactgtagtcaatttaatagtcaatttatacaatagtaatatataaacatatacacaatagtaatatataaacgtataccacactattagtttatggtcccacatgtcatacatatatttcgtcttggagcccgtgctgcaactggctacaaatctgtagcccactgctcatctctatcttctttcatctactcgatatgtgtttatagctggcatatagcctactattgtatctgctcactaccacacttgagaactaccctgtgggctgttatattttctatgggttccgcaaccaacccacaggaatatgtatttttgtgatggttctacttatccctacagaataattcatttttctggcggtgcggccctacaggtaaatgagactaaggagaagagagagataaccctaacattcgcccatcccccagaagacttcggcattttcttccccaccgctgccaccctcccatcctccgccccctcactggatctcgcccacgacggcctccgctcgctgactcaagggagcatccaccttcgccgcacctcctcgccctaacgccagggagcagcgtcggccacctcccgcgcctcgtcgccccgacgtaaggaagaagcgccgacacctctcttgcccttgtcaggtgaggagcaccatccccgcgcggccgcgcccctcgtcgtctggctttggccggatccactctcccttcatcttatgtccgttcgggcgggcaagcgtgaacccaccgagtatgcggc

SEQ ID NO: 60638 - DNA, 6736 bp, Oryza sativa
ctgctaccccttacttctgtcatatccttcttttgtttcctcggtctaccactatttctattcattctccttgaaacctcttaaaattggatcttatagctttttgagtttattatctcgttgggtttcgtttttataatttctagaagtcccgtcaaacgctgccattatactcctctaaggcccgtccactctcttttctctttattatcattgggattttacaaatcgaacataattatcgttcgggtttattttttttactttctataagtcccgccaaaccgtcagcgggtttgccattgtactcctttatggctcgcccgctgcctcccttgagattttaaaatgcatcatgattatcattgttttatttttactttttagaagttccgaacctttaaaaattggaccttgtagtttttagagtttattgtcttgttgggtttcattttttatagtttcagaagtcccgtcaaacgatgccactatacacctctacggcccatccgccgtctattctttattttcattgtgattctaaaaatcgaacataactatcgttggaatttattttttattttctagaagtctcatcaaccatcggcggctttgtaactatactcctatataccccacccgctgcttctcctttttattgtcattgagattttaaaaattaaatatgattatcgatggggtttattttttttactttttggaagtcccgtcaaccgccttactcgtttgcttcacggcctgcctgtcgtccctccttttaatcatcattaggattttatttggtgttttattaacagtttttatatgtcgtatcaaccaccaccacgctactcctttataggcctgttacttaatttatctcgtcatgtgttttagatggtcttttctttcaatagtctttatttttatcacaaatttttgttatttataaattgtattcctaactgaaatcttatttttctttttctaattcagaatttatttttttcaaattttaattaatatcgtattgtgttcttttaatttttttattttttattttcaatttcagttgttttaaaattttattcctacttgaactctcttttagtttttctaattttagatattattatatttttttattctgaattttaattaatctcgtattgggttcttatatggattcttcttttaatattgcttatttttaatttcaaattttagctaattttaaattgtattcctacttgaactcttcttttttttcctaatttcgggttttatttttatttttatcctcaattttaattaatctcgtattgggttcttatatggactcttcttttaatattccttatttttaattccgaatttcacctatttaaaaattgtattcctatttggactatccttttcttttttaaattttagattttattttatttttattttgaattttgattaatctcgtattgggttcttatgttgaaacttcttatgtggtgtctcctttcaaagttgttttaataatatcatagattttagtagtcaaagctttgtcattaaaattatgcattagttcctatatctccttatttctcatcttatttttcgtggctaatttattgtctgtagctagttgcacaaatatctcctcgtttaagtctggttagtgtccagcacaagttgctcatttttctcgattggttgaagcatctacttgagtcgaatgttgcattaaactagttagtttgctcataaccgatttgttgtgcaattttgagatggaatctgaagtgatttggggtttgaggggagtacaacgtaggtgatacatatgcttgactttgtcttgtggacttatttaactactgcaaactaattttttttcacttgccatgctcttttttgccaatttactaacgtcactgctatctatagtatgcactgaactgaagctgttgatgcaccatatattaatgtactgcttgtttctagaggtagcacagtgtacttcaatgtttttgtgactcgggaaaatttatgcatgtcagaattgtcttcagaatttctcaattgacacatcctaaaatacttaatgccttatttttcttgttcctctgaatatgtcagtgaaggatatatagtttgtgcaaagcctgttgcttaaaagccccctcctcaatatgtagcatttcaaagacatacaaaagatgataaaatagctagagcttaaatgcttggaagagggataagttatctgcatttgctgtttcatctacttgtattattggtactggaagttgtaactcccataactcgtaacttacagtggtgataaaagattcttgttgaatgtaaattggttataaacttataagttacagggctgaaagtttgcttgtattttgatggatgaatttgtgtgcatgtgaattgctgtgtatatatatataggaaacaactccattgctataatgtgttgagaaagtattgttcagtaatccatattgacatatgaactgcattgttggttttttttttctgccttgaagttaatttttctgacggttctacctttgtttttctgacggttccacgtcaaaattatggggacaaaaacgtgacggcagtggattttttctgtgttcctccatcagaaaaatacccacagaaattgtttttctgtagggaaaccgtcaggaaaatggaatttttccgtggtgatttttctgtcggcaatttctgtcgattcacccacaggaaaataatttctgacgggaaaactatttttctgacggtttcgctcctacagggtaggtcccaaatctggtagtggctctgataccgctatattcgaagggcgtacccagccttagctaaatcttatgctacttggagttctagaacaaacagaaaaggtgctgaaattaatttgaagagagagtggcacagcgcaaaaagcctgaaaggccaaaatgatagccacattcgctgcatggccaacttaattggttagggccacgtaatcagcttgggaaccactgaaacccatttgacagggcaccagtcattacggtctcctggttttcctctcttccctatctccctaggacgacggcggtagacatagagaaggacgacggccaacggtagaggagctaggcaatggcggtgggcctcgatggcatctcggagaggggcgatgtggagggagctcaacttggacctcttatcacgtctggtgagagatgactcagagtaagccctcttcagcaactagagggtaaaaaaaagaggaggaaacaacgagcagccggcggcaaagtacatccgttgcgctccccatcgccgttgccgccactgcgaactttgatttcccaagtccctctgccctgatcctcctttgcgccctctcgagctcgtcgccatctcactcatagccgttagtggcgccaacagtctttcaagcggatcttagcagacgaagcgcatgcagatgacgactgaccatccccattgattccccttatcgttgtcagcatgcaacctcctcacgcgcggctagatgaggttgctcacgagctgcgatgtgactcccaaccccgcgtgacggcataacatccgatgaacacccagacaacgagaaggccaccatggctagttcgttacgctctatcgccgcaacagtccatgtcctcccttttcatccccttcccctacctcctcctttatgatatcctttcctttttttggcgccgttgtccctgagccttccctatagccactgccctggagagatggtgaagaaatggggaagaatgtaagggccctgacataggtttcatgtggtctcacggccattttgactacagtcaactcaccatgtgagtgaaaatcggtcaaaatactgtcctgcgacctcgggtactctggttgtaagttgtgggatatgttatatctggtattaccattcaattacacgatgcaaactcgaagttaaaatgagggaccaaaagtgcacttattccgctgaagtgctgaacattggaccgatctcctttgtgcgtcctaaccgatccaacggctgcccacgcacacgtacgagtaacccagttttatttcggcccaactggtgcccaagtgcccgaccgcgcgtaggtttgctattgccgccgcggatagctctcgtggccgccacggaacgaggtccgcgcgctcgcgattgggctggcagatggatgcctggaagcgttggaagtgggctcatatattaggagaggaacatacaagtcaatagtggtaggcatgcacactgaagactgaactgactgatctgaactgttgcttgcatgattggattggttgtttagataggagtacttggataccttaatcaaatcatactacaacatgcatatggtactagagttctagagtactctctgtatttattttgcgatggagggagtagaaagcaaaggtgttgagattttctttagaagagagagtgccacaacaatgtcttactttttttttcagattattcattggattatcaaaacggattatttggtatatacttttaaaaagaatatgttttctacaaactttttctactatattgcttagatcactcgttttaacttttaaactctttttaatttatttttaaaaatattttggttaccccttaaaacccatcgcaataagctgcaaaataatctgaaaagtacggggtgggtttgaaagtttatactttggaatggcaaccacattgctgcatggccatcttgaggagagataaagactcaaagtattctttccatgaggttctacctcatgttaaatttcctctaatattcacatgggaagaggcatttcataggattccataggatttattcttttgattcaaaaggctatataggaaaaaaaaatcatataggaatgaaattccctaaaatttttatgaatttcctttcaatcaaaaggggtctaagtttgctagccaacaatgagatggctagctactcatagacttactttgtacggcaaacataaccaaaaataccataattagaaccatctcgatctaagctctagcgagctacttcaaacctttcgccactagcgcgcagcatgtcgttcttgttgctttcctttcgtagcccttgggctacggtttactttcccgggttatacggctcatcagagttagcagtggggcataatccacaaactgccttgttgatcgtcgaaatcacaaagaaacacgcaaaattctggcgtggcggccgcggggaaccgtactgcatgccggcaatacggcgaagaagcaccggccccagtaccgtgtggatgcacggcatcatacggtacgaccgaccccgccgggggctgcgctgatgaaagatgcgcttaaaccgggggggagcagtatcagcatcagcagaacgtgacaccccggtcccgcgcgtcatagtcgatccaaaagccccccatgatcctctcgccagagcctggcaccgggccccacatatatcgcccgcccaatcgagcggggccccgaaaagtatcaggcacaggagacgcgatgcgttcgctgatctgaaaaagataaaaaggaccaacgtacgcatgcaaccgcgcggaggagaggaggcgagcgtgcagcggggcagagctaaacacgaacgaaagcccggtggtggcgagttggcgactgagcgcccgtgtacgtcgctggattccccgacttgtcaccgttgcaggcttgatgtcccccgctgcgttcgcccgacggcgggggccgtccgcacattaaccgcttgtgtaagtgagctttatgcgcggtcgtcggaagctagctagcaaacaatgccttgactgttgggggcgctttgggagcagctggcgcgcgcgtggggtcttctccggcgaagcagagcggacaacgtgtggagttcccaggagagatcgagcgagacgccgagacggacacggtcacgcagctttgctgctgatgtgggggcttcgttcactgcgtgcactcggtccgtggaacagtggattagataagaggctccgacgcgagctgatcggacaacggcgtccggctctccgaaaggccggctggagtggagtggagtacaggagggttcagcacagcgccaggccggcttaaacatgaattctgtgagaaaattttgtcatcgatcttcatctcatctctttaaacgtgtattaagagtagttatacctacgggtgtttgctgcacaggcaatgaggtgtatgtgtgtgcatctttctcgaaaaatataaatgtactcgtgctgattttaaatataccatgtaagttgtttagacttgtgttgtgtatatgaattgagaaaacaacttgcttactccttgtttttacatttctgagatttacgagggggatactaacatagtaacatttagagtatatttcattttgaaccacttttaataaccactggtagagaaaccatctttggtcggtcgacctatatccacaatagtcccggttccattaaaaaccgggactaaaaatgatttttagtcccggttaataagaggaagatctttagtcccggttgttgttaccaaccgggactaaaaatcatctttactcccggttgattccatgtcaggctgtgtcagggccctatgatctttagtcccggttagtaacaccaaccgggacta

SEQ ID NO: 60639 - DNA, 5706 bp, Oryza sativa
gttactaaccgggaataaaaatcaaaacacactatataatccatagtaccgatcctcttttcccgtccacacaacaaactcctccctctatctctttttttcctctctaacttcttatctctttccttatctctaactcccctcctctccttccttttttccttcaccacagtgcaggcggtcggcgcggaggcggcgacgcgggggacggcgcggaggcggcctgcgcggcagtcggcgcggcagcgcgggggaccgcgcggcggcggtggtgggcggccggcgcggcggcgcgggaggccgcgcggcgatgccgggggccgcgcggaggcggcggctgcggtgggcggccgctcggcggtgaccgacgcgacgctggccggccggcgcggatgggaggaggggaggcggcagtggccgccggccggattttttttttgaaatgtgaatctgtgatgtatttttgtgtgagatgtgaatatgtgatgaattttttagaaccctgtgatgtaatttttttaagagtttgtgatgtatttggatatgatttgtttgaggatttggagatgttctgtaatatgtgatgatttggatatgggaggggatggtgtgaaatcaatattcaatattaaaagcagaaaaaaaagaaaaaatatctttagtcccggttggtgttatcaaccgggactaaagattctcccatctttagtcccggttggtaacattaaccgggactaaagattgatttttagtcccggttatttgaaccgggactaaagattctcccatctttagtcccggttggtaacattaaccgggactaaagattgatttttagtcccggttatttgaaccgggactaaagatagcgatctttagtcccggattcgtagtcccggttggaaaaccgggactacagggggttacgaaccgggactaaaaagcatttctccaccagtgaaccgaagtttcatcatggaccgccaagcttatattttcacttagcacagttaccaccactctttacactttaaactagggtttacaagttagcacaagaacatcaaatgtaacaggtatacaacatcctataaaataaatggaattgcattatattactgcatatgaacattcaaagataatatatatttcattactatgtatgaacattcaaagatcatatttcactgcttgaaaattaagatatcaacgcatgttgttcaaccttgtccaaagcgtgaacgattgtaactatatgctgtgatgttacgtgaaaagataaatctagcgtagtctattgggaaactttggttgataaaagtagctcaaagtgaaatttactctaacatttatctgcaaggacatacaaggaaaaaagttgcaaaaatgtcttaaagtaaaaaaaaacagcttacaacttggaaagagtcgagaacttatgttcgagacaggagagtcaaaaaaattaatttagggctttcatggaacaaagaaaaaacataagaccttttaggattgaaatccaatggaaaattttcataggtgctcatttggaagaaagaaatgagcacttgagattcctacgaaattcctatggaattggcttgaatcataatttattttaaggatttctatcatgaggttgggcctcatgggaaactttccttgtgttatctctctcgaaaaatcctgtatttttcctatgaagcatctaaataacatatttcacacaattcctgcattttaggaattatttaaaattcctaagatcaactaaacatgccattttgattcttacgtttttcatgtctagtgtttttagattcctgagcattttttttcttttttgccgataaccacctattaattcaatactcaacagtgacacaaaatgccagagctggcaaagtggagtagctattctatgcaaagatttttccaaacattctctccggttataaacatttgacgtggttgactttcattcatcttattaaaaaaatttatataaatattatttattatgttattacttgtgtgtctatatatatatatgtatttatttatttatttatttatttgcacgaaatttttaaataaaatgaacggttataaaatatttatggttaaagtcaaccgtatcaatatttatggtcaaagagagttcttcgtgaaagaaagaaaaggaaataagctctccaagaattgcatgcaatttgactttcggcactacggtcataaaagaactggagtagtgatcatttttgctacctgacacctcctaggctcctagcagaatctttaattaacacattgcctaaattttcattacatatggcagggaaagagctacagtaatgtcgttactcgttaggccagccaggctcatcgatctcccaacgaggcaatggcttggatgaagctctacagtaaatttgagcagtacatatctacagtattcactgccactcagccagactagcggagtggtgccgttctcaggctcacggtcccggtatggtcgattcttacgggcgatagaagtcgacagtatactaaattgcattggactgactctgtgtttctgtcaaaagctctatatatatggagtagtgtaactcatgtcaatctaggtgtctataggtggtgcgaaatccgcaatttactaacgcgacgctgctgcaaatttgtaaagaatatgataagcagagattggaaagtcgtgagaagggggggcagaggcatggacgcggtccagggaatggaacaggatggcgcagcgcagcggcaggggcgtcgccaggcaggcaggcaggcaaggccatggcgaggagggcagcagcagcagccgcgcagtgctgtcactgctgtgcttgagagacccacacacacccgataaaagcgagcgcgaaagcgagcgggcgaggtggacgtaacaccccccctctactaccgctgcacacacctgcacactgcctgcctccctcccgcgcgcatcgctacgacgagccagctgccagccagccggccggccggggaggtctttcctcttttactccctgttccttgctcgtatagttaacagtagtacgtactcatgcacggctgccagtgccacagcctctctccccacgggccgacggcgagctagcgcgcgcgcgcgcatcatccgtcgcgctcgcgtatggttggcgtggcgcatcattcatcagtagtcaacagtggcagcgccgcagcagcgagcgagtggcagcctggcgcagggccgcagggggggcatcaaaattttggcagctgcgtgcatgcgtcaacaatcgtatacacggccgagtacagagatgacatgggcgcgtcgtcgtagcgtggatccatgatgatgtgttatattccggggaaggaaggatgattgcgatgcgatgagcgatgtgccaatgtcacgccgcgcgcatctcagcaaattcagcatcgtctccccctgcacgattcggacctgtcttaaacggtttagctatggtcaaaaccaggagtagtttatttagggcagtcccaaccctctatataggatggtgtctatagtattaactacattgttatgtaggactattaacttatgtggcactatattaattaagagagagagtgaagagaggaagaaattgggtctcatgcaagacacaacttcaacacgagaacctatgcactagacactatcaagttttacattgagagataatactgtcttcataatagatgaataataaatatgattggtagagaaaagagatgatgtatttattaacggtccactttaagaaacaatgagttgtagagtgtagtttctattgtgatgtcttattgacatggtaccatagacactgcttatggacactataagttgggactgcccttacatgccacataatgttatgtgatgtcatgctgctgccaggcaggtataaagacatgagcaaggccttgcttagtcctaaaacaagaattttcacggttatatagattacgtgtaaattatgagacaaatcttttaagcttaattataccatgatttgataacgtggtgttacagtaaatatttactaataacggattaattaggtttaataaatcctttttgtaattttttgacaagatttgtaatttagtttaataataagatacattttaatatttcaaaggaaaataggaatatatgatgtgacacccaaccttaaaaatttttctcatctaaataaggcctgaaccaaccggttgaatttgggtgttcaatgacggtgcattgatcgggctggccgtgcagtaaggaaattaaaagcagggctagctgggaagaaaggcagtaagacaccgtggacaaaagagtaatagcatatattgactacctccattattgttttctactggcatcgatacacatcttttactttatcgttgtttactttattacaactaggaaggatggaaagatgcgtggatatcttatttattatttatataaataatattagaagagttaagtcatatctcatcatataaatataaaaaaaattatagatttcgtctcataagaaaaaaaatatgttgtaaaatagatagtagactttaatataaacaataaaaatgtttcttgtattaaaaaatcactgttgatcaggatacatttaaactcatctattgtcgccgttacttattagcattatcgctaaatgccttttgaataaatggaactgcatatgtaccaccaaaataagtctaatgcatcattaatacataaaaacattcatcttcgctgcatacctaaatgtttatgtcacacttaatttttaatctataaataagtaatctgaaaatattgcttctattggttaatggatagcaccgttaacaattagatatgaatgccccctctaacgggtgaagctaccaaggctttatttctcttttgccttcatacataggttccgtatcgatatactcgtgcctctcaaggccagcatggagcacacttttaagacttagttcactgtcaatatcttcaaagacgattgtatcgctaagtaggaagttgagcactattgtcaatggtaccctccactaggactgcctcaactcaaccatatatatgccccatgctatactcatggtaacgcaacaagcactatcatccatgcttgatgcccttcaggggaaagcaagaaaagataaatgtgatgagaatagttctttccataaaaagtatatatatttttattttttagacacaatttgtttgtggtgttaattcaaatttttatggtacagatacaatgctctgttttgaaatgagcaaggttgatccttaaaatcgcaatatttaaccatgataagtcatcaacaatataactatgatggagcggatggttaatggaattttttttatataatatatataccttcccacatctaactgtatactggtgccttacatgcatggccagtataaagtcagatttggtggataagagatttttgatatatttgaatgcaagtaccatgtgccaaaggaagtcgttttggacagcgatatggtctccaaaactcaactttgacttcttgtttctataaaaatatttattgaaaatgatatatgcatacttttatgaaagtatttttcaagacaaatctattcatataatttttacattttcaaac

SEQ ID NO: 60640 - DNA, 768 bp, Oryza sativa
gttgaggatgttgctgctgtcgaagtagaacttgtagtagccggagtacggggagcccctcgcctcggcggacacgagctgcctgtaccgcgtcacgggctgctccggcaggagcgtgtccgtgggccagtcgaagctctgccacagccggttgccggcggcgtcggagacgacgaggttgccggtgtcgaggagctgggcgcggtcggccggcgtgccgctggtgttggtgctccacacgacgcggccgtcgtagtcctgcagcaccagcgagccgtccttgcggagctcggcgcgcgagccgacgccgttcacgggggtgtcgcggttggccgtccacgcgacggtggcgtcggcggacgcggtgaaccagacggcgagcgtgtaggcgttggtcgccaccttgtagaagccgcacgagaagttgccgctcggcgacacgaggacgctgtcggcggcgtcctccacggcgatggagccgccgcgccacagaacgctgcggcgatcgccctcgcccgccgaaagagcaacgcaacacagggaggtgagtacgatcaagtgcaagccatggactcgattcatcgtgtatcctaaccccacagggctggaggcgtgagttccaacttccaacttaaaaactggtttaaaaggggaaagaatgtggctagcctgctgacagtgacatttcccaattgagatagtgtgtaccgtcatttatttaaccattaatcttcactgtcactgccggcaagtgaacatgcttcttgg

SEQ ID NO: 60641 - DNA, 989 bp, Oryza sativa
tgtgataaaaaagttgaaagtttgaagaaaaagtttggaactatactcggcctaatttgcccttcagagaaggtgtaggacacccggtcggaattcattgcctgagtaccaaaacaaagagaatttataactacccgattggacatatgtaagttttactcacagcttattttaaattaatactaagcgatttgcataaacatgagaaacaatgagttcaaacctagtctcgtgctattgagatcaggtgcagttactgcgttaaggattatagttggtctcatttatccattttttaataaagtgttcgtatttagtacttgctacagaagcataataaatttcaacgttttgaacgacagtacggtctccaaaacatattataatacaacataaaaataaatatttagttttattaattaaagaattattttttcacttattttcgcatatcaaccaattataaccctttacaatttcacttacctatttttcttaatcttattgcatactccctattaggttgtttttaggacggatggagtatttttaaaggttgctagtatattttaaaactgatgggtaattaattgtttgacctcaaacatgttcaaaacttcaagatttatggaaaatgggagtgtggagtgtgtgggtgtgttgggggttcttttcctaactaagagtgttaaaacgatcctaacccttgaagtcagattaaacaacgataagtagtgtgactgtagactgattaagctgcagtcacactatcactgtctcatgcacaatggaattagctttctatagctcggatgactcatggccatggccaactgcactaataagcagtcgatcgagtaggcccgagcatattatctggtccataccgctacttcttgcaataccattttttcgattacacgcaggtttcatatgcacgcctcacacgccgtgaatgcacttctctaataatacatacttagagagac

SEQ ID NO: 60642 - DNA, 1937 bp, Oryza sativa
catgtgctaaaaagtcaacggcgtcaaacatttcgaaacggagggagtatttgagaactgacattttgaaaagaagggtaatagtaaattctccataaaccaaaatgaaaagttgacttttttaagaagagcaggtatgaatcaatgcatgcatgcaccccatgtggtacacggtttgtttaccaaatcacgcacccatgcatgttcagtcaaatgtcgtcgttacgtccctctctgcctgcactgcactccggccgggtaaagaggaaaccccaaacacatttcacacgagaaaaaaagatgccctgtgtcaccgacgggagaaaagtcttccacctcccttaccttttttccatcctgccccctccaagacgcgaatatatcatcatacatgtgatataataattacaaggaagcaggagggcttcttcgaaattacgaccggctactgctggtagacacgcgtacaggtggtcccgcagaggaggatgcggtgggccccacgtgaaaacgtactccagcgaagcgtaggtgggcgcggtcatcacgcggggaggagaaaaatatgcacgtgcgcgtaatggcggaagcttcctggttagggtgggtcatcgcctctcccactttcatgtgggtcccaccttgtcagttgtcacctgctgtctctctcttcttgtgtggctgaaattttacaagggtccggtggtattctgcaaaatctgttgagtggtggttaactggtgatttgttggacttgaggttatgcctgtgtttcatcaactgagtccccaattatggctgtgtttagttcaacacaaagtttagattttggttgaaattggagatgatgtgactgaaaaattgtatgtgtatgacatgttgatgtgatgaaaaaggactgaagtttggatccaaactttagatctaaacacagcctaatagccacttagccactagtagtttcgtttttgattttttaacaaacctttttttaacattgatcaaatttataaaaataatataataatattttcaacatagaaaaaaactattaaaatatattcgatgttagatttattaaaactaatttgatgttataaatattactatttttatataagtttgattaaacttttaaaaaaataaaatgacctataatataaaatggaggcagtactaagtattggtcatgacagctatcagtctctcttcagctatcatgaatgataaaatcgtatacgtgtggtattcatataatggagtactggtatttaattaatccattcccattatcttagaaaaagttaacattgttctttaagattgcgagaaaaagtctgaagattatgtattcgtagatatgacaaaaaactttgcttaatcatggtgaactctaggtttttcctaataaagtagtaagttcacactagtagtactaaaactaattaattggttacccattcacaacacttgaaagaaagctctcaattgatttgacttttccactcacatatgtgattgtgtgacatttttaaaacaaaaaaaaaaccaatcagttagtatgattgtatacctaaactaattaaaaatcacattgtgttcatttgccctccacaagcaacaaaaagctagctagctaatagctgctcctaaatcctgattattctatctggcgcctaaaggtagacaagccatgcggatctcgatcgatatactccttgcgctttaaaatgcagctgtcagcacataacgttcgattattcgatttatttaaatatttagcataaatatatgcaagtataagttaagaatataatttcttttatgataaaataagttataataaaataaataatatttatatagtattttaataagataaatgatgaaccgttatgtgaatgggcattatatttttaagagcaagtttaacagta
